United States Patent 8,105,826 (NUCLEOTIDE AND AMINO ACID SEQUENCES RELATING TO RESPIRATORY DISEASES AND OBESITY) - sequence listing, part 2

SEQ ID NO: 704 - DNA, 166649 bp, Homo sapiens
  misc_feature (1)...(166649): n = A,T,C or G
atatttttccactgctatactagcataattcccacatgtcgggggaggaacccagtgggaggtgatgaattatgggggtgggtctttccatgctgtccttgtgatagaacaatccacacaatcctcttttaccgtcctaggattcacaggtgattttcttctcttgacactgtctcaaggatgactgtaggatgctcaagtttctggacagatgatgctgctctaaagcagtgcttcccacactgtcagtggaaataccaactttgttgttatttacttcccatatgctacaaactgctacttttataaaatacaacaaagataaatttctagggaaaaaagtgaaatgagaaaacacaaagatatgcaaaatacaagttcatgactaaagccagtgtcaattaccaacaccatcaaattgctctggtgcctcctctggccttctgtaccaatttctctccaatgtgtgacaagcagtgcatgggctgtcttgagtgtgtggaccacactttgactggcacagtgatacggcctcatagccctgggtattaatcccaactgtagtaccaaccaacaaagcattctatcactttcaaggaacagcagtggcacctgccttggagtcagacattcctgctcagaatgaagtgtcttgtgtacccaagattatgtgttctggatgcgcacagatcttgggggataatatagtttggctgtgtccccagccgagtctcatcttgaattgtaactcccacaattcccaagtgtcatgggaggaacccagtgggaggtgattgaattacaggagtgggtctttcctgtgctgttcttgtgatagagaatgagtctcaccagatctgattgttttaaaaatgggagtttccttgcacaagctcctctttttgcctgctgccatccatgtaagacatgacttgctcctccttgccttctgccatgattgtgaggcttccccagccatgtggaactgtgagtccaataaaacctctttcttttgtaagttgtccagtctcaggtatgtctttatcagcagtgtgaaaatggactaatacaggggagccgaggaaactggactctcatcccatcctcaaagtttcgggtctggtttgacagtcagagaagaaataaccccaggatgagtattataaagaagacatgagcaagataccagatactccagagaagtcaggagagccttcaccaagaaggggatatttgaaaaaggtttttccttccttcattccttcctccctctttcttctttccttctttctttctttctttctttctttctttctttctttctttctttctttctttctttcactttctttctttctttctttctctctctctctttctttttcttttcttttcttttttctttcttttctttcctttttttttttttgacagagttttgctcttgttgcccaggctggagtgcaatggtgcgactgcaacctctgcctcccaggatcaagtgattctcctgcctcagcctcccgagtagctgggattacaggtgctcaccaccacacccagctaattcttgtatttttagtggaaatggggttttgccatgatggccaggctggtctcgaactcctgacctcaggtgatccacccaccttggcctcctgaagtgctgggaatacaggcatgagccaccacacctggccttgagaaaggttttcaaaatggttagacatccactggatggatgctgggggaagggggtcagtggatggagctgagagttggaaaaagataccctagtgacgcaagatgggggagccccaaaactggggcttagcctggaagggttcttgactttgcccaggaaagaactcaagggggagacggtggtgctggacagcaactgttatggaagtggctgtgcacagcggcagaggtgctgctcctctcagagcagggctccccacaggcagtgtgcccagagcagcagctcagaggcagggctgcagtcgtatttatgcccacttttaattacatgaaaataaaggggcaggttttgcaaaaatttctaggaaaagggtggtaacttccaggttttgccatggcaatggtaaactgacatggcacactggtgggcgtgtcttatggaaagctgcttatgccttggccctgttttagctagtcctcaatttgttccagtatccaagccccacctatagagtcaagtcccacgtgctacctcagtaggcagggcaaacagtgggtaaaatgtccgtaaacttgggcaataattaagaccctcgaggtcaaaatttcctcccctgtgaaatggagccgacaatgcttgctttgtgtggatattagaagtgatgatgtgcaaagcatccacatctgtgcctacgctgtattcacacaaataaatgctagtttgtgtctctacccccgcgttggtccagaggcaaggaccatgggtgagcagtcatcccctactcttgggaatgtgatgcaggctcagagatcactgggcatcgggagaattcagtgaggggacccctaacagacaaatgggcagggtaaggacaccttcaagggacaacagggcactccaggatggttccccagtgatggggaagccctcacctcccacagacctgaagaagcaatggcttccaaggcatgcaggggatggaaagtgctaaaggcgcctgtggagaatggcaagcgtgccgggtttaatgagagatgtggggggggggggcgggggggctgtgggggagtgagtattaagggattgtattttagttatgccttgtgatgagcaagtaacacaaaaactataacaaaaggccaaatgtgttcatttctctaccagagtcaaaagtaaaagctactcgagaacagcaggagaggttctgtctggccggagccaggagagatgctttctgaaggaagagacattcaatatagtccttgaataaccacaaaacaacaacagctggcacttctgagcacttactagttgccaggcactattctaagtaattggtacatatgagctcattcatcctcacagccctattaaggggcactagggattggatttgacctctccaaatttatctgtggaagtcccaaccccagaaactccaaatgtgaccttctttgaaaatagggtctgtgcaactgtaactggttaaggtgaggtcattagggcgggtccctcctccgttgtgatgagggtccttctaagaagggggaaacttgggcacaggcttgcatgcaggaagaatgtgaggatggaggcagagatcagggtgaagcctcacactctcgggattgccaaagatggccagcagccatgggaagcgaggagagaggcctggagcagaagaaaccaacctaacccacatctcaatctcagacctggcctccagaactgtgagacaacacattcctgttgtttaagctgctcagtgtgacactttgttacagcagcccccagaaactaatacaaaggggtcattatcattgttctcttacagatcaggaaacaggcacagaaagcttatatgcctaggacagtgatccagggcatggggtctggggccagactgcaggggggagccatgaacctgccatgtgttttccaggggcagagactgcaggcagggataccagctaggaatctgcaaggatgaggccagaaacaagggcaggagagggactggggggcagcgtggatgggaaagattgtagagctctgatcgccaagacttgaagacacatttgcttatacacagaaagatggaatccttcccagtgttttacagagccagcctaatcctcattccaaaacctaacaattcaagaaagaaaatagagattattctctttcacaattaaagatctctaaatcctaaacaggctactaggaaatcaaattcagtactatgctgaaaagataacgcaccatagcaaatgagcggttttatttcgggtgatgcaaggatagctcattatttagaaacttactaataccattcacatgaattggctaaagaaggaaaccaatgatcctcttgatacatctgtggaggcattcgataaaacacagagatagctgagaataaatagaaagaccctgacttaatgtgagggtgaatatccaccttcagctaatagtcaatgctgtcctgaaggtacagaggagaggcatccccataagagtaagaatcaaggattttaaatatcattactcatatttgataaccttctagctaatgctagaaggcaaggaacagaaataagaggtggaaataacaaaaaggaagagactaaaataaatgagcagaatgcataagaagaaatcctaaaacattgctatgacaataaaaataaatggagagaaatatgtattcctgggcaacaatgttgagtattgcaaaggcatcattttctccaaaatcataaatatactgaattcagttcccgtagtatgaattttggaactagataaagatgattctaacctgcatatagaagaataagcatgacagccagtgtgggtgaccaggtagcagggggtgcctgcctcagtcatgcacccagaaaacatggttcctcagcaaccttcaaccctggcccaaccctcgacatgaggccccgtggtccaggcttctgcatgtcatgtactgggacaccagctgtggctcacttgtgccccagagggggacttcctgtggcccagaaactaggaccctgctggcctgagcaaaccagcagacttctctgccattccaaaaggggcaaggacagccttctccaatgaggtctgagcccagcctggggaggggccttccagcttgtccttccttattttttctatcccagtcctagagtagcctatattttatagttaatctcttatcatcatcatcatttacattaaactttccttgtttaaatcactgtgcaatttgtgtctcccgattgtacccaaactagtacaacaggtaagtgtgttttgaaaacgaacaaggaatgactttacacaacaaaatttgtgtataatctatctatatgtatagattcaaattatatttgaataaaatactttcagaagtcaaatgtgtgtgtgtgtgtgtgtggtaattaagatagaggggattcgcaaggatatgaacagacaggtcattggaacaagatataaagtcaaggagaagaccaaataagaagaaagataacatttcaaatcagagttgaagggtgaattgtttattataacaatttgttttgagacaactagatagccatttacatagccatttaaaataaaattaattaacttaaatccctaacatatgactttctctgaatacattttaggcagtttaaatatgtaagtgtaaaaaatgaaactaaggaaatgctagaccacaatattacatggctacatgtctgtttccatggtaaaaaatgcctttccaaggatgaaaatgaaatatcttccttaaaagagactaaggaaaagattgatattcatgactacagaaacatttaaacttttccataaaattaaaaaatttcaaaagctaacttaaaatgcaaataacaaactacaaaaagtattgtggataaagttttaaaatttcaaatatctaaagaattcttataaatcaatcaagtatagctaatgtacccagtggaaaaatgggcaaagaatagatagtcacttcaatagctagtaattttttaaaaaacaaaaacagcataatctcattattcatcaaacaaatgcaacaacaaaggaatttcattttatgcttatcccataagcaaacctagaaaacaatagctggtgtgttggctcatatctgtaatcccagctctttgggaagctgaggcaggaggattgcttgagcccagaagttcaagcccagcctgggcaacaaagtgagactttgtctctacaaaaaatcaaaaataaatcagccaggtgtggtggctctcgcctatggtcccagcgacttaggaggctgagctgggagaatcacttgcgcccgggaggttgaagttgcagtgagctgtgatggtaccactgaattccagctgaggtgatggagtgagacccggtctcaaaataataataatgataataataatatcctgttagtgagaacacacacgagtgcagcctttttggggatatttccataacacatatcaaagttcttcaaaatctgcaaatctctgacgtaggaattctacagtgaagaacttcgctttaggaaatggtaaaaaataagctctaagaagtatagacagagacattctttacagcactacttataatattgaaaaatggctaacaaagttaattcccaataataggcaattggctaagtaaagataaaaggcatggagtgaaaatttgtgcagtaattatcaataaagtcacaaaataatccttaatgacacatgaaaatggttatggtatattttaaatggaaaaaaatagcaggtaagagcaagctgcatatgtacaaattacacgcaattgttggataaaaatatccaattttttaaaggggactgcagagccagtatcaaattgtcagctcaggaagcacaggacttctttctagaggtccttgttttgggctgagtctttccgcaaagacttttctggaaaaggcaggcatccccctgcccgttgacagccctgaggttatcctcttgcctaacttccatggggggttataaatagaagaccctcttccttcagaaaggacaaactctctcacagatgggtgtgctcctatctctggcagccagacctcacaactgggatcacaggattctttctcttttgccatctcaatgagcatagcggaaagtgacagcaaatggaaccattggcaggattggtctctcagaggaatattatcaaatgggacaccagtggcgcttggtaatcaaaccaaaagcagcggtagggaagagcatttataggttagaggagacactggagaattaaggtgcctcgggagaagagtgcaaatgccagctgacttcactaaaacatctgtcctttatgactcctagtttttaaaagctaattttaatttggaagcatcactggagcgctcggctgagcccagtagattccctttttgctgttttgtagataaaatgaaaaagtcactcatcccaatgaggatcatctttatcacttgtactgagccaaatgaataaatgataatcttcgaatcaatcagggtcccagcagggagaagaatctcattcagatggttccctggaagacattttaatagagggactcccttcaaaggtgggcaaagttaagcaaaacacaagagaggctgaggccccgagggagcagtgatggtaaggagtagtaccctctcccccaggcctggggggcaggaggaaggagtagcgttcccagagctgcagacggccagggccttggacatgggcttggtaagcgggagctgcaggtgcgcggggcacagccacactaagccctgagtgtgacagcagagggcggtgggaagaaacgtccgacctgtctctgctcctgctctctgcttcctggccagtgcctctcacgggccgaacccacctcgaaatgcaacagcaagtgagtctgagggatgccatccaagggacgttgaggagtgtctcctcaacagtcacgtccacacccagtctcagaatgagcttgtttgaggatagagtctttagaggtgtaattggttaaggatcttgagctgaaatcatcctgaattcagggtaggccctaaatccaatgactggtgtctctgtaagaagaggacccagacacagaggagaaggccatgtggctatggagacagaggctggagaggtgccgccacaaggcgagggacagaggacagccaggagccaccagagccaaaagggatgagcaaggatcctccctggagccttcagagggagcaggaccctgctgcctcctagatttcagacttctgaccctaaggactgcgagagaatatgtttctgttgttttaagccacccagttggggtgatttgtcagagcagccccaggaactaatagcagtcatgagtgtcagcctcccatggcacagagtagggccctgcagtgggggctggaagggtcttaaccaacagtaaccttacagccctctcccaagggaaggaagctactggattgcttccatacattggttgcaagcaacagaaatgaactctggccagtgacaatgaaaggaactaaaagggagctcgcagaattggggaaaaggatgggaaacaagcactggaaataggcagagactcggaaactcaggggcttggatgcaggggctatagggagcagtgctagagcaggaacttgtaggtcaggacgcaaggaccccagaacagccaacatgatcttgtaaaagaacagccaagttggaggactcatagttctcaattccaaagcttataaagctatagcaatcaaaacagtgaggtgctagcatgaatacagacatatagctgctcactggaatgaatggagagcccagattatagactcttatttatggtcagttaactttccacaaggaagcaatgacaagtccatgggggaaacgatcatcctttcagtaaatggtgagagacaattagaattccacacgcaaaagaatgaagttggatgcccatcttataccgtattatacaaacattaacaccaaatggaacacagcccccaaattaagagataaaactataaatctcatagaggaaaacataggcataaatcttcatgactttggattaaacaactttttcttagctatgataccaaaagcacaagggagaaaggaaaaaaaatagatatgagtttcatcaaaatttaaaacagttttgtgcccccaaaatatactgtaaagaaagtggaaagtcaatctacagaagaatatatttgtaaatcatacatgtgataaagggcttgtatctataacatatgaagtactcttacaactcataaaaagcatgccttttgaacatggaaaaaggatccaaatagacatttatccatagaagacatataaaaggccaatcatcatataaaaagattctcaatgtgggccgggcgcggtggctcactcctgtaatcccagcactttgggaggccgaggcaggtggatcacaaggtcaggagatcgagaccatcctggctaacatggtgaagccccatctctactaaaaatacaaaaaactagctgggcgtggtggcgggcgcctgtagtcccagttactcgggaggctgaggcaggagaatggcatgaacccaggaggcagagcttgcagtgagctgagatcgtgccactgcactccagcctgggcgacagagcgagactccatctcaaaaaaaaaaaaaaaaaaaaagacaaaaaaaaattatcaatgttatttgtcattaagaaaatgcacatcaaagctacaatgagtattacttcacacccactaggatgactgtaataaaaaaacagacagacaataacaagtgtggtaagggtgtggaaaaattggaaccatgatacattcctgctctgattgtaagtggtgcagcactttggaagacagttttgtttgttctgcaaaaacattagcatagaattaccacatgattggcaatttgacacctaagtatatacccaagggaattgaaagcatatgtcacgtaaaaacttgaacctgtatgttcaaaatagcccaaaggtggaaaaaccccaaatgttcaccaagagacaaccgaataaaccaaatatggtattctatacaatggattattattcagccataaaaaggaatacaatacatccgctacaatgtagatgaaccttgaaaacacgctgaatgaaataagccagccacaaaagaccacaaactgtaggattccatttacatgaaatgttttgaataggtaaatctgtaaagtcaggaacaggttaatgaggctgtgcgtggtagtgtatgtaatccctgtaatcccagcactttgggatgcctaggtggaaggattgcttgaggttaggacttcaaaaccagcctgggcaacatagtgagatcttgtctctacaaagattgttttaaaaattagccaggtatagtggcacatgcctgtagtcctagtgacttgggaggctgaggtgggaggattgattgagcccagtagtttgaggctgcagtgagctgtgattacacctctgcactccagcctgggcaacagagtgaggggaaaaaaaaaaaaaagagcagtgaacgaatgattctgagtcccagggagaggtggaatcaataacaactgctgctaatggagatgccgtttctttctgcaatgacgaaaatgttctaaaaccagatagattggtgatggttgtacaacgacatgaatctatttaaacctactgaattgtaaattttaaagggatgaattttattgtatgtgagttatggctcaataaatttattttaaaacgtctagccctttgcgaataatttatttttcgcaatcttgccaagatctttgtacaaaatatgtattttaataaaatcatttgtaggtcttggaatttcccacgagcttcagctcatattacggtcacttactacacaattgattttcttctaggttgggtcacttgtgtttattttcctgtggggtgtcctcagcaggaaaaggaggctctttttttggcactgtggtaaaatttcttcatgttatatttatagaaacataataaattcttttaaaataaatggtaatgtcacactggtctttgtttctttaccctttaaatatatcctagtatcctagctttttttttttttttttttacctctcagcaatgacataaagtattttttgtttataaacatcaaagactctttttaaacaggagaattgcttgaatctgggaggcggaggttgcagtgagctgagatggcaccactgcactccatccagcctgggcaacagagtgagactctgtctcaaaaaaagaaaaaggctcttttaaaaaaaattttatgccatttgcatattgtaaatcttttttaatacttctgttttacaattagtcaatcagtataatatgatctataacaccacatcatataataacgatctctggggctctgtagaatatttgtcaccatagctagcaatttatcaaaagaatataaattaaaaataaaaactctgcatgctttgtaagtgcatgactcatttatgagtggagagaaatctctaggataggatattttttcttcgaggctggaatatttaaagctgcatttcacaacgaagtttggtttacacgggtatttactatttgaaaatatctgtgggtggttttaggctaaaataatcatctatttccaaaaccttgatatcaggttttatatgccagtagtttcctgcttgcatgaacggcacgcgtgtctcccttcggggagacctgactttgatacttttgagtcccttgtgtctgaagcaggcgctgatgggttcttcccatttgggtttatgtctgtgaccattttgcagtttatcttaaagaggagctttcagtgagagaacgtgtgctttgcactcccttccctgagtcatgctatcctaagtagtccctgtgctaatcatcacagaagggatgctcatatcatttacggcacaaattgggacctcttgagaatgaaagagaattgcttttcataagtcgcaggacagcaggtgtcagccaggactgtttgagcaaaccaggatgcattgtcacaccggtcctgggggaaccccccggtccgagactcatctccacattgaggccacctgacctgtgccgagcattaagctaacactttgtgtgtggtgcgtttcctgacctcccaaaacaacttgatgaagtgggtgccatgacatctctacatagaatgaggaagccatatgtaacatacatgcctgcaggattccgtccattgatcatgtcctctttagatactccacactgattcctctcctattccccccctctgtctctctctgtctctctctgtctctctctgtctctctctctctctctctctctctctctcctgtctctctcctctgtctcctttgcaagctcatccttctcttcagggccattcaaagagggttcttaaggaatggtcctagaccacctcgttctcctctctcccatctcactcacccacatgacttcactcaacacccatatgtggataacttacaaatgtacatctctagtgcagttagttaatatctgctttgggatgactcaaaggtatctccaatccagcatgtcaccttttcactctcatcccgatagccaagtcttacctatgaaccttctacatatctttcaaatcctaccactgttctccatttctaaccccaccctggagcaggctccttgcatctttcacttggactattgtaatcacagccatattcctccaatctgccctccacggaactccctcctgcacaaagccctccagtggcctcccagtactttcaggacaaacacgaaactctgtcaacagtgcctgtaacaccttgcatgacggggctcttctttacctgccctggctattgcagattaattccttcaatcttcctccgacccctgtcttctggttgtgtagatcagagtggccgacagaggtacagctgatggcacagccaggacacgcacaccggggtttccatcccaggcgttaaataaggcatttgcatggatggtgtggccttgcggctggcacatgttggcatattaggctttctctcccacccttagcaagtgtgactatgaaatcctgctgtttttgtgttctccaaggctgtggtaataagtaccatagttgggtggcttagaccacagaggtgcattctctcattcttctgggtgccagacatctggaatcaaggtgccgcggggttggttccctctgagcatgtgagggagaactactctgggcctctcttcccggtcctggtggcctcgggcaccctccctgtgtcttcacgctatctgctttctgtgcatacctgccctgtgtccaaatttccccttttgacaaggacatcatattcgattagggcccatcttaacgacatcatctccacttggcctgccaaagactctatttccaaataaggccagtttcacagggattggaggtgaggacctatggggggtggggagaggcaattccacccacaacatctgccttatcctgcaagcctggttgagtccagcactcgggccctcattcagcagctcttacagagtgcctggaacccgtctaggtgatgccacacatcgatggacacagccgacaaatctctgcatgcagtggagaaagagaaggatggagatccagggaaggggtgctgtgatttcggatggcaccctcgaggagggcctcactgaggaggtaacatctgagcaggggctgggggactcagggcagccgcatttttcccagagggaagagggtgaggtccaggcaggggaaacagcagcggtagagatgtccaggctggagcatctggcctgttcagaaactgcgaggaagcgttcagtctggggcggagggagccagggcagagggtgcagccatcagaaggggaacggaaacctggcaggctttgtggccttggaggcgatcgtggctctgactctggaagagagaatttggaaggctgcagtgttggggagagcaggggtggggacaagaaccgtagtggggaggcccgtggggaggcggctgcctcatccaggcgggaatccaggtggcttggacccgtgtccattgccttcatgagccctctcttgcctgactccctccacagctgtcttcccagccctgaagtctggtctcactgctcgccacttgtttgttgctcctggcatgtgtttagcacacagcggttatgcgactcttggatgctggcatgctggtagacgctggggctgaatgacaggtcagggttggcctgtgttgggcagggagctcaggctcaactgtggactctttgggtagtcatgacctgggaattgcagggcaccaaggtctccagttcttcctcatgagctgccaaggaggctctcccacagcccgacatcctggaccccagggaggcaggactcgtgggcggtgccggaggacggtggaggcgggtgtgtgctcagtgaggagctgggagttcacagctgtatgtgctgtggggatgtcacagctgcaccgccccccccccatctagaatggcagctgacatctgcaaagggagatgcagaaagggtccagggtccttctgaaaaagagagcaaaggctccgtctgttgatgccccacctcctatgataggaaagtcagcacaagaagggggcacaggagaaagtctcctgggagtctctcctgaggaatcatggacaaacagcagacactgctcctgtcttgacagagcctaccgtctagagtgcagcacagacatccgggaagcaaccacacgcatgtaagcagagcctgtgacgagggacacaaagggaacctccagggagagcgagaatgtcacacggcagaagccaaaccacgtctgtggatgtgggcaggcttcgggggaggcgctgactgggctgtgggctgcagtggctctgggctgccgctagtgacacacaggggtcagggcatgaatttcgtgggttgcaaccaacacgttttataaaaatgaagtattaatagaacagaatggaaaataaacagattgcatggcgcagactacatgctattttgtgaaacttttgtttcagttatacatacacacacatacacacacacacacacgcacacacacataaacacacacagacacacacatacacatatatacaaatgcacacacatacacacacatacacatatacacacaatacatgcacgcacacatgcacatatatacacacgcacatacgcacatatacacatgcacacacacatacacataaacacattaacacatacatacatgcacatgcacacacacatacatacacacccatacatgctcataaacacatacacatatacacatatacacacatatgtacacacatacccacataaactcacacacaggtacatacacacacacagagacacacatacacacgtacaaatacacacatacacatatatacatgcatacatgcacacacatacacatacccacatatacacacataatgcgcacacacatacacacatgcatacacacagacacagacatgcaaacacacatgcacaaacacaaaacacatacgcacatacatgtacatatacacaaacacacacatacacacatgcacatatacacatacacatacacacacacacacgcacagttgtgataaaaatgcttttctgaccataagctgcactccaaaatgtttggaaaatgctgttttgaaggaagagtgagaaggacaggaattgggatgggcgcagggacaaaaggcaccgtgtgtagagtggacaggccacaggctgtggggcagcagacaggaggctggcacagccagggccacagaggaagggaagcctctgccaggccagcactgcaatcccaggtggcctgaactcctcacagcagcagggccgggtgatgggaaacagcaggaagagccacaaggaggggccatccaggaaggaggaagggcagggctgtgcagacatgcaaaggaggccgatcagaaacagtggggcaaacccagggggtgagcagccaagacctcagagccctggcagcggaggagctggtcactgagtcgatggagctgcctgagaacacaggaggtgaagacagtgtgtgagagatggtcatggagctcgggggcttgagatgccgaggcccctttctctttgaacagagaaacaggtcctgaaacctaaatctccacctcccccatctccatggaactagctgaaatgttggctttacttacttggtaatttcagtgaacgctttttgccacgatggcattattttacctaagtaagtaacccccaccctgtagccaatttggggggtatacttcctaattaaaaacaaacaggtcaatgggtcgatttttaaaactcggttctggttttaccttttcaactacatctcaaattcagccatgacattgccacacagctgcccttggtggaggtcaaataacagccaccgcctcgtttcttaagcatttaggctgtatttcactgattcaaagactagcatctttcatctctgacgtctacatgggctttgcccccaatggcgtcttagaattgctgttgggcaggtcactgtggtgacatggtggtcatcacagcctgcccaggctcacgcgtggtcgtagctgttcatcagtgacttatgtatgctgtcagcactacatgtgttgagtttagtcactgttgaagtgttataaaaaaaaaataacactttggtttggttttgaaaagcaggcctcagtaggctatcaaaaaggcaaatagttgtcttaagaggaatgactccaattccacatttttttcttccaaagcaacatccaaaggctttagggaatccaggaagacatccacaaatagatgaagctgagatttgagcacaaggatgagccctcacgtgccaagcagtgccaggcttggccaaaggcactgccctggcactcagaagagatgagagaaacttcacagccaagagtggtggggtagctggttcatgtgccacaggagattataattaagacattgtgtcagactgtatttggcagggacttttcttccttagtgttattttgcagtgttaaaataacaatcatttatcttgctcacaaatcttcaatttgcgcagggctcagggggacagcttgtctctgttctgtgaggtgtcacccagggctgcttgcctgggcgtgaaggatttacttctaacttggtgggagtgtggccggtgctgagggctggtggccttggttgctttccacatgggtttctccaaaggctgctttagcttccttacaacatggcggccagggcatgaaaagagcaggcatcctgagagagggagtagaaagtgacagggggtcactcccaccatagtctactggtcaagccattatagaacccagtatcaagacatggttccccaaggtcatgtcctttgcagcaacatggatgggactggaaaccattatcttaagtgaactaacgcaggaacagaaaaccaaataccacatgttctcacttataagcaggagctaaacactgagtgcacatggacacgaagaaggaaacagacactggggcttacttgagggtagagggtaggaagagggagaggattgaaaaggtacctattgggtactatgcttattacctggcgacaaaataatctgtacaccaagtccttgcaactctcaatttacctatgtaacaaacctgcacatgcacccccaaacctaaaataaaagttaaaaaaagacatggtttcctgtctgtttttaaaacatactgatctatgattcacatgccataaaattcaccctttaaggtgtaaaattcagtggcttttattatatgtacaagattgtgcaaccatcactgctatctaattctaatatgtttctatcaccccccctcaaagaaaccccatacccattaggagtcattcctcacctcttccttttagcccctagaaatgactgatcagctttctgggtctgtggatctgcatattctcaacatcttgtatacatgaaatcatatgatcggtgacgtttcttttggtgtggcttctttcacttgccgtgatgtttccaaggctcatctgtgttgcagcctgtgtcagcactctcctcttttttatggctgaataacattctattgtaggggatatcacatattgattatcagtttatcaagatagacacttagatagtttcgacattttggctattacagagacgctgtgaacatttatgtaccagtttttgtgtggccacaggcctccaattttttggggtatgtacctggaagtgaaattgtggagtcatatgataactctatgtttattttaatttgttttaacttttaatttaggttcaggagtacatgtgcatgtacatgtttgttatataggtaaactcacgtcatggggtttgttttacagattatttcatcacccaggtactaagcctagtacccaacggttctttttactgctcctctccctcctccaaacccccaccctcaagtaggccccagcacctgttgtgcccctctttgtgtccacgtgttctcaccatttagttctcacttataagtgagaacatatggcatttgctaaggataatgacctccagccccatccatgtccctgcaaaggaaatgatcttattcttttttcggatgcatagtatttcatggtgtatatgtaccatattttctttattcagtttgccattggtggacatctaggttgatatcatgtctttgctattgtgagtagtgctgcaatgagcattcacgtgcatctgtctttatggtagaatgatttatattcctttgggtgtatacctagtaatgggattgctgggtgggatggtagtaactctatgtttaaatttttgaagaactgacaaactattttccaaaggacatgtaccattttataatcctaccagtaatgtatgaggattcccatttccctacctgcctgccatcacttattatcactctttttgattgttggcattctacggggtataaagttgtatctcattgtgttattgatttgcattcaaatagtgattaatgatgtggagcatcttttcaggtgcttattggccatctttctaccttctttggaaagaatagaaaaatgtctattcagatcttatggctgcttcttaactggcttatttgtcactttgttaatgacttgcaagagttctctatatgtttgagatatgagtctcttatcagaaatgcaatttacgaaaactttttcccattacatgagttgtcttttcttgatggtgtcctttgaagtgcataagtttttaactttgacgttgtccaacttatctttttcttttgtttcatacgctttttgttgcatatctaagaaggcattgccgactcaaagtcatgaagatttacccttctgttttctactaagagttgtattgctttagttcttacatttaggtctttgatccatcctgagttgatttttgtgtctggtttgaggtaggaatctcacttatttctgtggatatccagttgtcctagaaacattcactgaaaagactattattttccccagtgagttttcttggcacctttcttaaaaatcaataggccataaatatgagggtttatttctggactctcaattccatcccattgatctccatgtgtatccttgtgctattacaatgctgtgttgattactgtaacagtgtaccaagttttcaattcagaaagtttttttttaaaatttgtttagactattcttggtctcttgcatttcaatgtgaattttaggatcatcttattaatttctgcaaagaagccaactgtaacattgatagagattaccttgaagctgtagatcaatttggggagtattgccatctcaacaatattaagccttcccaaccatgaacatgagatattctttccatttatctaggtctttaaatgatattctagacagtgtacataccttgtacttctcttacatttattgctaggtatttaatgccttttgatgctattgtcaatgtacttgttttcttaattccatttttggattgttcattgctagtgtgtagagatttttttgagttttacatgttgatatttttgtcctgcaaacttgctgagctgatttgtggactctattggtttttttgtggataccttaggatttcttttttgtttgcaagatcatgttatctgtaagtagagatagttttacttcttcctttctatctggaagcctttcccctcccaaccccacttcttatacagaagaatgtcaaaatacttggggttctgtttgaaaactgtcaacctaattagtagtggtatataattaatggtgggccttaaaatggacggcatctaagatttgaagacgtatagttgatacaactggttattttaaatatagctcattttacttttcatgtttccaagagatagatgctattatagtttccatttcacaaatgaggatcctgaggcacagaaaggctacaccgcatactggaggtgatcctgttgtgagatgctggggctgggatttaaaccagatcatctggctctagctcttgtcctctattgatctctaagtcatcacacccaatccactgtattagataaggtacgctgcctgtgaaagcaaccatcatttccccagcaactgtgtcttcctcctcaggagaataataacacttctcaaacagcttgcgctccactcttgtaacatacatttacgttttgatgaataatggatatcctgcctggtcactatgaaatttgactttgcctttattgaggccatctcattctcaaatttccttgtgaactcgtagtgtttgccaagtcatgcttttgccatctttggactatttaagttgttgcctttaagatgcacttgactttaggccattttcagatgatcctctggcttgggtggagctctctgtgctgggagaagaaaaatatcccgtgcaagttgttgaggcttgtaaccttttttttgttttgttttgttttgttttgttttgagatggagtctctctctgtcggccaggctggagtgcagtggcacaatctcggctcactgccagctctgcctcccaggttcacgccattctcctgcctcagcctcccgagtagctgggactacaggcgcctggcaccatgcccagctaatttttttgtattttcagtagagatggggtttcaccgtgttagccaggatggtctcgatctcctgaccttatgatgcacctgccttggcctcccaaaatggtgggattacaggagtgagctaccatgcccagccgaggcttgtaactttttacagtatatctcctgcataaaaaacttttgcggccaggtgtggtgactcacacctgcaatcccaccactctgggagctaaggcaggaggatggcttgagctcaggagttcgagaccagctgggcaacatagtgagacccctcgagaccagctgggcaacatagtgagaccccatccctacaaaaaaatttaaaaagctgggtgtagtggtgcacatctgtggtcccagctactcaggaggctgaggcaggaggatcacttgagcccagaagtcagaggctgcagtgagccatgtttgtatccctgaactatagcctgggcagcagaatgagactttgtctcataaaagaaaaaaaatcatttgcaattagactcctgagcatggagtgtttgttttaatcagcaccatcttggtatcaagtctaagagactgcagatatttaaattactaaataaaagaactgtggattctctttagaaagagcacaactcaattctataattccaggtttatgttgacaatgtctaaaattttaatgtttttctaaaaaaatgatttttctatggtactggggaaacaaacgaatgtccaaaactgagccctaccaacagatattgcaagtatctgttaggaattacacttgtctccacaaaacaaaaacctgactctagtggctttagcaaataggggtttgttttgctcacataacaagaagtcatgagatggaaaagcctggctgatgcagcaactccactatcttcccgctccaccctccttagtgcatggctttcatatatgtggtgacctcgtggctgcaaggaggctgccacacctccagacctgcatctattccaggcgggaaaaagaaggaaaatcccagatggaggctaaagaaataaaccaaacctttatggcattatcagtctctatgaccttttgaaaaattttaaggcaatgttgagcttttaaggcaacgttgattagcttcagaaggagtgtagaaggtaggcaattcatagaggcttaatgccagattgtgagaaactctttagagtacagacaatggcagaacgcagctctatttatttacttggggaatatagaaggaaatgtcaatatttatgtcaggcaaacatgagccatcaggaaggtagagaaatcattattacttccccttgttcatggcacatgggccatgtcccataaatgtacaagcagactctcacctcaggttctgccagtgctttcccttttgtctgaactgtttctccctgggtgttagtgtggctcattctctcactacctctggatctcagtgcatgctggttactgacctgtcacctctcagctccaaacctaccctccaatgctctgctcagcattcctgggctggcctctgcagagaatgcttctcctctgccaaccagttatgttgggcaggggctcggtgctagagagaaaacacgaggttcaagaagggcctccttctacctctttgcttgctgtccctgttgcagccaccccagcaatagcactgtccagccagggacacttcaccccaacatcagcagtgaatccagcttccagcttctttagcactcccagaagcagcttctgatagaacagaagtggggctcctcctcaagctcgttaggttcctgcattcactggatagcaccccctcttcagggacctgagccatggctccaagggctcctcctctgagcttctaagtgctgatcacccatctcttcccctgctccccagcctagggtgacagtagtatctgcagttaccattgctgggtttctttctgtttccttttggctgtgtcagtcctccagcacccatgttacccatttcctgtattagattctctctgctgaaatacctgctgtgacctctgtcatagggcctgaacctagactgatacactgctcaagtgacacctctgcaaagaggccttccctcattacccagtcttaagtaatacccaatttgtcactttgtccccctgacttttttttcataaaatgtatctccacctcacatacacatacatataagctcctgtgtaccatagactgggtggcttaaagaatagcaatttatttcttacagttctggaggctgggaagtccaagatcaaggcgttagcctatacatttcctggtgacggctctcttcctggcttgcagatggctgccttctcactgtgtcctcacttggttgacagcagaagagctggttctttgttatctcttatgattaggcgcaccaattctattctggaggccccactctcatgacctcatctaaacctaattacttccccaaaacctcatttcctgacaccaccacattggggggcagggatccgactcagtccacagtagattctctttccctttagtgatttctgttgaatgacacattctgttttctttcccagctttttattattattattttttcactgttggattgattcttgcagatgctctaacctctctacaaatgaatgcatctcagggcaaatgacatttccctgcagattcaattagttatgaaggaaagtgggatctgacagcaagagttgggataaggcaatatgccagctgttcatacccacattcttgattattctgcagaatagattcattttgaagtcccttaaaagcattaatacatcacaagggcataaattctctatttctcatgtatcataacctcaaaaaactgaattcttattaattttttactttgtctttcttgattaaaaaaaaaggatgcttctttttaatcctataggcggaacgtaagatatgtgttcagtattgaagtgggttattcagtgtcctatttgagcaaccacatttgaaatgataggcttttcatcatttcagtgcttcagataaacagttgtctattagcagtgaggatacaaaatagggcagagatccaaccctgccctcaaaacacttacagtcaatatcagtcaaggttcttaatgtcaagccacagaaagccactctggctaatttaagcagaaaaaggatttactaatttaagcagaaaatagttattggtaaattaataaagttagaaagtagaatggtgttttgccaagggctaaaggaagggagaatggggtgattgtttaatgggaaaagagtttcagttttgccagatggaaagggtcctggagatggatggtggtgatggttgcacactgtgaatgtatttcatgccactgagtggctaagatggcagattttgtgctatgtgtattttaccacaatttaaaattaaaagatattaaacagcaaatataatttctaggttagccagagaacaaggctttgtgggttcacatgcaggagcatgatgtgggctcccacagtagaaacagacactgccatctgtcctgagggcttccccaccaggacgacctctggaggccgatccattgcttgatctctcagggtggatcccatgcaatctctcctttcctccactagtgacaggtttaaaatctccagtgcatatctctgatggtcagagcctgggtcacctgcctgccagcagcttcaggagagtgtggcatctccatatctccagtgggaggtaggctttgctagatcaagtgggagactccctgggactaagacaggggtcagagcaggtggatgtagcaattatcagcactcttcaccaaatactttcacctcccctcttcttgcccctggtagggtgtactttccacttccttgagagccatagcagccacatgacctgctttggtcaatgaagtataagtgcaagtggcttgcaaaacatctggcagaaagcttcaaaaccagtgcttggttttcccatgttttctctcttcccctctgccttagaaacccctccacaatccagatgagtcttctctgccaggtcctagaatggctgcagacaactctcagtgaattcgtaacacaaagtataagcatttgttcttttaaggcactgatacttggggcttatttgttactgcagcataacctagaccatcctgactgatacaagagctcaaaggaatcacagtgtttgctgaacaaagagtaaaagcttcaagctggctgaaagactgttagaaacaagcttttcctggcaaagaaatgttagctgagcaatgtgtcatttttagttattccacatgattaatttggtgatcagtgtgagtgttagttgtaacagtaatattagtagcctgtcaatgactcttctttctcaatttagaatgcagaggactttgaaactgtcaaattgtgttcagtgaggacatgctcacggttcctatgatacaatccattttacttgggacatagtgttttcagccacctggtgggaatgacctcacttttacaggtcaggccttacttgcttttaggtgagcatccttcaaattaaattagtggtttaggattcatcgggagggtcctgggaacgtcagcagcatttcctcatttaccctttgatgtgggaatttcctgtgcccctgaagtccttcccttaagacagagttgcagaaagaaacacagacacgcccgcagagggggcatctgaatgcctggctggctgtgggtgtagtgaggggcagcccacatgggcacaggccatctccctctcatttcccaccgttcctgctttgaacgctgaaactggatgaaggccaatttaagcaaagcccggcacatctctgcaattgatcctctcaaagtggctggcgtgcagacctaaaggccgtggagagacagcgggtaaattttttaataactccctgggttttatgtccgtctcccatcctacagatgagaagactgagacaaagataggtcaggaacctttggcctcatattagagcagaatttttgacccaggcagtctctttcaggaatctgcaaaatacagtgcatgtgtgtattgcaaaaatacttttggttacacagatacggtggtctctccaggtgtacctgtattcacacacagcaccgctgtcatgggggtaattttgaattcaaaggacaaactgaatgatgtctgtataagtttgagtgagagatcccgaatctctaatatgtcatatcatcatcaaatttttctttacactattttcacactaagtttgtctttctgtttttctgtgcctgagtgaatgtaatgggttgacaaaaccaacacaggacagtgtcacatgttgtttctataaaccatcatctacagaggcagcgcagtgtggggtgaagtcacgtgccctggttcgaatcccggctctgccacacggtcctcagctctctcagtgcttcagcttcctcatccataaaatagaaataatattatcaatctcttcaggttgttccaagagttaaatgagttaatccaagtctatggttctttcttggcctacatccaacagctctggaaaccttacactttgcaataagaaatgaggctatttatagccttattacgatgacacagtgtgaacatacataatttcactacagaaatctgactgttattataagacactgcccaaatttcaaaacacatctggacctagggagtttggataagaggttgaggaactatctatgtgaagatacatatagaaatagatttttaaaaagtacacacacacacacacacacacataaacacagatccatggcagcccattccagtttgtcctccgtagccttgcctacaatctaatccaaacactctctaagagtcaaaactataatttttattttgttctggacagcaggagggagaatgggtgataatggctttatatgttactgtggcttacgtgaacatctgtgttctctaatagggatcttccagaaataacatctcagcacatatgagtaacattctggggtggatacctccggtacttggtggaaagttcaggtgatgagtcagtctggccccagtctctactctaattattctggggagacaggcaggcgtgtggggccagagtgctctggcaaattctaatcaccaaccagttataccagtcctacaaatttatatcttgcttatgcaaaaagtttatcactgggggaatattctttcagctttttcaaaatacgaattttagactgtcttgttgcaaaaaattgccacaccttagcagcactgataatcagaaattcttaaatctgaatattttaggttatagttttctcgataataccagtaattaatagagaatattgtaatacttgataatactagtaatcacaaataatctttaatgttaccatgaaattcttaaagcacatagtcagattttagccagaacattatatatattcatatatgtgtgtgcatatataaacatatactataggtaatctatattatatagaccatgtaaattgtgtctataattaacaaatgtttaaaatgaaaacgaaatgttaactatatttcacttgtataaaaaattaactgatccacaaaagtacaagcaagcaaaggccacgcagactgaaatacgctagctctcctctgtgccttccttgagggctcaagactcctgtgaccgatcataaacaagaggtattttcatacaaaaacttaatttgaatgctattcaatacactagcctcgcgaacgtttaaaagaatggtcgtatttatgggcacaaaatccaatttcactaatttctcttaatatccaccctagaggattcatacccaactgttatttccagggagagagacaaaggcgagaaaaggtcgggggaaattgcacttaatgtttgatttgatttctttggatagagatgcaggtactgctgtacaaatttcgcacacacacacacacacacacacacacacacacacacacgacacacgaatcaacatccgtgccttacgttgctttctgtttaccttcacagcaaccttcgagatgtgtgagtttaagcagatgcaacaccctttgacaacaaagacgcagcacactgggttaaagtggattgaaatcagacatgtcacattttaggagagaatgcatgcaagtagggcattagtccaattcttttgtactgagcatttcaaagttgagacccagtgggtggggcaaaaataaatcaagccctcctatggcgagaatgtacacggactccagcatctccaatctgaccctatcttttgctctccggattgtcagctgctttgggggttgtctgatatatgcctccttttctcacttctaagactttttagctgggagtgtgtttgaaaacacttcagaaaaaggatggaaaacacagtgtctactttgaaatgcgttcctttgttaaatccctctcccaggaggaccaggctcccaacacctgagggcagccgatgactggctctgctctccccggtgacctcacatgctcccagcagctccagcacagagctctcgttctcactcagctattataacaaagttgtacaagaaaagaaaaaagtccttcgtcccatccttaattgggcactctttagaaaggagatgctggggaatgtttctagacatctgacgcttataaggaattctacatattatccgagggtagatacgaaaagtcttttcttgacaaatcatcccaacatttaaaaacatttacctccagaaaagcatctgagtattttctcttagacgacattcctcaacgataacctcattgtgaacaaggatgtaacgcgtggtgatggttacaaatggtaacagagcttccagtaaaatgtgctctattagtaagccctcatggtgttttagctcagcagaaacagaaaagaaggctgatttccctccctacattatattataaaaactttcaaccatacagaaaaatggaaagaactgtagagagaactcgtaatgcccacactgagactgtgcacctggcattccgcttggcctgcttcctcccagcctctcatctccccatccgtccagtcatccatcaatccttcttggtcttttgctgccaggagcctaattggagctgtcggcggctctgtctctgggaggggacacgatgatacatctccattgggcctgtctgaagagcatatggaggacacacaccctggctgccggaagagggcactgtactctcccagcagcagaagagcagacccttcaaggattggatgctcctccctgtcttgacagtggccttttcctcattaggctcctccaccaagattcgtacccagcttacaatactgcaatatagatcttatcatccagccagaaagaaaccaggtatgccctgggtcctaggcagacatcgctttagaacctctatgctctgtaaaaaggggcctcttttatatacatggaacatacatcaagtgtacaaatctttttttttttttagatgtaaaaaaataaagaggctggagtgcagtggtgcgatcttggctcactgcaacctcctcctcccgggttcaagcaattctcctgcctcagcctcctgagtagctgggattacaggtgcccaccaccacacctggctaattttttttggtatttttagtagagacggggtttcaccatgctggccaggctggtctcgaactcctgacctcaagtgatccacctgccttggcctcccaaagtgccgggattacaggcatgagccactgcacctggccaactgtacaaatcgtaagcgttcagctgaacgaatccctgcgtctgtatgcattcacagaagtaccacccagttccagagagagcaggggtttccaacccctgggcatggactggtactggtccgtggcctgttaggaaccaggctgcacagcaggaggtgagtggtgggcaaacaagcattactgcctgagctccacctgctgtcagatcggcagtggcactagattctcacaggagtgcgaaccctattgtgaactgcacgctccataattctttgctgtggggcagtcctgtgtactgtggcatgctatcagcaaccctggtctctacctactagatgccagtggaaccctcccaagttgtaacaaccagtaatatctccaggcattgccaattgtccccaagagaaattgtccccaagataaatggaccccagttgagaaccactgacatcagcaatatgaaaaaccagaaaagtcaaagatccatgcattatctgcctgacattcactccatgtttatggtttaccatcctggactccagtgggtccttgtgagaatctaatgcctgatgatctgaggtgcaattttcatcccaaagccatccccccacctccacctcagcctgtaaaaaaagtttcttccacaaaaccagtccctggtaccagaaaggaacactgagatataggacatttccagcatccagaagtctcccctgagcccaccccgcaggggaatcacaaatccgaccccgagaccctgagttcgttttgcctgttctccaatgtcacataggtggaatcgaatactctgtgctcctttgagtcttctccaggactgcctgctaggttcatacacattgttgcttgtattagcagcccagtcttttaaataaaggaaatattaaaacttaaaatgaggaagactaacagaattctgattctcccagtggtgtctacttgggtgctgtactcatctgttttcatgctgctgataaggacatacttgagactgggcaatttaccaaagaaaaatatttaatggacttatagttccacgtggctggggaggcctcacaatcatggcggaaggcaaggaggggcaagtcatgtcttacgtggacggtggcaggcaaagagagagcttgtgcggggaaactccagtgttcaaaaccaaaagagagagcttgtgcggggaaactccagttttcaaaaccatcagatctcgtgagacttgttcactgtcacaagaacagcatgggaaagacccgcccccatgactcaattacctcctgctgggttcctcccatgatatgtgggaattgtgggagctacaattcagaatgagatttgggtggggacacagccaaactatatcaggtgccttttttcaatgtcaaattttttcttttcaaataaatgtatgcatttgttggcaccccaagcctgtgttttctctgccttcagagagggagacctgtctccaaagcccgccggagtccaggatggtaaaccacagatgtggagtgaatgtcattcagataatgcatggatctttgacttttctggtttttcatctttgtttatgtcagtggttctccactggggtccatttcttttcccagggacaactggcaatatccggagatattactggctgttacatcttgggagggttccacgggcatctcatgggtagagaccaggtttgctcatagcatgccacagaatacaggagtgcccccacagcacacaggagcccccccacagcaaagaattatgatgcaaaatgttagaatggtgcaaaatgttgagaaacctggcttatgccttttatccatctctaatggatctctttgaacctctatctctttgagcttgatgtgcaccgaagtctggctcaagccctggtctaccctggaaagcctcctctgaaggccgattggtggctcttagcccctcccaatgggtgagacaataagacccttatcatttaccatggccaagatgctaaatcagtagttctcaacctttgatgttcattagaaccaccaggaaggggccccagcatctgagattggtaaaagttctctaggtgactctagcgaggctgaggtcaaaaaccaaatctctggcccttgctactctaggcatggttgaaagtgtggcagccccgtcaccttgttccaaatgcagaatctcatcccccaacccgtgcacgcacttttggaaccagaatctgcattttgactcccatgcccgtcagacatgggaaactccacgctggatgatgtagccctgcctctctccagcctcaccctcagccctcttccagcctattcccagcctcagccatcctccctggggcttcagtgccatcttcccagaggtgctgccatatcacccccacccgcccctcccacctcattgctctgtttgctccatagctcatgtcactgtctgaaattacactttttttctgggttttttttttttttttgagatggtgtctccctctgtcacccaggctgaagtgcagtggtgtgatctcggctcactgcaacctccgcctcccaggttcaagtcattcttctgcctcagcctcctgagtagctgggaccacaggcacctgccaccgcactcagctaatttttgtatctttaagtagagacagggtttcaccatgttggccaggctggtctcaaactcctgacctcaagtgatctgcccgcctcggcctcccagagtgctgcgattacagatgagagcccccgcgcccggcctgaaattacatttttatttgtttgcgtgtttgctttctgtcctccatctcctcccaggtagccttcactatggcagagactttgcttgtcttaggaattatattcctagcatgaagaataattttgctgtttaatttctgaataaatgctgctgcaactctttgacatttaacgattaatattcttttcttcttatagacctcgtctccccaacttgattaggatcttaactccaggaaacatctttctattgatgggcgttgctcttgagtgcctggcctggaggcttcctgtaggcagtagatacacaataagtacgtatggatggtgagcaagattttgttgattcaggtcattttttaaatagtaaatacattcaacgaccaatcttccacggtgagggagagcgtgtgctgtgactgaaagccacatgtcaccaccagtcccatttgaatactgatcgtcagcgctgtgaactaaagcagaactaatacttttacctttcactcttctcctgaccccatttgccaagataaagatggaaagaccccggcattgtccagtgggagggaaaaatcaagctccgcagaacttttctaaattggattagcatctcctgccgtatgcgcttatttattcagggaatttccaagtcagtgttgcagacatgaatgtggcaggggattgcacgctttcaggatgaaagtatttgggcttcctaagtgcgtcgacgagaagagaccagttacctcacgtttcttcttattttatctttagcctctaaacatagcacacagtaaatcgtcttggacatctagggatccctttcttcagatgattataaagactcagctgaaattgtcgttatccttatttcacggggaggaaaacagaactgttaagctctgcctcttgctgctgatcagccaactgaagccaggtggcgggtgtggcccaggaggcacgacgactccacggttctccagctatgtggccatccccaagaatcacacggtttccagacacttaagcgtgtgttccattccccaccttacagcccatctctcatctcatcaacgcttggaggaaacaaggaaaaaatcggtgcaggaagtccagagaaggaatctcaacttttcactctttgctcaagccccggattacgtctctgaacagcctgagccttaaacaagggtttaaaacagcagaaagacagatggtaaatgcaaccccgcccgttaggtgctattcgaaacacagatggtaaatgcaaccccgcccgttaggtgctattcgaaacaaaaacgccgggggtgggaggtctgcctaggaaaaagccatccagggtggtgtccgttcaaggagcccctccagagggaagaaaggggtgagaaactctgtgaaaagtgtttgggggtggggggatgaagaggccttaaaaggaagctgagcgctttgctgcctggcggtggcggtgcgcagcggctccccctgccggggagtcgatgaatagcgctgcagcgtcaagctgggcccaggctcgggggctggcaggccaggctgaggcagtgcgcgcggggctcagccattctaaacgcaaacgaagggggaccctttccacccaggcccaaagcgggaggattagaacagggagttcaaagctctaaaatggcttgttcgttctttcttttttcctccccaccctcccctttattttttaaaggggccagaaatatggctggttattatcccaagtgattgctacaaagaatttcgaaattaaaagataagcacgccgaggaagctcagtaattttcataaaaggggacttaaaacagatgtgccctctttaatcgaagcatgcttgaaaaaataggaatgcatttttaacatagcagggggaaaatcacatggcttcgcatttgtcccctgagagttgctgtgtgtggatatctgtgggcacggggagatggtactaacgcgctagggcagccgcaaatggcgggtgaacgtgctttcatcttcctggccctggggtaaatgaccagcctctgtgctccagaccttttgctaactagataatttatttatttatttttttaatttcttaaacaatctgccatccaaaatgtgacgatggcatacaagcaacagaccattatttgcaaggaaacccagattttgtcaacaacgtaacccttttcttcctctttgcaggagacggtttttccgtgttttctttttgacaatttgcacaaagcaaattcactcttaaacaaggctggtttgtttttatttcaggttgttgacatgtcagccattcagctttagccccaattcgtccgttcaccagatgagggtagctgtgtgtcaattcttaccaaaacaggagtgtcacgtctactcatttcctgcatggtgagaaggaaatgaaagtgctcggtctgagattccctgagaagagaaaccaaagaccgtcagaccaacaacagtgcttttaaccagtgaaagaggcaaacattgaagcatatttaggagtagcagggcactaaagccagcagttgcttgattctctgttgccgtttagctgagcgtgtgtcccacactccctagcggcttcccaagtgatgcagagactattggtggatacttttggttgttgttactttaaatgtttcctttttattttccataaaaacgatttagctcatctttctcactgaaagtaggcaaataaaaccccaactccatgccttggctatagtagataataaatatcagctgacttttattgcttgaatacttttagaattatttcttttctttttttttttttttttttttgagatggagtgttgctctgtcgcccaggctggagctggagtgcagtggcacaatctctgctcactgcaacctccaccttccaggttcaagcaattctgtctcagactcccaggaggctaggacgacaggtgcgtgccaccatgcccacctaatttctgtgtttttagtagagaccgggtttcaccatgttggccaggctggcctggaactcctgacctcaggtgatccacctgcctcagcctcccaaagtgctgggattacaggcatgagccaccccgcccagcctcttttcctcttttaacttggaaattaggcttttcaaatccatttccaccagacctcataatgagacattttacaatctcgggtttgtggagactttctttgaatcacctcctttcttcacctcttcatccacacttcacctaaaactgagctaaagaaacagcaatggtcaaagggaacataaccttacctgggatgcttcaggtctgtgtttattttggttttacaagcattaatttattctctgggcatctaaatttttctattttttattttaacatgtaagtaattatccttaaatagatactacattgacaagatagcaaatttaaaacgtaacaatttcaccccagaacagtaacagcttatggactgccattctcatcagtggctaggcctacttctggagattattttcgtccatataagaagatatgtctgggctgggcatggtggctcacgcctgtaatcccaccactttgggaggctgaggcaggcggatcatttgaggtcaggagtttgagaccagcctggccaacatggtgaaaccgtgtctctcctaaaaatacaaaaattagccaggtatggtggcacatgcctgtaatcccagctacctgagaggctgaggcaggagaatcgcttgaacccgggaggtggaggttgcagcgagccgagatcataccactgcactccagcctgggtgacagagtaagactctgtcttaaaaaaaataaaaaagaagaagaagatatgtctgtctgtctgtatataccatttaaaaaattcctccaatagtggcacactctaccacataaaccttcaccctaattttgctctgcattaaaaaacttttatttctataggttattggggaacaggtggtatttggttatacaagtaagttctttagtgatttgtgagatcttggtgtacccatcacccaagcaatatacactgaatctgatttgtagtgttttatccctcactacattttttatcatgccacactctgaaattataatttttaggaattgttttgaacatgtaaaaaatattgcataggtgacagaggaattaatgctcattgtaaaaaacgtgaacaatatacagggtataaaccctggaggcctccctgctctctcccttccatccccacagcaggtcttcttcccaagcggctggtggtcaacaccctgctgtttatccatatccccccctgcgccttttcctctccatttacttggatttgtgtaaatgtgtccatagagagcaatcgtctgtgatttttattttcttatgtaatgatttgttctatggatcatttcttggtggcgcaggtggatctcactccatctttttgcttaacttttattttaggttcaggttgctaggcctctttctggagattagtgtacgggtttgttatagaggtaaactgatgtcacagggtattgtacggattatttcatcacccagagactaagcatagtaccctacccagtagttattttttctgttcctctccctactcctacccttcaccctcaggtaggccctggtgtctattgttcccctctttgtgtccatgagttttcatcatttagctcccacttataaatgagaacatgtggtatttggttttctgttcctgcatgagtttgcttaggttaatggcctccagctccattaatgttcctgcaaaggacatgacctcattcttttttatggcagcatagtattccatggtgtatatgcactgcgttttctctatccagtctactgttgatgggcatttaggttgattccatgtctttgccattgtgaatctcactccatcttcctaatgccccagtgtatttagctatgggagattgttctgtttggggacttgcaaaccagcatctaacattcccaaggcaattaccaagagtcacctgagtccagctccttcctaatcatggtttgtatgtgtatatgtttgatcattcctgtttaattcatagttaaccaaaatggttattcagttcatctacaatgaagtagcaaaagagagctaggcatttctcttggtattaagagtgaatcattatagttgccatttattaagcaattatgatgttctgggatttttagctacattctcttggttcctcaccataaaccttcatgataatattaatgtccacattttatagaggtgggggctgatatgaggagtgattaagtagctatcctgtgttgacccagctggtgaccggacttgagttcaggcacctctgacattccagtccaggctttcttcaccattatccagtgactcttaaaattttcaggaaagaatgttactcaatgtccttgggtcgagtctttagtattttaactctcacagttgaaacacatctctttttttgaaagtttttcctgatatgtaacgtaaggctccctgcatccagctgaactcttctcagcagggagaaggatcagctgagcgtacgacatcatcacagccatcactgtccatcacgacaccgagtgtcttgtacattcccttatctgctatgtggcatacttggacttaactgcaatttgacgaacttccagacagaagctggtcccgacggctaacacttgcagtctaccgaaaatgagaagaggcccctccagtgttttgggtgggagaggtgctcacggaacccaggccacagcgttatcctgggatgcctggcgagcggctaggaggaagttaaagtggcaaaccacgtgcaaggcagcaccagagagtggatgaccaagaggctggatttgggggctggattcctgggctgtatttgggcaaaggacttccagtctctaagctgtttctcttactgccttggaggtagtagaaggaatttatgaagcagccaggtatagtgagcttttacatattaagaagttcatcaatatattcaattttgtagcttacatttcatgaaaattgataaattttaatagttttaaactgatggggtcatggtttagagatggtttcatgcacgagccccacgttacagcctcctcccctctggggaggtgtgaaaagtgtcatggagagggtgattcagtgtcctcagggccagtcagggtggaaacagacggtcgaagaaataaaaacatcaatcaaggactggattctatcctatgcttcaaattcagcaagttcagaaacatggacctacatttactcctgtccaaagcaagccctgtgtgggtaaaatgcacgaaagggcagaagggaccggtcatcggactcagcatgaactgtgtatgatgtcatccttcatccaaatctatgtatgtgaggcacactttgattgtgttttaggcagtgtgtgtgctcaagatctccaattctcagagaaaaagcaggtgtatttgcaattccttacctgaatgcaagctcaaaaaacatgtgtttttgacctctggaacccagtggctagggctgagctggacccacagtgggggctcaggagaacttggtaagacacgtgcaggtcagcttcctccatgggaagggtttcatctctttcttgctttctgatgttgtgggttgactttggtaattgccaacttcttagaagaaatgggatgcttagaaatgatggtttttatctagagggggtgaggatgctcctttctgttgaaatggccataaagtaaacgctataaaggatgtgtcttctctcagatttccaaggaccaatggctagttggctttggtgctttgactatgtcaccaaagtgactcatgatctattcatgaagttcagcaagttgaataatgataaagcacagttgctatgcacctgctgtgtgcatatcccctatttaatccacaccatgagcaaggtaccattatcaccccattttatagaaaggcataacctgcccaagaaggatggggagaacttgaccccagcggtctggcaccactgtacacatctaaccacagaaccctacagccattctgtagcagagatacagaacgatttgtctccactgttggaaattgtatcataaaatatcaaataagaaataaataaatggatgttcatggacaggagggctcaatgttgtaaagatgtcagttattctagacttgatctatatatttaatgcaataccagtcaaaatcccagcaagttatcttgtggctatcaacagactgattctaaattttatatggagttgccaaagacccagaacgatcaacccaatcaatactgaaggagaaaaacaaagtgagaggactgacgctacccaacctgaagacttactacaaagctacagtaatcaaagctgtgcagcattggtgaaagaacagacaaacagatcaatggaatagaatagagagtgcagaaatcagcccacgtaattatagttgactgatctttgacaatggagcaaaagcagtgcaatggaacaagatcatcttttcaacagatggtgctgaaacaatgggtcatccactgtaaaaaatgaagccagccacaaaccttacacccttaattcaacacagatcacagacatttataaacataaaatgcaaaactgtaaaacacccggaagaaaaaggaagaggaaacctagatggccatgggtttgctgatgactttcatatataacgccaaaggtgcaatccatgaaagagataattgataagctgaatttactaaaattaaatttctaggccagctgcagtggctcatgcctgtaatctcagtatgttgggaggctgaggagggcggatcatttgaggtcaggagtttgagaccagcctgtccaacatggtgaaaacccatctctactaaaaatacaaaaattagctgggtgtggtggcaggcacctgtaatcctagctacttgagaggctgaggcaggagatcacttgaacccaggaagcggaggttgcagtgagctgggatcccactcctgccctccagcctgggcgacagagtaagaccccatctcaaaaaacataataaattaaattaaatttctgccttgcaaaaacagtgtcaagagaatgagaagatatgccacagactaggagaaaacatttgcagaagaaacatttgataaagaatgttatctaaaatatacaaataactcttaaaattcaacaataaaaaatgaataacccaattttaaaatggaaaaaaaagtcatgaatagatatctcaccaaagaagataggcagatggtaaataagcacctgaaaagatgctccacatcatatgtcattagggaactgcaaactacaacaacgagatagtacacatgtattattataaaatggtgcaaatccaaaacattcacaacgcaacgtgcttgcaaggatatggagctctcattcattgcatgtattttcacctgggaagaccgtcatgctccttggtatttacccaaataaactaaagacttaggtgcacacagatgtttatagcagctttattcataactgccaaaactcgaaagccaaagccaccaagacatccttcagtaggtgaatggataaactgtgctacattgaaaagatggaacatgattttgtgctaagaagaaatgagctatcatgttatgaaaatatgtggaagaaacttacattcatattactaagtaaaagaagtcaatctgaaaaggctacgtgctgtatgattccgactatgtgacactctggagaaggtaaaattatggagatagtaaaacattcagtggctgccagaggttgcaggggagggaaagatggatgggcggaacacagaaagcttttagggcagtgaaagtactctgtatgataatagaatggcagatacacatcattatacacttgtgaaaacccataggatgtgcaacaccaagagtgaaccctaatgtgaactatggactgtgggtgatactgatgtgtcagtgtaggggaaatgattgtaacaaatggaccgctctggtgtagaatgttgatggtgcctctgtggatacagagggtacatgggacccatctgtactttctgctcaattttgctgggaacccaaaactgccctaaaaaataaagcctattaatttagaagaagaaggaggaggaggaggaggaggaaagaaggaggaaagaaggaagaaagaagaaaggaagaagaaaagaaagaagaaagaggagaggaggaggaggaggaggaaggggaatgggaaggggaagggggaggagaaagagaaggggaggaggaggagaaggaagaagaagaaggagaaggagaggaagacgaagaagaaggaggaggagaaggagaggaagacgaagaacaagaagaaggaggaggagaaaagaggaggaggggtaaggggaggaggaggaagagggggaggaggagaggaaggaggaggggaaggaggggaaaagggagtggagcaggaagaagaacaaaaatcacaatttattgcagatttcaaaaatctcaacacagccttcagaatcagccacgtctgaatttaaatgaggctctccccgacactttgtctccatgaatctttattagaagaaagggaagcgggcctacactaacactttgcatttctgttgcatggattcaccataatgtagatgggattctgggtacggtggctggattctgcaggcatcagtcaatatctacaatattggagtcaccaggtgaaagcactcacaccctggcccattcatggtcagccctagttttgaactcactcagcaacgacctgctctaacctgcctacctgcccaaatctaaactgttggataaatcgctttgctaaaaaattctcatagttgagcaatttgaccattaaaggtctctgatctacgtgttcttgaaagaatttttttaaaagagctttttcatgtatctactatattattcaactgtatgaatatattttcacaataatgttaggccattatttttaacatgtatgccttttttctggtctgaccagcatcatggaaggaatataagggtttaactatatggcaatcactagaattatgaaaatgttagtcatgctctaattaagatggatataatcttcaatagtataagatctgtaaacaaatttcaagatctatcactttgataaccgtggttacttatttattctgtgttcatactttatgaaattttgaaaagacttcaaattatgtcaacgagtgatcattaaaaacaagaaagctttctgtagcttagattactaggattttatggtcaatttatatgaagttacattatgcagaagatgaaaatgttttgagactgtttatctgtaacagattgctttataataactgtttctaaaggagagtatgcttcataaatcacggcaagcatgtgatataacacaaatcaaaggaaaacagaaataagaatactagcatttcgttctagctcttaacgactctttgacctctggcaaggcaattaatatttttgaacctcagttttcttatctgtaaataatagtgtctgtctagtttccaaactctgaggatgaaatgagacaatattaataaaaccctcaacaagtataaagcattttatatgggtagagtattattataattaatgcaggaaaatacctaagctgtgtgaacaaatatgaacttagcctttggatgaatcctgagtggctgacggagcccaactttaagactaagcccagcgtccatttgctggctagaggccacacacgtgttctagtgtgacagggctgatgacagtcctgctgagtttcatggcctttcatgatcactcatttttatcttctgagttaccctacattttttttttatctttgggactttcagagctcagatgaaccaaccaaccagagttcacctgccttggccgatcagggctcaactgtatcaaccaatcagggctcaaatgcatcaaccaatcagaactaagcaagtttcaattcttcatttgcataaacagatctgattgggaacctgggcaggacatttcgctttaaaacctgagccttcctttttttctttgcaacacaccttcattttataggaaagactccatttccccagtttgcaaactgttcactggaataaagtctctttcctccaaattccttttcagagaacttttgttcacacttgtttagcaaaccaattcattttctttctgggctttactgcatcttagtggtgccttgttgcccttctagccaatggaatgtgagcaaacagacacagacacttccaggtgaggctgacaaagcttccaggagatcttccaaattggctgtgccctgccaccaccaagatgtggagagtcaagggagcactgccattcaagaagataaggagccactggactctgggagccagtccttgaggacagctgtccaggagggctgcccaaccagccaccttcgcagcacttccatgaacaaaaagtacacatcgactgtgtccagccaccaaggttctgggctgttctatcctaacacaagcaatgtgaattctatattatacacaaattgcataattaaaacatttttaactttcctttgtcaagaagaaaataagctgcaagtatctggtctttatattttacatatgtgatttttttaaaagaccataaaaatagaaattcctggccagacgtagtggcttatgcctgtaatcccagcacttttggaggccgagggtggatcacctgaggtcaggagttcgagaccagcctggccaacatggtgaaaccccgtctctactaaaaatacaaaaattagttgggcgtggtggcaggcgcctgtagtcccagctactcgggaggctgaggcaggagaatctcttgaacctgggaggcggaggttgcagtgggccgagactgtgccactgcgtggatgacagagtgagactctgtctaaaaaaaaaagaaagaaagaaagaagaaattccccaagggcattgtaatttagattctgagaaggagacagacaaaaaaagagttcatttacctttgctatttgtaaatctcttttcatttatgggtttttcccaatggagtagctgagaatgcattttttttttttttttttttgcttatgatctaaaatcttagaaatgtaaactacttagtaaactcagccaatgcttgtaattctgacactcaattcttacttcataattttgaaattacttgagtgctcaaagattgtggctagttagttagttggttgatgagttgggtggttgtattcagattggcccggtaattgtctacatatcacatgaactctctgctcatattttcatagctaaaaacagggattggagcaaatcttatttgttgaatgctctggccaaccactgagatgtgtgtgtgtgtgtgcgtgtgtgcatgtgtgtgtgttgtgtgaacaagagagttaatggaatccactcctagtttccatttcaaacagggtgagaacatctgaccttatttgataaataatggcacctttaaacatttctattatcaactgtctgcagtaacaaagggaatactattagaaatgtttaaatagtttagagcgataaatataatatgcacctacaaatgtgcagataaataaggttttaactaaaaaatttctatcatgactttgaaaagaaatgaaacagcctgtactagaaatctcccaattcaattaaatattttattattaacggaaagcccatgctgggagtgtgagaatgggtattatttgagtatgaaagttcatagacattttggatgtccaatttccctttcggtgtaagggcaggcattaagaaactggatcctcactgagcaatgatggttgaagaggggaacctgtgccaggttatgccaataattgccagccccccaggattctagctcagaaatttttgtatgttctcaggagacaaaaatgagtgatcatcaaaggcagtcgaactcagcaggactgtcataagcctgaagttacaacttagacatgcaatagaaaatatcatcggtacctctccagtgcatcgcctgtagtaattaaaaacttgatccctgctgttttatcatctcattagcaatgggggcacacaacttttatccttgtttgtcaggaatcaaacataccagaggaactctgattataaattgatgaaagtaaagttaaacttttaaataagagaagtgactgttcacaatgttttttttaaagctgattaaagggatctagttttttctcttaagagtaatctctctgtccagcctagaattgtagaggtcatctccaggattgctacatgtgacacgttttataaagggggtttgctttgtaagccattctgatttaaaataaatatcagccctgaaaaacttcctgaaagcacagatgcaaagagtgtcatccttttcaagccttttgatgaagttgaaacaccttctatccctctcagttatgtgtattataacgccttttattcagggtaactgactggcctcaccgtttaaaagcccaggcaagctttctgcttgttttaataacttgtttttcacagaggacaggtgaaggacctggggacccttttatgcagctaatttttccaacatttgcctccaaaatggaagtttttcatcctaacctacattgtttcctttgggtccaaaaaaaaaaaaaaaaaaaaaaaaaaatccaaacaggtagagctgtatttctctacggtactcgaattctaatctacactatagaacaattgggaggttcagatttgaagacagaacagcttactgtacctttcgtcttatgttaaatgcccttcacccataattaacaaattgcctatgcatttaaagcatactgccggagagacttctaagaaccgtgttctctggcaggtgctaggatatcgagaaataaaatagagctccggttcgcctgcaactttaaaactttcttctcatcctgccaagttgcttgaggaatcatagtccaaacaacttaaggagttaaagataaataaataaaagcgagatattcttaacctcaggactaatgtcattttgggtcagacggttctgtgtggtgggggccgtcctgtgcactgcgggacggtgagcagcctccctggcctccacctaccagctacctgtggccccccacctccagtgtaacaaccaaaaatgtctccagacatggcgaaatggcaccgggagtcaaaactgtccccagctgagaatgactagaacaatgtgtatatagcatattaccatgtgtgtgacacacacgtgattgtgaacacggaagccatcctgaaaaccaacgtgctttctgatagcatcaaaagtcattgcctctcctaggtaaaggagaagaacaggggagaaaaggcaacttattttctcgttatactcttttgtaccttctaaatcctgtggcctgtgtggatattacccatcccaagcaaacacccaaacaaatgaacacataattcaagccaggagttcccactgaggtcaataagtagagagctaaattaataagtcaaccaagtgcatgaatgggtaagtcaagatactatgccgaggcatcctacagatgaatgaactaattgaacctgatggcccagtacagaactcatcagaattattctgtaatagtgaaatgaaagagtatgcttatatacagtgacttaggtgtttccgattttattatcatcagcaacaccaataaagaactattctcccattccttccagaaaatgaaagctttctcagccttcaaaagccctgcaaagtcacttaagacttttaagcctcaagacttccttgaaggagcagggtttgcctcatggcacgggtttgtgtttataatgccaacatttgctctaatgagcaaaaagaacccttctcatggggcagctgcccccatgccccagtgagggtgaggccagtgtcctgtcccaggtagaaagcaggtcctggccgccccatcaggggcatcacagagtgcctggaagctttcaaaaagctgccaccaaactggaggtcacgatgtaagtgaaataagccaggcacagaaagacaaatatcacttattctctctcatgtgtgggagctaaaagaaatggatccatggaggtagagaatagaatgatagataccagagtggggagtgtgtgtgtgttcgggggcggtggggagatgaagagaggttgggtaatgggtataacacccattcgatattggatgggtattggatgcatatgagattagttatagtatccattactaatgggtacagtactcattaggaattggtatgggtacaattacccaacagttagaaggaataagttctcatgtttgatagtacaatagggtaaccatagttggcagcaatgtattgtatatttcaggatacctagaagagaggacttttaacactcacagcactagaaatgataagtgctcaaggggatgtgcagcctaaaaccctgacgtgatcattacacattccgtgcatgtcgcaaactaccacaggtaccccatcagtatgtgcacatattatgtatccaaaaaaaagtcataactgttcctgctatccctccccgtcttaaaagctgcctagagtgaacaccagcctgcggtcatgggcgggcctggctctggatcagacgcggagagccagcctggtgttgtaggaagagctgtgaactaggagcccggagacttggctctgtcaccagcggagggcgatcttggtaagaaggttcatttcccagggccacgtggattcatctctgaagcagagacaagtaggaaattctacacgcgccatccaaggtccaaagtgctacatcccttcctctttccttttaataggtgctcaataaatcttcatttaaatgaacagaaaaatgaatgaatgaatgaatgaatgaatgagtccattgtcatcaactttttaaaaataattgcaacttttacttaaaattcaggggtccatgtgcatgtttgttacatgggtctattgcgtgatcctgaggtttggggtacagttgatcccttcaccgaggcagtgagcacagctcccaacaggtagttttttcaaccctcgccccctcccctccccggtagtctccagcacctactgattccatctttatgtccccgagtgcccaatgtttagctcccactgataggtgagaacatatggcatttagttttctgctcctgcattaattatcttaggataatggccgccagctgcatccatgttgccgcaaaagacatgatcttgctcttttataggacagtgtagtattccttaaggtgtcttcttaaaagaagatttcaataaccagaaaaaaaagtgtcttcttcctaaagctaaattgaaaaatacctaattaagtcaataacatgacttaaaattcattatcatactgaaaacactttatcacacaggaagtgcctttttcatttttgtaaggccatctttcagaatatagcctttcacctcaatgatttacggatatgcagtattagagtctcatcaaaatcacgggtaacatgaggattagaaatgtcagatgttaggaataacagaatcagaatcaaaatattctgagagtccataaaacttaacagagaattgcagtcagttctgctttaacacgacatgtgcgcacctgagaatgtcggtgctatgcaaaatcatgcaacgcaaatcacagggctggtaagaaaagcgggattggggcacagcgctcaaaagcacgtcagtgacacatttgagaaaaagacggaaagctaatacaaattccagcgtggttttacacgtgttcagtggttaagaaataacataaataccaccatgaatatggctcttcacccagagggaaccccgaagattgctcacgggagtgggtactggaaggactatagtccgcgggttattgtgaagcggtggaaatggcattatctgcaattggaagaacggagtgtcggcaggcgtggatggagtagttcctaaaatctcagtgaactgaaatcgttggtagatgtttgaggcgtggacatgtgtgggttttgtacatttctttgctgctctgttcagcccatgcaattttctgtattcggctagtgtttatcacagatgaaattgcccatgagcaaatacgactttggggctgagctcaaatcgttccctactatctcaactgcattggaacaaacgtgtatcttcaaaacaagagttgcagcagaactgcgtaatattctgcacttaggataaaataatattgttagaataataggctgggcgcagtggcttattcctgtaattccagcactttgggaggcggaggcgggtggatcacctgaggtcaggagtttgaggccagcctgccgacatggcaaaaccccatctctactaaaaatacaaaaattagccgggtgtggtggtgggcacctgtaatcccagctactcagaaggctgaggtgggagaatagcttgaacccaggaggcggaggttgcagcgagccgcgttctcaccattgtactccagcctgaggggcacagcaagactccatctcaataataataataataataataataataataataataataatactgctaggtaacattagtatcaggcatcaggcctactctctgctgggcacactgcccagcactgacatacattaaaccttcttcatcctcactccctctgtgagacaggcgtggttatcatgatatcatttcatcacggggaaaataaggcacacagaggttggtgggatgagctgggaggtgatacagggagtttttccacagaatcgtcactctactgcgaataggcagtgttgtttcagggactgtcgtgtattccacatgcttcagccgtgggctgggactgtaacaacgaaaaagcaacggtgtcttaggcagctctagcgaaacttcaacataaggaaaacaggaagcaataagccctctctctgtctctcaggacataccatcctggagtattcagtcctgttccgggcaccacactgctaaggagaggggtataaataaatgggatttaaggggatataaataaaaccatgttcaaaggagtgtaaacaagatggcgaaggaatttaaattcatgtcagatgagacgctgtgaaggaacttaggatatttagaagagaaaaatgcagccacatgagaattttcttgaaatgtttgaagggttagaacatgtcgagactattagatgtccctggtgtgtttgttttcccttcatggacccatggagttgaacaggatgggtgtgataatggctaatgctcaccgagtgctgagtcccaggtgctttgcatgtagcacccaggttactcctggcaggggccttgtgacgtcgcctctgatcgtcatccccactgtacagatggatacatggagacaacagagataggagactcgcccatgtcacgtgatgtgttagtggcagagcaggggtttgaacccaggaagtttgacctgaaaagttacattcatcacccctaagcagaagaaggtatagggaagccaatttcaattccacataagggagagctttctagaaatcagaagtgctttaggacagagcaagccacttctgaaatgtgtcaatacctggtccgcagagcttttcaagcacaggttgaatgacctcttgatggggatacataaaggagatgtaagaacaaatcagataagattagctttaaaggctctttccagtgggtttctgtggttctaatagggagtgttcaatgcatggtctaacagtgtaaatgtaaaaacaaacaaacccacagcagccacgcccagggaccatgctgggtttgctaacatcttcattactcagatatttctgcatagggttttgcagtcactgaatctgaatttaaaaaaaagatcaatttccattttgagagatgtaaattcattgtgtggctctgtaaatatataatctaaagtgcagtgagtgttaaatgtatgtttacaatatctttgccctgtggaatcttgcaggtatcagttgaaggacctttaaaatagtccctcccatcttaaaacaaagcactcccgccaagtgatttcccttcagccatcgcataatcgcttttctgccttcgcagttcactccttgaagacgctgtgtagattcccgcctcggctccctctcttaccagtcttcactcaacccgcctctgttagtgaacctctggcttcctccccaaccatcctctcccatcactgaacccaatggacaatctttagtccctgttcttcctggtcacgctgtcgtatcggaaccattcttctttttaaggtgctctgtttttgagtttttgtttggcatcacacactcttggttttcttctcacctctctggctactcattcctagtttattttgctgactcatttctttcacctatctgctaacattgtctatcttcacagttccaccatttttatcttgttgacttatttgacactctccccatctcagtgttctttgagtgttcttctgttaacctttaaacaacaggtgccaaagggtcctctttggttcttactatagcaaacgggacgatgtggtctccttccacagccccagacaccagtcattgaggatgactctcaactcatggactcatacgactctgagctccaaagtcatgtatccagctgagaactgtacatcttctctcagacatctctggataactcagcaagtccaaaagggagctctttccttccctgccgcctccctcctctttgttccttatcctggtccatcctaaaatctgtgaatcatctctactcttcccccagcccctctactgacccaagcatctggttctgtttattctattatcagacccaaaggcctctcaagctggtgcacgttttccttccttatcgccattgctccagctacaaatctcttcacttctttattgcctgttctctgcttctctctccaaggttatctttgctaccagatgcacagactcttcactccaatcacttcatactgacatttttttcggtccctgaaatttgttcttctcacgtgcacaccagcttttgcacatatggtttcctttgtccggaatagttaaagtgacttttactttttgcttggctaagtcatgtttactcctcaggtaccagtttaaatgtcatttctatgttaaactttccaacttccctataacatgctcttttacacattcccatcataccctattctttcgcccaataaaaagaatttaatgttggaccttcttgttatgcctgtttattcatttgtatgtccactgcaattgctaatttcatgagaacagagacagtcttatggctagcacgcagtaggttctcagtaagtgtttgttggataaatatgaaaattgagattctatgctgtgttttccagccaatcaacttttgcttaccattagctgttgtacatgacttcatggctacatatatagaagtcacgatattcagagtttaggcatgaagctagtccttcatacatcttccctatgtttcataaacttcatctcagatttgcatgatgttttggttcattagctttgcattttagatttgtttttatggagcacataataagacttcatggcagtgaatttgttgagaagttgttgaaaaagtaattacatcccgaagagtttattttctaaagccatgaatcaatggaatttattcatagcttaacaatggggagatgaacctatttataaattacaaaggatctttccattttaaaggaaatactgcacagccttttactcaagaaacattttgcatgtattaaaaagtcataaaaatacggtactaacagaagacaggtagactatttcggtaatttagtcaatgaacagtttccttttaaaattgaatcatacctagtgcccattcacctgtggggaatgctggttaaattcttcagtagtggtgtagctttctaggttagagtggttttagtcgacaaagaaaatcgagatatgacttccgtgtcacagacagttgctgtattaaagagctcctttgtatatgtaataacatagaagacgttttaagcacttagagagttccacatctaagatagcagtccctgtaagactagatctaacttaccctattgtaatggagcagaaatacatgagacatgattttgtttgaaatattggatcattttcctttgagtctgtgatttctgagctacccccaccctcctgtgtgactttaatgcagtctcccttctgtatcctggtgcctttccaaaccaggcaggtgtgagaacagttctgcatgcgtaagtcagctccccaaggagaccgtttcaaagcaaagtgactttcttgatcccagggaagataatattaaagaatacagtgaccagaccaggaaataaagatacactgaattttgaatgactttgcagacctaaacatttgtaagaagaaaaagaaaacatcgaaagtgagtaaaatgggccatgggagaaatttaaaagtagataaatccaccgataagagcatacatttcctttgctctgccttccaaaggagcttctgatgcaaaacttcacgccggtcaagaaaaggaggccaagaaaagcttgtgctaaaactcttacaaggctgccttttaaaagaaactttactggccaggtgtggtggctcatgcttgtaatcccagcactttgagaggccaaggtgggtggatcacctgaggtcaggagttcgagaccagcctaacatggtgaaacccaatctctactaaaaaaaaaaaaaaaaaaaaaaaaattagccaggcgtggtggtgcaagcctgtaatcccagctactcgggaggctgaggcaggagaactcgggtggcaaaagtttcagtgagccaagatcatgccattgcacttccagcctggacgacagagtgagactccatctcaaaaaaagcaaaaccaaaacaaacaataacaaaaacaaaaaatactttaccgtattgcctcttttcatctgctaatataaaaaagacaaatgatctctctactgctccaaaaatatgtgtgcttaatacaatctctctcaatgcaagtgtttacactttcctatccaactgcctccctcttgtagagtcccattcttgactcaaccgtgagcatgaaaaggcgaacgctccccccgccctgaacacagcattgatgcagttaggatacaggctgaactgctccaagagagagcataaaatagaggctgccccaaacaagagacaagaaaaacacttatttctatctctccctgcgggacagaggggcgatctggggtgggtccttgtcttctatccctgggccaccagctgcaccagctcttgccattcctggccagggctaaagggagagctccgaaatagagtttctagctgggtgcacgtgtcgaacctggggataactgaggataaatccccttggctgccctgcactccatgctttgggtgaagcccactcagccccactctgacaaatgtgcctctcaggaggaacaatcgtttgtccccttccagggcactactggccaatatctactgcttttccaaagattttagtgtttgtaatccttacttataaaattacaggtcacatggcccaggcgtcaactactagtgaatatacagctattcattcattcatcaaatgtttactgaccactggaaggcagtgagggacagaacacacaggtagctggaggagcaggggccaggcagagggagctgcttgtagagcctctggatggcggtgcctggagggtggaggaacagagtggcctggaggagcaggtgatggagagaagggaagcagacgccctcaagaaggtagtgggagatcagggcactgggaaccttgaaggccattgtcaactgaaaatcctctactctggtggccctgggaagcctttggaaggtttgagcagaggtgtgtcttgatttatctttaaaaaaacatctcatgttgccatgttgagaattggactaaaggttgcaaagatggcaatagagaagcgggttaggatgcaattgtgaacatctgggaggagagacggtggcttgcaccagggcagtaagcagcagcaggggaaggtcacattctgggtcttttgaaggtggagcttataggatttgctgattgtttggatgtgggttttgagcaagacagatgagtctaagagttttagtccaagcaactaactaggaggatagaattaaccaccaactgaattgggggcattgtaggagaagcatgtttgggagaaagaccaaaagtttgggtttcaatatgttagatttttcttagatttccaaacacaggtgttaaagaaatagttgaatacgtgggtctggagttcagggaagtggtccagcctggagaagaaaatttgggtctggagttcagggaagtggtccagcctggagaaggaaatttggatggattggggagtagctcgcatattggtggtaatccaggtcttgacaattggacatgtccagtgagtgcccgatgtggggcacaactgtgcttcccctttgctgcgaggtggggtcctgggtccggttctgaccaggctcacaccgtggtcaggtcctgtcacacttcctttccctctggcatggagcctggccacgtgtcagcagttctgttaacctacatccccccctccccgagggcaacacggggcagaactcccccggagatccatgaggagcctggaacctcagcaagaaaggaatcttgttttttcagtcatgttgggtttcagttgtttatgatctcaactcaccaagtctgccctggctctggacatgggtatggttcagatgctaggtatagtagtcaaattataatgtagggaaatggataattagggatttatttttgtgatttctttgacatacagtttgagccaggaaatattttcattttccaaactgagatggaaagaagttaactggaagttaagaaagttggttatggctggtgtagtggcttacgcctataatcccaacattctgggaggccgaaacagggggattgcttgacctcaggagtttgagaccaacctgggcaacgtagtgagaccccatctccacaaaaataaaaagaaaattagccagatgtggtagtgcacacctgtagtcccagctactcaaggaggctgagagaggaggatcgcttgagcatggagattgaggctccagtgaactaccattgcgccactgcactccagcctgggcaacagagcaagaccctgtctcagtgaactaccactgcgcctctgcactccagcctgggcaacagagcaagaccctgtctcagtgaactaccactgtgccactgcactccagcctgggcaacagagcaagaccctgtctcagtgaactaccactgtgccactgcactccagcctgggcaatagagcaagaccctgtctcaaaaaaatagttatatatcatgactatttcactagtagcacagaatggcttatccataagatccttgaaggttcggtgctgtctgagtgcctgcctcagtctcccccagctttggaaagcaactggcccctcttctagtggcctgctttgaaacatattctattatctatatctgtatctatatatctacatctatatttacatctatctctatatatctgtattcatagattttcttactaaatgcggcaatgatgtcaacagttcactttaactgagtgtgtactatgtgctggccctgttctctattttgcacattcacagaagccctgcaaagaaactaccacatgctttagagttcccaggtgctggaagaaggcaccccagagctgcacccccaaaccccgtggcaggccctcagcagacgaggtttgccttgcaccaccactccctcctcctaacttatttttgttttgtggttctctccacagaggtaagctattagaaacatttatttcagcctacatacatgatgttttctaaaaaccataacattcttctttctaaactcaatgctttggacaagctaacattccctgccactgttccccattgtgttttacggaggcagcaggtgtttgtgacatgcagatggggtcttgtactctctctcaattagtccccacaataacccaggaagaatgttattctcaccatgggccaagtggaagcagaggttctcagactgtgagcagcctgcccagaactcaccagggatgacgatggagccaggacccaacctgatttaatttattcagtaggttgaatgacgatacttgcaaagcagtgaaagtcgagggtttcagaggctgttaactcagtgattctggagccatctggggatgctggtgagaggtgacagcgtgctggcagtcctcagagccctcgcttgctctccgcacctcccctgcctgggctcccactttggcggcatttgaggagcccttcagccacccactgcactgtgggagcccctttctgggctggccaaggccggagcccactccctcagcttgcagggaggtgtggagggagaggcgcgagcgggaaccggggctgcgtgcggtgcttgcgggccagctggagttccgggtgggcgtgggcttggcgggccccgcacccggagcagccggccagccctgctggccccgggcaatgagggacttagcacccgggccagcggctgtggagggtgtactgggtcccccagcagtgccatcccaccagcgctgagctcgatttctcgccgggccttagctgccttcccacgcggcagggctcgggacctgcagcccgccatgcctgagcctcccaccccctccatgggctcctgtgcagcccgagcctccccgacgagtgccaccccctgctccacggcgcccagtcccgccgaccacccaagggctgaggaatgagagcgcacggcgcaggactggcaggcagctccacctgcaaccccagtgcgggatccactaggtgaagccagctgggctcctgagtctggtggggacgtggagagtcattatatctagctcagggattgtaaacacaccaatcagcaccctgtgtttagctcaaggtttgtgagtgcaccaatcgacactctgtatctagctgctctggtgaggacgtggagaacctttatgtctagctcagggattgtaaatacgccaatcagcaccctgtgtttagctcaaagtttatgagtgcaccaatcgacactgtatctagctgccctggtggggccttggagaacctgtgtgtggaaactgtatctaactaatctgatggggacgtggagaacctttgtatctagctcagggattgtaaacgaaccaatcagtgccctgttaaaacaggccgctcggctctaccaatcagcaggatgtgggtggggccagataggagaataaaagcaggctgcccgagccagcagtggcaacccgcttgggtccccttccacagtgtggaagctttgttctttcgctctttgcaataaatcttgctactgcccactctttgggtccacgctgcttttatgaggtgtaacactcaccgcgaagatctgcagcttcactccagagcccagcgaaaccatgagcccaccgggaggaacgaacaactccagacgcgctgccttaagagctgtaacactcaccgcaaaggtctgcagcttcactcctgagccagcgagaccacgaacccaccagaaggaagaaactccgaaaacatctgaacatcagaagggacagactccagacgcgccaccttaagagctgtaacactcaccgcgagggtccgcggcttcattcttgaagtcagtgagaccaagaacccaccaattccggacacactgggacctctggtcaccctatctctggatctgaagtacttaaccctgacttgttatggcaccaataggcaaggccaagcacccacttactttaggaaatcacatttatggcgtgtttcctaaaaggcaaacgtgtcttttttccccaatctctgccttcctcattaaaagtaaaccaaagctgggcatggtggctcatgactgtaatcccttccagcacattgggaggctgaagcaagaggatcacttgaggtcaagagttcaaggccaacctgggtaacatagtgaggccccatctctacaaaaaaaaaaaaaagtagttgggtatggtggtaccgaagaaccacttgagcccaggagttgaaggctgcagtaagctatggtcaaaccactgcattccatcctggactacacagtgagaccctgtctcttaagaaaatgaaaataatgaagtacaaaaaaaaaaaaacaaaccaaggaatggacatggaaaaacggcctttcaatatggcaggacattgataatggccttcagaaacctctgctgggcttccagctctggcctcctccgcaggtcaccacaccctcccaacaaacacagacctcggcacttgccaggagggacagcttgccctgcccctgcagccgcagcaacacagagccaaggcctagccacaaagccctgccactcactgccaattagttctgttttcagtataaacagaactgccttaaagaaaaatacagcctcccagagcgcagaactctttatccccccattcgcaaacaggtgagggattgtccgctcactcactctgcaggaaaagtgggacacttggcttgctttcctgcaaactgcattttgaggaaggccaccaggagccctgatgccgagtcacagaacaggcctgactctacagaggcggaaggcggagaatgaacagaacaatgattctattctctaccctctttctggcagatttttttttcctgtgatggttgttggagtctgtgacaaatagtccacaaccaccgcggattggcagagccgccgcgaaaggcctctgcgcccaacacaaaggcatctgttacaggttgcacctcccatcaatgagcgtccgacccttatgctgtctttgtttaaaaggaaaaaaaagatcctacttaagcaaaagtaaaccacagcctgatactgtgccaactatattaaccaacttctcttcggagcctttgaagttggcagggggcaacatgcttgtggtgcgaggagagaatgatactttaagcgattccttttcatccctttaacttaatgaaagattaatggccttgttatttttgtttctgctcctttttttcccctttaatatccacccccaccacccccaccacccctgccattgaaattgaaaatccttcccgatcgtggttttctggatcagtgggttttgtgaatacaactcctgccccttcgttaccatccgcaaactgggtcaatgactccaagtccaaaacatccaggtgtcttcaaggaggaggtccctggtggatgaacaggtgggtggcagcccaggagagctggattttcttcaaacaaaccccacctcctttgagtcaggctggaatgccttggcagggaattatttatgtttttccttgaagatgcagtgcggtgtttttggcaccattttgggaggcgggctgtggactgatcaggaggtggtcacatgtcacaggcccagtgaatcctgctggcggggaggcaggagagcaccaacacaaagttgttcagtcagcaagagccttcctctcccacctcagccactccattttccaggcttgttctcctccccgtctttctcttgctgctgaacgctaactccatccagcaaccgcaggtgccaaaaaacataggtgtcgttccggataccaactcgcactaccctccccacccatattcagtcaattagcaagacctgttggttcagtctccaaacatatttcaaggacagcccttgctattcatgccctcttccacccaagcacacaccacctcacaccttgcctggaggtcatttggagtcagcatcttctttcttactctgcagccagtgggacccctctaaaataaacattgtgctactctcttgcttaaaaccatctgtggacccaggattctcttagaggaaaatgccaactccctcctgggggctggaaagtcctgtgtgacctggttcctgcccagctctcctgggctccacacagtcctctgtcttccctgggccccgtgagggcttcagcatcaatgccatcctcacctcctcacaggatgggcttctgtggtcatcccagcctcaggaaagtgcaccctctgagacccacagcatccacacaccatctacagcatcctcctcaccctgcctccttgtgctgatgttacctctatccctttacccctgttttattttcttctaaacattcatctttatcggaatgtatttgcgacggatggcccagccccttctatgggaatgccagagccgtggaagcagtcatggtaagttggacttacctgccccctggtgactgatgagtgccctccttgtgccgggcacgttgctgggtggtgatccgggccacctccctctattcatggggaacaaatggcatttgccttcatggtggccctagtattcaaagcaccatgtgaaaagaacaattcagtagcagagccccattgaagactccagaaatggtctcaactatttggccagctacatccaagaaaagtggatgcccatatgaagacaccaaggagatatttagaacatggccagaagtcccaagctcattcagttggatagagttgcacatttcgtttgtacctggccagcttctgcaaactcagagattgattactaagtgaaactcaacagaacaacctagagattatgttacctagaatggggtagtacccggttactcactggttctgctaattcaagaaaattctaatgatattatgcaaggcagtaagaggctgcatttattcaaaatttctattgcagatgaattccataaaacccgggaaggctcagctcctggtgagaacccccaggtggggtggagctgatgagacccccccaggtggggtggagtatatgcctctctgcaccttctcagacctgacttgtacatcccgtatttcatgtggatcttcgatagataattgtcttccagaatattttaaaacctcctctagggctgaaaatgagtcttactcatcccgtagtaagaacttggtgagtgcttgtttattctaagatctgtgaaatcctgtaactcagtgtaagaccctcccagcagcagagggataagcaaaaggcagccaggcaccgttgttttgctccttcgtgggcacaaatattgctcacgtaattataatttcatgtatgtgattgaaagtttctgacacataccatgcttaccccagttctagctacatcaatgattctcacattttggtcagttgtattttaaaaactcttaattccagtgaaaatgtatggtagagaattatttgggttctatgattctttagcttgggattttcagacccatttttagcattttatggctgactttcctgccaatcactaaaatggaagagtattgggctgagcacacctgacacagactgtcccaagaaagggctgttgtctcgtttccaagcaaacaacagccatgttgcataaatgcttaaaccctgtagttggaagaatttaatgaagacagaccctgatgcacgacattaaatacattcccttcttttaataactcaagttgatttcagatcgggaatcacagtcgtctaatactatgaaaattaaacagaaattttctgccattacaccaagcagcctgcttaataaatcagtaatgaaaaagaataatttattatggcttgtgaattctgacagctctaaaaagatgtccttcctcttcccccagagggagaacggaattttctttttaccttcaatacactggcattaagcataatttctctgtctgtaggactttactactgaagagtagaagggattagatttttacatcacaacctattttaagcaattataatccacaagtaatcttcctcattcatcccccctggggcgaggaagatgtaagagactgttctggggcctcaatttggatcagtgtttgcattcctactagctgaattagctgggattctggagtgtggagcccatttatctcagacgctgtgggaatgtgggcctcactcacaaaaggaggtttttgccaactgagtgccattagtgcagtcaaataacatatgacccccatcctttgccctcagacatgtcttttggtctttggcctccttgtgccagtgcaggaagaaacttctcgctttgtgggaagccatttgggagttaacgacctggctttccttcaatccacttacatttctggtcattctcagcatcagggagttgtgcactggagtctgttcatacaggctttttttttttttccaggaattttgtgagccagttgtaaacacagaattattaaaaattaaattacataaatgtacatttaaagcaattgtattggaaataaaggtagaagagaactcagcttcaatgcactccgtgatgacctgtgctcctgaggctcactgcgtggaggaaacgctcgccgggggctgcaggcatctcttcccatctccgtctggtgagtcatgttggtaacttgaagttgcccacgatgggagtatttacaccatggaaattggcaaacatgacaaatcaagtgtgtttattgtatttattgtattctggtcattttgttttcctgaagagttaattgttaaacctttactagcacactgctggcaaagggggaggggatggatgagagcaaagacattcctaggcttaaaattagccatgggaggctagcacctgcctctgagagccactaaaagtcacttatttatttacaatctcttttatttgtccaacagctattgtgtccacagcactggggacatggccataagcaaggcagatgagggctctgctcttagagagctgacattctcatggattaagctcaatgggtctgacaaattgaccaacgtgttagagaatagggggccaggttagaccagatggccaaggaaggcctccctgaagaaaacttgttttatttccttcgtaccgcttatcaaaattaaaatatgcttctttctgtgtcatcctattgatgatctgctccccatgcccccaagccttgagtgtgtgccccatgaggacagggacttgtctgtctcactctctatccacagggtctgctgagtcaaagtgagaacacgaggcacgatagatatttgttgaatgcattaaatgggacttgagctgacacctatgaaatgaaaattattcctgggaagaggcaggatatgagaggcccaggcagtgggaatggcacctaggaacctctgaggtggcagaggtggccacagcaaaatggaaaaggaagagtgaggttagaccaagcacgctcccacaggggaatggttggcagagcccacggttctcctcttcctttcccattccttcatctctacgtggttcatgggggaaaaggccatcagctttaccttccagtccagtagttctttcttccgctgtatctgatctgatcttcaatccgtctgaagcagggcaggcgaaccccacactgggcttagcccgggaaggattttggctgtgcttaggagcgagctggtggtaggaggaagcagctttatggaggtgcagggtagcagccccgtgaccaccacaccacagcagagcagggcccacaggcagtgcctgagagcagcagcccagggcagttctgcagccatatttatatctacttttaattccatcccagacaagggtgagcttattcagaaatttctagaaaaagggtgggaacttctgggtcgttgtcttgcaaaaggggcagtaacttctgggtgttgccatggcaatggtaaactgacataacactggtaggcgtgtcttatgggtgttcccatggcaatggtaaactgacattgcactggtgggcgtgtcttatgaagggctgctttcacctccttcctgtttttcagccagtctttgatctggtctggagtgcggaccctgcctccagagctatgccccgcctcctacttcacatccgttgactgttttatttccaacactatttttttaatcttagaatttctacatgcttcttttgcaaatccacacatttttaaggtgttctattcttttatagttttccatccctttctttatgatcattctaaagacttctgggataaataagttcaaccttgacatgatatattatccttttaatgtgttactagactcagtatgctaatattttgtctatttataattatatataagattagcccataacttttgggcataagactttgcgattgtcatattttttcaatgattatacctctggtaatctgaatattcttctttggctttttactttgaattcattggtctaaattaatattgcatttttatatcccttcccttttaaacttacttcatccttgatatcccttttgtaaacagcatgtagctgagtttctatttgtacccaagttgaaggtgtctttccttttataggggaattgggtgaatagtgtttattatctcatgatgtccttacatgcttgtatttctgtttattttatgttgtttcttttccacgttttgttttttaaaagttgagctaagcaagtctcatttattccatttaactttttataaacaactgctttagtagttatacatactagttatatttttctagaggtaatttaaatttttaaccatcatattcaattttaaatttttattaatgtctaatattaatcaatagcttcaccccaccaaacaagagtctgggcacacattcagttccgtctctaccacctgtgggctctctggggtgcggtctccttcaccatcttcatagccagtagctcctggtggagcactggacaccagcccagactttgatctgattcacccaatcccaactgctcattttcaggtgtttctggaagttttctcttctactgatggcatcgttattgttttctacagatatttagatatttttaaatatatattatattttcctgtagtttctggggatttggagcaagaaagggaggcacgtgttaacatgtttttttgatcaaacatcctttttgagagcactttgttggttttaaaatatttagataattaatctctctactgtttccttatcgatggccttgaaaaataggtattagaatctcaattttagagacaagaaaattaaggagcagggacattaactaatttgtgtaaagatatccctcttggtaaggagaaaaacgagggctggaaaacagatttttctgatatttaagctcatgttaattctgctctgaaaggtgtggcagttttctttccccctcctcctcctccttctttttctcttgttcctccccctccacttccttctgccattatcattaccatcatcaccatcactaccaccatcattattaccatcatcaccatcaccatcatcatcaccaccatcaccatcatcaccatcatcaccaccatcaccatcatcactatcatcatcaccatcaccatcatcacatcatcaccaccatcaccatcatcatcacatcactatcatcaccaccgtcaccatcaccaccatcaccaccatcaccatcatcaccatcatcatcacatcaccatcaccatcatcatcaccaccgtcaccatcaccaccatcaccatcatcaccaccatcatcacatcaccatcaccatcatcatcaccatcttcaccatcatcaccatcatgctcaccatcatcaccatcatcatcaccatcatcactaccatcatcactactagtttctttacccctaaggaacccgtgagtctcttggagggcagggaccactttttaccaccttggcatttcctgtacctactgcctggcctaatgcccacatttgtaaatctttcttcaatgtttgtttctgccttttgaattttagctttctgtgagcagatttgtcttgtttactaacatttcccatagtgtccaatagatgccagggacagagtgagtattcagtaaatatttattcaataaacgaatcagtgtttcatagatgctacaacctactacgatataaaaatgagaatgtaatttgaagacagaaggtaagaaaaaaagctcaattagaaattgggttgttatgtaaacctaaaatataaaaatttagtttcactagtataacaccatgacaggatgatttagttagtgatctctaaaatcatcacagctgaaaaacatcttgctctatattcactacgtggtatactatgaagcctccttctgtgcatttaaaaaaaataaagacctatcacttggacttaatttttccactgcatttcatcatgttaaatgtctggccactgcattactaccacaatgggaattgttactaggaagcttagattcaaattaaggtagttccaaggactttattaattagcacgttcaaaaagcatccgttgagtttctccaggataccaaatattatgggcagtgcaagaccgataaataaataagatatagttcctgttattaacatctttacatgtcatcggtgaggaaaatgtggcacccttcatgactgtgtaagtcctcttattggggaagttctcggcttgatgggggagtcttgtttgcccagctcttcacaggaaaagggcttggcattaacatgacctcactgggtttctctccaggtttcaacttgtgcctcctgggagtaaagctgtacaccttcattatgcaacctcgtcctgcacccatcagcccccacccttcatacctacccttttaatctttcaagaagtgaaaaaagttggcttaacctcaaacatcctttacaccaggagaaatgtaacgatgattgatggttattctaaatgatctggggtcgaggataatatttaattctgctttgtgtcctctttggcgggtggtaaatgttggttacatgaaaaatatcgcccttgtccccaggtggggaccatgagatttctctaatgcaaagtgactatttttccctttgtgagttatgagtatcttgcagggaaacactttgagactctgcaagtatcctgtttctcatcgaactttcacccactagtttcagcatcccttgatgattattgtcggaaacaattatgacggtaatattgttgaatggtgatttggcaaatcacctttacatgtacatgtagggtaatcttaaaacaaaattaaatctagagggattctgtgcaggaagaacctgcatagaacattcatccaaattcctagatgggctaattaataaagtccttggaactatctcaatttgaatctaagcatcttaataacattgtggtagcaatgcagttggcagacatttaggacaaaagaatgatgcagaaaagttaaatccaggcaataggtttttatttttaaaaaatgcacagaaaaagtcttcacagttatccaggtagtgaatacagagcaagacgtttttcaactgtgatgattttggagatcactaagtcatcctgtcatggtattttactagtggaattaaatttttatactttaacttcatatgacagtttcttttacatgtgaccatgcattgcaaaaaaccttaccttcatgactcttgtaccttttagctgtatgaccttttcatgttccttatattctctgaactttattttacttatttgtagattgggaataataatagtaattgactcataggggctgcctgaaaattaacttaaacaatatgtgtaaagttcccagatgagtttgtgataaacagcagatattccatcaaagtttgctatgaatgttgttgtatttaccaacatttctcaacactgatgggatcttaaaacaaaattcaatcttgagggattctgagcacgaagaaagaagatgttgcaatgccatcctgaagtgagcagtaaagttgttcacaaaggcaaagaccgcaaatccctgccagggagcggcaggctcctcctgaaaggacttaaaggccgctgggaaagccgagggactccagcttacattttttccagctcctcaaagcacacatctgtgggccctgatagagggaccctgcttgctttcttctgtagagataagagatatgccagaaatcacccctgtggaattattatgtgaaattgggaattaggccatctgacgactttcttgtgaaatgagagcatcccgaggaataccattatttaggaacatcttcctgtctgcatttgggttggagtgtattactggacggggtgtttacgtgtgtgacagtggatggagccgcagaaggtcaagtgaaggtgtttacttctgggtaagagggagatacaagatcctcataaaaccacatcatgaagcttctcttccggatcatggctgcaagtaagtcacttcagtttctggtgagtaaaatccatctctgcccagcatgctcttgcagaatgcgaaccccttggactgtcgctgtttttaagacaagcagcagaagaccagaccatgggttagaaagccttggcttcagtccatatgtcagttgggcaaagcaactttgtaaaagtccagctcctctaattctcctgatctatgaaatggggataattggaggtataataattgtgctgggttgaaaattcatgctcaccaggaaacacagaatggaccttgtttggaaagagggtctttccagatgtgattcgtaaagatgagcggtgggccctaatccagtgatcggggtccttagaagaagaaaagaatttggacacaaagagacacagaggccagcatcatgtgaagagggagacagatggaagtgaggtgtctaccggccaaggagcagtgaggattgctggaaattccaggcactagagagaggtgtgggacagactgtctctcagagtctccagagaaaccaactccagtggcacctcaatcttggacttctggtctccataaatatgagaaacaaatttctgttgttttaagtcactgcatttgtgctaccttgttacagaagcatgaggaaacacgagacattaaacagccaccgcatggtgtctttctgaggctcagtttgaatcatacacagaagaccttcaaaggttagtggtatgttcatatatgggttgtgaccgtgaccctgggagacagagtccaggttcacacttgcagctcttgcactcaactgctgagggctttgggtagctcccgggttcttccgagcctgagattcctggtctataatcaggagccacctctacctcgtgttgtcgggaagatgtaatggggacagcatgtagagggcctgtcaccaaggaggcacctgggagataataaaggctgttattattattatttatggagaatcccttgtgctcgctttcaccctgcatttgctgtttggggcagttattgggatcactgagcaatacttagtgtgtacttatgaagcacctcactctgccagtgggtgtcaaggaattgtaaccagggccctcagccctggaacggtaaacagcatagagaggggagagaggatgggagctggtgctctgcggccatgcccatctgcactgcaccatggaaaatgcatgctcccatccaaatgggcaacagtctcccttcttatgagtgggcaatactctcccttcttatgaaagatcgaagtgagaccatcctagactcctgagattggaaacgggtgactgtcaagtggagtgggagctggaagtggcaggactcctgtccctttctgagatggaagggagcacacatcggagtgggtgggtctgttgcgcatatttgaacccagtagtgctgaacttatgtgctctcaaaatcctgcaaatactattttcttccaaatgaacaaaacctgctccttggacgaacccattgaagtctgcaggatgcacttctgtgagatttgggcttttacaatggaagtttaggtaggggaggctttgctttctaatcaggtacatcaaacacagtcaaaatcccttctaaggttcttcttgaaaagtcaatgaatggatcatgatcaaagtgtttgaatttttctgtgtccccaaataacacaattcttgatgatacattaaaagaggactgtatgtaaaggaataaggacgcttctttatttgggttttcagcacgctgtagtgctaagctcgccaaagtccattgagtatatcatctctttcttcttttatcctaaaaagaaccttctaatctattgtcatgaccatactgtgtttataataaacccagctgataaattataatgttattcattcattcaacaagtgactcctgtgcccctactgtgtgccaggtgctgctcaaggcactgagatgccaacgcagaatgagacacacagacccctgcctccctgacccacccttgcaggcatggacacaggtgttcagtgtgatcccagttagcgtctctcatgtgctagatgaggacagggttctggagacataaaagcaatgaagacagggagctggggtcacaggctgaaattctggacagcgattgcagaagaggcctcctggggaaggtgacatgagagcagggtttaaggaggaaaggggaccagctgggcaaaggttggagggaggagcatcccagctgaggagacagcacctgctgaggccccgaggtaggccaacctggccctggaaggatctgtggaaactagagcagaattagccaagaggaaagcaggaggggctgaggcccggatcacaggaggctgtgtggaccctgccggtgccacggcctctgctctaagtcaggtggggagttactggaagtgaggagcagaggagtgacaggaaatgatggggctgttacaggaccaccagggctgctgtgtggacaggcagctgcggcagctaccaagagcagaagcaatgatgccggcctggaggctgcatgtgtgtccatatctacaactcggtctacaccacacctgcatttccatcgctgtcacttctatcgtcatctatatccaggtaggaggctgtatgtccatatccacaacctggtctacaccacacccacacctacatctccatcactattacctctatcatcatctccatccagcccggaggctgcacgtgtgttcatatctacaacccagtctacacacccacacctatgtctccatcgttgtcacctctaccatcatctccatccagcctggaggctgcatgtgtgttcatatctacaacttggtctacaccacacctgcatctccatcactatcccctctatcatcatctctatctatattaatatctgtctatctatctatcacctatcatctatccagctctacctacctacctgtcatctatcatctatctgtccatctatcatgtatcacctatctgtctataagttatctatgtctatttattcatctatcatctatctacctaccttcatctatcttctacctatctatccagctctatctatccatccatgtatctatgtatgtatctatcatctatctattcatctacctatcatctacctatctatccatatatctacctatctataatctatctgtatctatctatctatctcctcatcgatcgtctgtcaacctgttatctatctacctgtctatcatctatcttcctatcatctatctattcatctatcatctacctattgtctatctatctattcatctctctacctatcattcatctatctatctatctccctttataatctccttatctataatttttaaccagctgcagaggagtcggtgagttgtaccctccactcatgacatgtggacatcatgagcactgtttgtttcctgctgctgttgtaataaatgactgcaaatgtcatggtgattaaaacgccaccagctcacgctctcacaaagtctgaaatgggtctccctgggctgtctgcagctcctgccccgaccccatgcccaccggctttgctgccatcaaggtccccatgggcctctgcctgcagaacccaatgctggtcctcagtcttctccctgctggagcgttcagccctctgtggccctgggaagaatttccttgtccttagacgtgatttccccttggcttcaggaagccaccctttgcttttccttctgccctataagctgctctctcccagggcctactgggccctcctcttcccctggaccagaggaccctggagcacccagagcccaggccagccctctcatgtccacctccacccccaatcggggggtccatctcttctcacggctttaatgaccacctctctggcaacgactcccaagtggatatcatcagcctgaacctcagcctaaaccccagacttgccagtccccatggctccctgacagctcctggcggaggtccaatgggcatgcagagggagggctttgactggaggaataaggacaggaagtaggaggcagccggcgtgggcagtgcttcccaggagctttcctgagcagggaagtggaagtggtgcagcagctggacgggagagcaaggtccaagaaggtgtgagatttatttttatttttattacttttgttttaggttcaggggtacatgtgcaggtttgttatataggtaaattgtgtgtcacggggatttggtgtacagattatttcatcacccaagttataagcatagtacctgataggtcgtttttccatcctcaccctcttccctcccttcacccggtgtctgctggtttcttctttacgtccgtaggtattcaatgtttagctcccacttacgagtgagaacatgcagtatttggttttctgttcctgtgttagtttgcttaggataacagcctccagctccatccacgttgctgcaaaggacatgatcttgttatttttatggctgcatagtattccatggtgtatatgtaccacgttttcttttctttccactttttcttattttttaggctgtttcttttttattatttcaattgtttgggggtataggtggttttcagttacaagaatagattctttagtggtgatttctcagattttagggcactcatcatctgagcagttgtactgcattttctttatccagtctatcattggtggcatgtaggttgattccatgtctttgctattgtgaatagtgctgtgatgaacatatgtgtgtatgtgtctttatggtagaacaatttatactacttggggatatacccactaaggggattactgggtcaaatggtaattcggtattaagttctttaagaaatcgccacactgctttccacagtggctaaactaacttgcattcccaccagcagtggctaagtgttcccttttctctgtaacctcatgagcatctgttattttttgacttcttagtaatagccattctgactggagttagatggtatctcattgtggttttcatttgcatttctctaatgattaatgatgtggagcatttttttcgtatgcttattggccacaagtatgtttcttttgaaaagtgtctgttcaacagtttctcagactttccttacgtttgatgacattgacagttttgagaagtattggtctggtatattgcagaatgtccctctactggaatttgtctgaagttttcctcatgctgagactagagttatgggttgtgaggaggaagatcacagaggtagagtgccatttccattacattatatcaagggtgtataatatcaacatgataaatgcctgctgatgttgacattcatcatctgtctaaagtagcgtttgtcaggtttctccattgtcaaatgtgttccttctgtccctactgtctttggacggatgttaatatgatcatcccacacttagggaatagggagttatgcttcctctcctcactggtggagtgtctacataattgatgtgcaattctgcacacatttgtctcttctcctctatttactagtttttctcaaatatttattttatatttataaacaaatatggatatttgttttatactttgggttttaatccaacactattttcttgctcagattgttccatatttggacattggaagctcttttaccacatagatcactctagcctttcccctttgcttgtctgtaacctccaattccaacaataagaagcctggctcccaccataggccatttacttcattgttcaattcaaagtatatgtgtatagtggtatcagaattgttagcctgtaccttcaataggaaacaattctgtcaacaagaataaagtgcttatctgtagttagttttgcctttagtcttacaaattccatttatttctaaagttacacaggttagcaccttttctacacccttttcagtgaggttgtttcatatatttataatacagttagattttctggtcatggtctactagtctttactaggatcacctgacctcttcaataactttttaaaatttttcttactttaaggttcactctctgtgttgcatagcatttgtgttttggcaaatgcatgatgtcatgcatcccatattacaatatcatacagagagcagtttcattgccataaaaatccctgtgcttcatctattcctcgccaccacctgccatccaacccccaaacccctggcaaccactgatcttttttctatctctataaattcaccatttcccagcaatgtaatgtaatgggaataatacagcatataagtatatggccttttgagactgggattttttacttagctatgtacctttaagtttctttcatatcttttcatgtcttgataactcacttcttttgattgctgaacaatattccattgtgtgaatttgtcatagttcatttcccattcacatattaaaaggtgtatgaattacttccagttttgggtgattataaagcttctataaacatttatgtccaggaatttgtatggacttaagttttaaactcaatgggtcaatatttaggagcacaatcacttgattgtatgataagactatgcttaaaaaaagcaaaagacaacaacaaaaaaaaaacctgccaaagtgtcttctaagttgctgacttatgttgcattcttaccagtaatgaatgagggttcgcgttcctctgaatcctccccagtatttaatattgccaggtttggggacttttaagcattctaatagacggacagtggtatctcgttgttttattttgcaattccctaatgatgtctgatgataagactttttaaaatgtttattccccatttgtatattctctttggtgaggtatctgtccacatcttttgcccattttttaatagggtggtttacttttctattgttgagttttaaaagttctttgtctatttttggatacaagtccttgatcagatatgtattttgcaaatattttatctcagtctgtttcttgtcttttcatcctcttaacagtatatcaaagaataacatattttaattgtaatggaaaaaagtgtctgttcatgtcctttacccaccttttaatggggttgtttttgcttgttgtttgttcctatgggttctggatattagaccttaatcggacgcatagtttgcaaatattctctcccattctgtaagttgcctgtttactctgttggtagtttcttttgctgtgcagaagctctttaattaggtcccattatttttatttttttaagattgcctaagaacacatctgaaggctgatgggaaagatggagaaaaaagggaaagatgggtgagagagagaggagaatggtgggagggagtccttgagtaggccagagagattagcatccaggcactaatggaagtgttggaggattcttggagtgtcaagaaagaaatgggagaaatgactcggttctccagataccctgggagactgctccagaggcagcgccatccatctgcggctcatgggaagggtggagtttgtttatggtttaattaataaaataaatgctgtcctatcatccatggttaccaggagttggtgaaagtagacatcaggcatggtgtgtcttctgggaataagtgctgggcattctcctctcccaggagatccatcccaaggcccctgtgtatcatctgatgctgaccttctgtctcctcatccaggaggaggggagggcgtcaaggattgtgaggtggtctttctcccacaccacggtgcccaccatgtctgcagtgggttaatgcccaggttcactggaaggcccggctgaaaccacaaacccccttcactaggaaatcaggctccttctggaatctaggagagaagtcagaatccactgattctactggtggggactcctttggaaatatggatctgagagcgtcccaatgacgcaggtgcgatgaggccaggtaatctccggaagtcttaacaactcctccaaacagactgaatttgaatggtgacaagctgctttctctcctctttgagaaaaagaagccaaaccatctaaattccctcgtgtgatcccatgtttttatacaagagctcctggatttttcacttctcctttctagccactccctgtgtccgctacagaacatgatctgtatggagagaaaggtttagtgcagaggaaacatgaaatcaggccagaccagaggcacagaagaggagaatcctgagttcctaacagttccgttttgctacgaatgagacctgcaaaatggatccttgtcctttggggttcctccagagactgattttaatcagcgaggcattttcacaggtggctgtcacccgtctgcatgggcatttctgcttgatgctcagaactgaaagggcccatctccatctggactgtgtttccaccacctccatcacctgccctatttagattttccaggaaggcagtgagtgtctccggcataaaacccgctcgcctttcagtggtgaagggtcaaggccagggagctttctgactgcgaaattgccggttgcttctctcactttcctcctccatgcagctcggtggccctttctctttctcgttggtccaatttctcaccctctctcctttttgtagaaatactgagtctgtttcgtgtcctcccaggagctgttagacactgaaatctgcagctgagctgaattcaggttggaatgctgcacccttttctagttgcaaagacgcacagggttaaaagaaggaagagcatcccaaataggcttaacagaaaggaagccgggatccccagaccacaaaaccagtgcaggtggggaggccgtgcagaaatgtgtgtgtccttctcatgtcagaatcttaaaaacgttttatgagcaaagttaatggagaaggcaagatgtttaatgaataataaagtcgggccatatgctttatccagagaaaagagagaaagaagtacatgtgtgcatgcacacacacaccacacacacatgcacacacacacacacacacacacacacacagagagagagagagagagagagaagctgcaacgcattctttgttaacccaaccacaatccaattaatgatgaaagcattttagccttgttccagaacataggggagatgtttcagatctgtttctgttacctcttaggggacctgaaaggaaatccctactccaaaatattttccaaattaaagtgtctaacaatcagctctgtcaacaaatgccttttcctctccctgagttcagtgctggcatattttcagaggtggaatttgtagttatgtctataaagcaccgactgcccctagggtgagaagccctcatggtgccagcccatcttctttaagcctgttttctccaaagagttcttaaaaggcattttcccaaatctggaggtgaaaggcccccagggccataatatccatcgtcatcttctaagcaagaacacacatggcttatcctgaagatgaattcacacggcaaaacttctctatatgtttctgggtggctgctccggatttgtacaaatttcccacccattaaatccaagatttctgctctctcctccacaagaaaaaataaagaacataagccaaaatgcccccaacatccacactctctgattataaacaaaatccacagtgatccccatctcttctttggaacaaaatccttcttccttcccaaagagtcacctctactggacgcttggtattcattccttcctcttaattcttgcagccaggacttctctgtaggagccgaatgccccccacccccttcactgcccttccctccaaggtttctcaagctatgactaccctcctaccaggtggcccaagcgccctttcccccaccccgccccccaaacctgcaaccagtctgtgtctcaaatccccaacgttctctaatggaacttatgtctaaaaagtcaccttggaccgtccatggtcaaatggctgggctaactgcccctcctatcctgtttgatgtcctaggagcgtgtcacactgttgcccactctcctccagaaattcctccttcctggatttctgtgcatggaggactcctcccttctctgctttctcctgacccagatgttgttgccctgagtccccttctgggtcagcccctccttccctgacagacctcctctcccatggctcctaccacactctgagctctaactctggtgctcccccagacctgtcccctgagctggtgcctcatttcccaagggctccctgacacactgcctactcaccttcaagcagctgcgatgaaacatatctaaaattaaactcactgtggcgccctcacacacacctggctctggtccggatgtcattctccatgtcaatgacttccttccacctgcccttcctacccttccataaccggttgtcctgtcccatctctttgagctctcagagctgggtcttcctctgcctgaactatggcagcaacccctacactactcccagtggcaatttcttcaccctccagcttttcttttgttttggaaacatgcatcagactctccagtgatttccaaaggcatcatcttatttaatcctcaaaataacctttcaaggcaagaggacgacttgagcccaggagtttgagataagcttgggcaacataatgagaccctgtctctacaaaaataaaaatttaaaaattagccaggcatggtggggcacacctgtagtcccagctacttgggaggctgaggtgggaggattgcttgagcctgggaggtggaggttgcagtgagctgagatcacaccactgcactccagcctgggcaacagaaaaagatgctatccccaaaaaaacaaacaaacaaaaaaccttttaaggttggtactcatatcttcccattttacagccaagatgagggaacaacttgcctaaggtcccatagatattactggaaatgccccagttaacattcacagcatttattcagcctcatttatttacatctacagattgtgtttccagttatactactattcccaaagctgtttatatattgatttaaataaagggttcttcttttggtacatgaagctgtgtaaattttacacttgtgtttcatattaacagttctttccctgtgcaccaggaaaccgggctcatcacatatgctcatgtgatcaagacaaagcaccttaaataaataaatagtcttgagactgtggaaatatatgtagcacagtggttaattgtcccctcctgctgtgtgggctttagctggaattattatacacatgcatacacacacatgtgcactcttactggcagacatgcatgttcacatatgcattcacacatgttcacatatgaattcacatatgaacacacaccccacacgtgcacatatatgcacatgcttacatgcacacacatcccacacacatatgcatgcatgcatacgcacgcacacacacacatacacaccccttacctttcctcgcttcaaaatttagagctctattcattctacattacttagatttcctttttatcatcctcacttgcaaagctgtctatttttacattcattccaagggcatcatctaatgatacgcagtagggagtcacgggcttttttaaaaagcacagctctaaagtttgtggaataaatgtaaatgtgttcacttgtatggaatttttttcatagtaatatatattttgatactctttattatatataggacagtatatagtatagtacagatacagaaaattgcattaagaaagtgtactgcctagtgaaataatataaccaaaactttcatagctgccatccaagtcaagaattaggacattgtcagcccctcgccgctccccactcccagatgctgttccaggcaccaccctgcactccactttggaagtcgccgccactcttatttcttcataatcaatccctggttttcctttagagtttcatcactcaagtgtgcattctaagcactgtagtttggttccgtccactttagcatgtctcgtaagtctcttttaattgacattgcttttgtctcttttttcttttatgcataatttatttgttgaagataccaggctgtttgacatgctgaggtcccgtggttaggattctactgaaagcatccccatggtgtagtttaacctgttcctctgttcctcatctttcctgtaaactgggagttggactgatatattcaatcagatttaggggggcagtttcttaggtggtgtggtgtttacccaccaggaagcacatggtgatccattgtctccctttttatgatgttagcagtcatgggtcctcagtgcttagaaccaagatcttcctagaagtagtgaaatgatgacactgtaattctaccatatgttccttactagctggaataatttcataaaaaggccatttctttaatgttttatttgattttgtagtgatacagttcatatcggacagttcatatagtacagttatttctcttttgctaccaatttttgaaataatgagtgagtttaacattcaaaggccatcaattccatttttgcagcaacatcatgagcttgtgggtttaacatgttccatgtgttttcactcattgctgttgctgtttgtggcagtctgttcttgcattgatataaaggaatgcctgagactgtaatttattaaaaaaaaaaaagagagagagaagtttatttggctcatggttctgcaggctatacaggaagcatggtgctggcatctgcttctagtgagggccgcagggagattcaatcatggtggaaggtgaaaggacagcaggtgtgtcacagggtgagacagaaagagcaaggggaggggaggtgccaggatcttttatatttttgtttgagacagagcctctgttgcccaggctggagtacagtggcatgatcacggctcagtgcagccttcaactcctgggctcagatgattcttccaccttggccacccaaataactgggactacaggcatgtgccaccattcccagctaattatattttttgtagagatggcggtctcactatattgcccaggctggacatgaactcctgagctccagtgatccttctgccttggcatctcacagggctaggattacaggcatgagccactgtgcccagccaccaggttcttttaaacaaacggatcttttgtgaactaatggagtgagaacttgctcatcatcaccaaggggatggcaccaagacattcatgagctatctttccccatgaaccaaacacctccttccaggcctgacctccaacattgggaattacctttcaacaggagatttggaggggacaaatatccaaactgtagcattattcttgatctgattttctcaactttgcacaatgggatcctctttccgttggctctagagagtctcttcttcactctgtaaatctttgataacatagttatatggcatgacaggaggctccaggctcatcctatatctattatatatcatagatagatagatagatagatagatctcctgtatctttccactcagatctaggatcagccatttctcagtaaagtcccattttgtttatttgtctttgtttgttcattttagttggggaacagatttcaagatcacagtatggaggctggcattgcccatatctgtttgtctcttgtgaattctaggccttttcaggggacagagctaaacaatatatgtttccatatctaaagctgtaacaaaaaaaaatctcccaggttcatactgttccttccagtttcacttgggccctacaagtttttcaacttgatatttcctgttttatactagtttgggtggttttccatgctagcaatcctggttctcaagaccacagagcttgatagaatcctagataaagcagcttcatataattattcatttgctgcattccaccaccacacacatagctgtctcagaataacaataccaatactacttccactgaaaatagtaagaaatcaaaacaaaacaaaacgtgtgcagatgtttccccaccagctttccttttgcaggtagtcttcctctatttcccttgtcagggcacacagtgattccacaccaaactttccttactatggcactgaattagacttatctacaaataacttcatgtttagagcacactattagttcttatgtccacagctctctggtcatttttgttgtctaagctcattctatgatagattctcaagaaggactcttgaaagcaatactgcctgagttctcacaggtgacggcaaccttgattctcaaaagtcagttgcgctgggtataaaatccctggcaacattttctttttttttgaattagaaatgctggcattgaaaattttatgacaatttaattttcttttttaagtgacatcataattttgattttattcttaaaatattttatccttcttttgaaaataagtacttttattgaccatttctcattgttagttgtttgggggcaaattacttaggtatgtgatataccctattaatacagagatcagtttttttttatctcaggaaagtttttattgaatgttagtgtttatgcttttcccttgcttggattttcttctttagatacttagattttaggtttacgggatctgcattgccttatcttctaaatttgtcacttctctaaaatctttttcacacttattcatttctttttagttttcaaaatgtcctccttttcaacttctgtaactattaaaagattctgttgtgtttattcactcttgtttttcttttagtttacttttcattactgaaagaaaagtcttttatttataattctttcctgaattatatcatctcatttctgactttttctaattctgagttatatttttctttttcatcttgcactttttaaaaaaaaaaaaagagcaacattttcttctgatcgatgcatatgtttttctggtgtgctctccctctctgtaggtatgtttttctgcttctagcttattttatgtgattatgtgtatgggtttatatctcagttgcttctgtcgtttatctcacatggagttggtttttctagaattggataaggaggcatgtttccaagctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccctttgctcaacatttatccttcttgtcaccttgtgaagaaagtaccttgcttcgccttcaccttacaccatgattctaagtttcctggggcctccccagccatgcggaactgtgagccaattaaacctctttccttcataaattacccagtctagggcagttctttatggcagtgtgaaaacagactaatacaacctccctcttctattttttcatgttatgcttaaagacatggtggcctatttctgagatttcttatctcttgttttacaatatgcttttacctgtctttgtgtcctctccccagtttagattcccagtgcaaaggtttgtcctggtgggaagttctgtctggtgagtttgggagtctgtagggcccagtatccttttcccttctgaacttgcttgggccccttgactccccagctcttggagcaaagtctctcccagcttcagcttctgttctcacttggccagtgctccagccttaccagtaaacacctgctggttctgctgagacactgaggcctggcaggtgccactgctctctgcttgctcctgacaggagatgtttccacacaggtatgctgacttcgggtagtttgctccctcctcccatgtgtatttcccatttgtgttttgaggttcctgggggatgccttgtcatcagttttgttgtaggtttttgtcatgagctttcagttttatttttgtctctatttttatgggacaattatgagagtgaataaccatgccattgccatttggggatggtatagactgggaagagagaggagacaggaaaagacctgggagctctaaggtttagagttgagaggagatgttgcagtgtgagaacagcagcattgcaggtgccaggagggtttgccagagggtgtggggattgtgggaaatgctccgtgaatgtaggagactgagatgtcccttggatttggaaataggaggtccttgattatcttaagcaattttattggggactgaagccaggtagaacagaaagcagagaggaagaaatggtgaagaagggaatacaggacacatgggcgacccagtagtcccacggttaaacatagaaagtgacccttctggtcttcaagcttgaaccttacattcactgtatctgagcttcttcctcaggaaagaccttcaggccctcaaaaaacatatcaaagaactgaaactccccagatcattgtatccagaaaatgagatgcgggacccctcattcatcatgattgcttccttgcccctcctgggttcctgttttcttacacactgattcatttcttccctgctacataaacccctaatattagttggtcaggaagatggacttgagactgatctcccatctccttggctgcagcacccaattaaagccttcttccctggcaatactcatcatctcagtgattggctttctgtgtggtgagcagcaggacctggacgcagcccctcgtgttttggtaacactggctttcaaggagctggcatggaagggaggcgagtgccctcgtccctgtggtccttttctcccaggcatgttccacactgtcgtccagttgcctggggccttccatgcaaggtaccttccataccagaaggactgaggcaaacccagagggagattaggagttaagagaagccttgtaaaggaacagagatcaattctgtccttcaatgtcctgcccaggcttgtttggatccgggatcagcaccaagactgagactggccagcagccagcagtgggattgacgttgcccagtcgggttttgctacgctgggagaatgcagggagccaacctgcttctctctttttgggagttagagtgtgaaatgcacagagccagtctccacaggtttgcaggccaggaaaagcaagctgatggaaggcacagggatgaccagttgagacaccagcctggcagttgtggtattctttgctcagactgtcctcaaaatcagttccatttctttctgttccaagcaaaccaaagtaagcattataacaatagtcaggaaagaagatggatgtaattgccaaagtcatgttttgtgcagttttactcctgggatgtatttataaggacccttctccaaaagatagaacaattttattcaggtgacaaggttcaacttttaaagccctccactacatatatggacatttgaaaatggaaattaagcacttcccatatgctgtctgattaacggagaatgactgatcactttcacatgaaacggtgagtgcaaacggggaacgtttcacaacgagccacttctctcaatcggagagtcgtttcaatgctatttttgtagaaatgcacattgtgccgagagaacaagaccaaatattctcttcggaggccgccctctggtttttccttttaggtggcaagtgggtccttcaagtagtgggggtacccatgtcaccgcgagtaagtccttcgtgtcgtggggtcctgtgttgcaaggtgtgctctcaggtcactctcctattgtactgacattttcccaaatgctttgatgatgtgcttgagcttcaagcaatgctggcagtggggtcgagcccacaggctggctaatctgcccgctcattccacaccatctgctttctctgcgtctggaccttggccggctctcagagctcctgtcttctgtgccccttcctgctgggccaacatgtagcatcttcatgttgtacttggccaaggacagcgctgtgatgtggaattcagaaacaaaattcgggtactgcgaggtcagcagacttcttgcctggcacagccgacgtttcaaagtagctgttgtttgaaggctccaagagttatgaaataatcatcagtgtaattccactttcaaaaaaaaaactgcttcattagcactgggactgtgttacctttgtttgacaatggtgaggtgagttgtcaaaatgagactcgtcctttaatttaatccatttcaaggagcaaagaataggctcgtagttgggatgattgtacttctgacgttcctgtttctaaacctcaggatttagatcttaatcttgaaagccctgcagactttagccagggcatctgccctccgttaaaatacaatgcggagtttctaaaataattgtgtagctatgaccatttttttcccataaagcattttccacgtgaagaacatcctttgaagtgagaagccgtgaagatggctggggcaaaggtgagcgtgtgtgacagaagcttacattccaggcagagggtgggttgcagggctcaggaaagagtctattgatattcagcgctttgacccgctcacaataactgttggccctggggtcaccgcagagacacatccctgcattatgtggcaatggaggcaggcagacctgatgggttttcatttgctttgctgggggaccagcaggacgtgggccatgtggtcaccagttactcttggggtgggaacagggtgcgaggccgatggttcagggagctctgggtgaaggaattcctgcccattccacatcccaaagagcaaaccatcctaaaataattcgcccagagatttacagcaggatgggtatttttcgaaatctcatccagaaaagaaaggagaaaattaatagcatatcctgaagctggaattttaaagggcacagacagaggaagggaacaccctgctgttgctctttctttgtgttaaaaaaaaaattgcctctcctgactttgaaagtagctactgctttttttaaaggaaaaaaaaaaatcaaagctctaccaaccatttctttttgacaatggagagcgcgttttcccctggtactcaactcattttgaatacagttctaccagtcttgtagaatacacaccatgtatggactatttttattatggaaaagctaagcagactcccaccagggagagtgggtgtgtgtgtgctgggggaggggtgggggaagaaggccatacacttgtttattccaggaaggaaggcgtcctcccttggaggccctgagcctgcaatcccacgagctttgtcgtcctcacgacctcagtgggagcccctgtctgaaacagcacccaagactgcctatgcagggtggcccttactgtttaagtccctcccacaggcaaaaagcaaatcccaggaaggaccacgaagcctcacccagctcctcccactaagcagacaaaggccaaaacctgctgttgtcggagcacccattccttttctcctgcctgtctggtccattactgtagccaccactcaggtcttgtctcaatcatgtacaaagggtgactgtttaaagaaaaagaggtccttctgtctactcctgatcaactaccctctacctgtgtgtctctatacaaagaatgcatttttgttattctttatgtattattgaatacgtatttatattttttattatggcaaatcagatcactgtgtgatggagggcgtgttgagctttgaaggaagaagctgagagtcgtggccattgtgtaaggtgggcactcacagatgcaggggtgccatccagacaaaagattctcattgaggacatggtcccttctgaaaggggcacccccttctccctttctgcgtggagcttagaccacccgcaacccagctggccctcgcgcgttatcctggtggtgagctgtttggctttctctcaagggcagagactagatacacacttacacttgtacatgtgagattacaggtatcttcccaaggcatgtatgacgccagctcacgctgcctccggacattcgtaggaactgacttgggcgcttgcccagccatttccccgctctttccctggctcttatctcagcgctcctgccatctggtccacccactaatcatatatatttgatcccccaaagagtgggaatcccgtgggcagatgggacacacttccatgaacaacatgtagtcatgatccaagtttaccaagtgaaaggaagaaagactatcccagcctcgaggaagaccagaggatgtttcacagctgccaaggccttcagttcagccaggctctggcacagtcagctcacagaggaatctgttgaatggatcagcgtgacagtggaggtggggagagcctcctgtccttcctcctcaacatgcacacatgcacacataggcacacacgtgcaatctcatacacacactcgctcatacacacacacctctctcatacacatgtacacagatgtattcacatacacactcacatgtagactcacaaacatgcacacacacattctcacaaactcctgcacacacacgcatacactcactcgtatacacgcacatgcacacactcacaaactcatgtacacacacaactcatgcatacacaaactcatgcacacacatgcacactcacaaactcgtgcacacactcacaaactcatacacacactcacaaactcatgcacacatgtgcacacacaaactcctgcacacacaaactcatacacacgcacacactcaaactcatgcacacacgcacactcacaaactcatacacactcacaaactcatgcacacactcacaaactcatgcacacacatgcacacactcacaaactcatgcacacacgcacactcacaaactcatgcacacacacgcacacaaactcatgcacacacatgtacacacaaacccatgcacacatgcatgcactcaaactcatgcacacacatgcacacactcacaaactcatacacacacgcacacacaaaactcatgcacacacccacaaactcatacatatgcaaacagatgcacacatgtgtatacatactgacccacctacacaaacatgtacatgccactctcccatacaaacgtgcgcacagatgctctcctgttaaccaccttccctgccgaatacgtttcacgtctctaattttaggggtcttgtccccatcacatgctcttctggagagggaaactactcagggagaaggttacagtcacagtggcatttgacaggcacgttatttgctttggccatgacttgatttgaggtctccatcactgaccctccagttgggttgcttctgcctggaggctggaccacccgacgtcgggagggagctcctagctgtcctctcctatgagtttacactgatttttaaatagaaaaatggaagcagagccgacttttctgaagagcagcctaataaattattaaataaaagagagtccttcaactcaccacccccatttccttatcatcagatgtttttttgttttttcaaatttcaaaaaagaagattaaggttttgtttctcttcttcctcatgctagggttttttttaaacaccatttagagctaggacggccactgcctctgaggagcagcccttgagtggagggtggccgccaccgtcttggctgcctttgtgtccctggcctctccccagaatttcttctgcgtgttctttttaattttccttgttgaaaggaatgagtgatccttgtgctcagatggcgttactgacacccccagctgagaatgagtaattattcccactccgctgtggctttgataaggttctgagggctgcctttggcgcagttgcccagcctttgttccgcagaagttattttcctccttaggaaatgaaaaaagatggaagatgacaacgccatcaagggaatggggaaacaccaacaagttattaacctctaaaaaaccattaattcccctgccaaaggaggcagacgccaggatgacgcggggcgcatggcaagctttgcggcgggttttcaggagcaagggagaacaaagtgtcaaacacgcggaagttatttgcataactcaacttgcagggagctcggttaccgaggtggtagagagcagtggcgccactcggtggctgattttcgggggcttctggcttctctgtggctgcggagactgcatttccccactggaaggcctggggttgggcgtaccaagggggcttctagatcagggaaggacctggttctcctgctggtggggcaagaggttggatcttgcagggtggtttgcagagcaggtgctatgggctgaatttgtctctcccgagattaataccttagtctcaatactcagtaattcagagtgtgactgtacttgaatatagggctttaaaacaggtgattaacttaaaatgaggcctttagggtgagccctaatcggatttgagtgatgtctttacaagaggagattaggacagacatgtgcaggggaacaaccacgtgaggatacagggaggaggcagcatctgcaagccaagtagagaggtctctgcaggaaccagccctgctgacactttgagcttggacttccagcctccagaactgagggagagtacatttctgtttaagccacatggtctatggtactttgggatggccacccaagttccctaatacagcagatgacgagaataatttagatttaaatgtcccttccactttaaataatataaaggtctttcatctccaaaaccctcctttgaactcttcaacgttggctgtaaaataattgcctataagcaccatatgacaacgcctaaaattccagggaaggaaacttacaggcaaatcaattggtggccagaggacaatggctggaagcttctgttcttagcactttaccgttttccttgttgattatgagaaagaaaacatgaagataaaccatggtcagtgaaaatggtccatcatttatgtcttggtggcaaatttgggtttataatatgcaaacctaactcccttccttgggtcactccaactcttgcgtgtggatgctgaaaatgttttccacgtaattttcccctgcattctagctgcatgaagacccacttgttctttccctctgatttctgattctgccacaggcactgttagaattagagcactgataaggaaaaaaactgggccaggatttaaattaatgcttttagacaaatatccgttccatctccaattctaatgctaattacatttgtggatcaaagaccattcgttaaagttttgcttttgaaaaacagggagagattttactttcttgtttgatatttttatgggacttgatgggaatggtggggggtgggcggtggggggagacaagaatctagggaagctggcctcatgcagagacggtttgtgggtgtgtgtgtgttgggtgggggggggggttgggcgagtttcccagggttcccaaagcactctttggaggctcagagtctgaagctgcgaggttgtgccttcacctctctttctcctgctgtggtggctgtcttggttacacgagaggacagtcaataaggggtaaaaaaaaaaatgggaagaactgattcaggaaaagccatggatatggcttacatgcatatgactaaaggaaaaaagtgagtctgaaagaatacatgcggaatgactccagctagatgacattctggaaaaggcaaaacttaaggacnntaaaaagatcagagggtgccaggggtgagggggagggagggagggatggtcagagcacggaggatttttagggcagtggaactcttctgtatgatgctctaatggtgggtacgtgtcattataaatttgtcaaaactcatagaatgtacagcaccgagagtaaaccctcacgtgaactatggactttgggcgataatgacgtgtcactgcaggttcatcaagtgtaactaatggaccctctggtgggcgatgctgatggcgggggaggctgtgcctgtgtggggcaggggggaggataagaaaactctgttctgctcaatttcgctgtgaactgctctttaaaagtctatttaaaagaggggaaaaaattgatagaatttttaaaacctaagcaaagttactttttggtctgggacccgcatcatggctacatagaacccaagtcgttcggggagcagaggaggaaatcaaaagcaaatatgacacggagttgaccccaagaatccacagagcatggagggattagctgggcagagagatgggtttgccagcaggaggtagcagaataagaaagggacggagggagggatggaaaatgcagtccagggacagaatcacaaaaaagccagtttctgaaacgaagatgtaatagcattaaaagccaggaagaagcttaaacggggaaacaggcagcctgcagttagagacaggtttccaggaacaaataggacatgcacacgcttaaaggccttccctcctctccagcccagccacccggcatgagtttatgtagtcacacctgtaggcgtgcgcctctaggtgtggggtgccacaggggacaaatgcaacttgtgtttgtgtgcttggggtttgtttagatctttcttccccaattcccttctcctggcctcaacaccagccataaacttacttctgactcattcattcatttatggaatgaatattcaaagagcttgcctcctaaacaaagacattgaataagtaaacaaactcccagataaagttgttcccagtagtacaccagggcgagagggcgggatgtgggttgttcagagggggtattcctggcaggcttcctagaggaggccacgttggaactgaggcctggatggcaagagttggaaaccacgtggagagctgggcagagtattctagacaaaggtggggacaagagtgaaagccccgaggctggaacgttctagaaacacaccggaagcccagcatccgagcctcagcgtagagagcatgaaggtcttggggtggtcgggggtggggtggggggtggtgctccagcttctgtcggctcctgtcctgagttcaggaaacccctgtcttgagccaatgcgatggctggtcacctctaccacccacaaagatcagatcctacaggagcctgggctccggtaaggggggctgtgtttgacattaaccagggaaccatggggcacatgcatgagctgtgatccgtgttgtagattctggctacaggcagcatcattcccagggcggcctgatgctccgagctagatgtagcatgaaacccatgcacactctacccatagaatccccctcctgtgtccctgccgtgggccagcccctgcctgcatctccactccagtcctcaattcctgatggtgttctcccttctctctgaattccagtgaaagcctcagctctcctggcccacccagtgctgatcacgtccaggagacagactctgtggttcttgcctgagccacgcatcctggtggcctttggaaaatgccaggcggtccctgagttgactgaaagcttccacgagtggttatggagataagaggctgcctccagtgcctttctaagaatggtgcttggagcactggccctcacggctccttgcaaaagtaaacacctcaatccgccaccaccaaatctatggtctttctggtatctgcacccatctcacttcttcctgcattgatggagagaatgctccttcctgcagtcgacagccaggtcctcctcctattttctggaaacctctgccctccaccactcaacggctgtgcttctgttgacccttcattttccggaaaaatcaatctctcctccagtgggtcatttcttcaacacgctgacttgcctcatctactctactgagtcatagaccttcttctgtcttgcacaccacctgtcacccctgcctgtgccaggcttttctccacagcacagcccgtgcaagctcagcctcacctcctcacacccacaccctccgtccgctcctccagcctcttcgtctggctccgccgccacccatcacgtccagctctctgtaggacgctggttacttccaatccaatgatcacttttttcttctgcttttcgttagtttttaaaattgatacctaatattcatacatatttatctgaccatgtgatactcggttacatacatagaaggtgtaataatcaagccagggtacttggggcgtccatcggcccagtgtttaccattcctatgtgttgggaacatctgaagccctttcttgtagttattttgaaatatcccacacactggctattcctcaaggatctagaaccagaaataccatttgacccagccatcccattactgggtatacacccaaaggattataaatcatgctactataaaggcacatgcacacgtatgtttattgtggcactattcacaatagcaaagacttggagccaacccaaatgcccatcaatgatagactggattaagaaaatgtggcacatatacaccatggaatactatgcagccataaaaaaggacgagttcatgtcctttgtagggacatggatgaagctggaaaccatcattctcagcaaactatcacagggacaaaaaaccaaacgttctcactcataggtgggaattgaacaatgagaacacttggacacagggtgtggaacgtcacacaccagggactgtcgtggggcggggggaggggggagggatagcattaggagatatacctaatgcaaatgaccagttaatgggtgcagcacaccaacatggcacatgtatacaaatgtaacaaacctgcacgttgtgcacatgtaccctagaacttaaagtacaaaaaaaaaaaaaaaagaaatatgccacgcattgttgttaactctagttgccttcctctgccctcaaacgcgagaacttcttccttctaactgcatgtttcagtcgcttgtgggtcatcaaagctcagtgacattgcaggcgaccgtctcgcctcctactccttgaagctctcgtctgcttcagtctccaggcccccaatttcctggtcttccctcccctgcccagcggctcccacgccaggtaccttgctgggcctccctttccttccagtctctgtgcagaatttcttccaggtgattcctggctcttcctctcctctcactccgacaccttcctggagatgagatcattcattcccatggctttgtatgctctttttatgttaaacaggcccacatgtatatctccaacccaaacctgagctccagactcgtgtaacttactgtgtgcctgtacccctactcagaaaatgaatttttgggctgaattttgaatttggaactgtcttcctgaaatcaacctctgtagggtggcacacacctcaaccatccacgtctgtaaacaccactgccaccacctggtctaagccccaccttatcctgcctggcccctgcaattacagcctcctaaatggtttccctacttccactctcagccttgtttcccaatctgttctccaaacagttgctgaaaaccctttgttgggacttttcttctgaggaaaatacggtcccgggggctgtagagccgtggtccgcctgctctcactcctgactcaccgctgttggctttcgccaatgaacaagtcggtcaggaagccgcgctggaccatggcttttaaagacaccggaaaacacccacagggccagaggtcgcaattcaccaagttcaagtctccctaatgagccgcaacatgcaatccttggagaaggtgtgtactgacttgaccagagccgcaaaggaaggtcatctccaagtgaaaggactggcccagctgcctcccgagcctttgagaagcactacaggaaaaactccttgtggcgaaggctcttgacatgggcttccttccagaggagaatccacccgcaacctacacacctgcacagccctcctgagactgccaagtggattattctcatcagtgtgagccaggagttggggttgaagtcaccattgcagatggtgacatcaactaccttaattcattgattagcagtttaaaaacatcccttattgggctgagcgcagtggctcacacacgtaatcccagcactttgggaagctgaggcgggtggatcacttgaagtcaggagtttaagaccagcctggccaacatggtgaaaccccgtctctaccaaaaatacaaaaaattagctaggtgtggtggcgggtacctataatcccagctcctcaggagtctgaggcaggagaattgcttgaatctgggaggcagatgttgcagtgagctgagatcgcaccactgcactccagcctgggcgacagaacaaaactccatctcaaaacaaaaaacaaaaacaccccttattggattctcatgggtctgagaatgaactccccgcccctcccctgcctgtgggctcctccaggcctggccctgccacatggccaacctcatctcctgtcacgctccctgcaccccactaggctccaggcggcctgagtattccacacatgcatgcccttcctgggcagggccatcacgcctgctcttccctctttctggaatgttcttttggcatctctcctcacagtcgcattcactctcacttcttcaggcagcccttcatgatcactctgtaaaaagcaggtcaccccgccactccctgtcacagcacccgggccattgcctgtgtgacgcataccagaatgttctcctggattccttatgaaagtgttcacatgctcgttgtctatcactggggagctctagtggggtttttcctgttcttttattgcacccctagcacgcagctcatggctgtgttcatgaacaagtgtaagttgtaaataaatttcctctctgtccacctctctccacacacccgtgctgcatctcatgcttatacagcattttgtgtctacaagtcattcaacaataatcatgcaacaaatatttattgaggtctcatgtcaggtgctgctgaggattacagattaaaagatgaaacaagtcttcactctgcctccatgtggctcatgatccagctgggaaaatagacacatatgcagataaataggatattatgtggtcactcggcaattgatacatatgcctatctattgattgattgattgatagattgatagatatgtgtgcacgaagagtgactgccccagcctggggtggagggtttggtgatttgagtgagggaggataaagaagagggagggggtcaaggctccagggttgtagcccaggtgtgtggggcagacagaggggccagcctcgaagatctggggtcgtagcccaggtgcatggggcagacagaggggccagccttgaagatgcccctgtgggaggaaaaggggctcagagtcagacttgctgagcggcagtgcctgcaggacatccaggtggcagcccggcagacacttggataaatgagcccaaagctcgggggaagtcttgggtggggctgtggaatgagatccgggagccaaggatggaaccccgggggacaaaacctcttcagagcgttcttttaactgaagaatatattaagtcagggagaaaaatgtcattcagatgattcaacaacttccctgtggtttcatgtatcaacttgtcatcagtaaaggaagagaatacgaaatgcaaccccgtagcctctacagtgctcctgaaattggaaggggagccagcggggaccaccttcctacatgagttgcctggttttgctttttggttctgtcatattcctttgctgggattggagtcctacattaaggagctttatttagcccccttattatctccagcctccccactccacgagagcaatgagctttcttcccgtgcaaacacaacctcaagataggtctcctacgccctcttccttccagatgctctcctacaaggacctcccactgataaatttggtagcagccgaggttcaccaccaggctcaaatcaacagcaggggagcagtgcaggggaagaacacgggttttggaagtagacaaggctggaattagaattttgtttgcatcactcgctagctcagtttccgcatttgtaaagtggaaataagcacatgtgtgtcatagtctcgtaatgagtctcataaatttgagtctctgattagattagatcatgcttagtctcacaccaattccttctgcccctatgtgtgcacttgctatctctaccacctcacttcttttttatttactaaaagtgggattaggagcacgatgcacagcactacacaaagctctgtgaacgcacacattgatctgagatattggtcgacacacacatgtgaagctcccacatgaaatatcaaaaataacccccttaactgttaatcagaaaacacaagcaggtcttaattagagggtgatgatttgctttatggactcaaaagtctcagagagggtagatggcatttatgtcttattgtagatttctagacccttagataaaatctgcaagaagcaaggtggaggcacatctttgcattttcatagctcaaaacaattgagcttaaatacagtccatttttccacttagcacctttatgcaactccatgaattctggcaaattctccagacaagatgatcataacagagaagaaaccacatttgtccttttttagcatgtgtgctggcagaaccagacatgttggagaaacacagtccaagggggtgagcattgttagggagagaggggatcaaagggctgagatggcccatgcatgccttggatgacagagaaagctgttttatgattggaagttaaaaagccccataagattccaggtgcctggaaacaggagatgacagaatcctgcgggagggaggccattgctgctggcgtctgtgcctccacagatgctttaaagaggtaggagataagaccagagttgtatctggagcacataacttcccatttaactctacttcaggactggagtagctgagtggggtcatgtgtcatccgaattaaaggttattgagctggagccagtggagggagtgccaaaggagaatatgacccatgctccccccagcccttctccaagcaggtcttcaaggtttgcagagtgaagagaagagctgcttcacctgggaggatgtgggagctggacaactccactcatcaagattaatagaacctccttatccccaatacagtatcttacagaagatagcaatctatttccctctcacgtgaaagcaacctgcaggtgggcagctcaggttaatatggcatgtggagagtttcagggatccgtggactttgtggctttcatgtttgctatttctagggtgtggagcttgacttcctagtccaagaaggctgcaggacctccagccctctcttctgcattccatgtattccaagcacgaggaagaggcaaggaagaggaggtcaggagccagcaaagctgccttctaagacagcttcatgaaagcagcctcatgttttccacttttatctcaatgaccggaacatagtcacacagatacaccaagctccagtgagaatggggagtggactgttctcttctagacagccaggcactgtcaaggaactgtctccaagctgctgaccaacaacagtgagagatctattgatgaaactccttaggcagctctaggagtctttgacaactcagagtcctcagtttccatatacacacatggagttatacatagcaaatcttatatttgttgttgatgtatgttaatgaaagaaaaagacttaaaatattgccacacaattactaaatagtatttgggaggaagcttctctttgtggagttattccactgaatggatgaggaaacaagagaacggagcattaacatttggcaagccttcttaaaataatggatccaggcattgaacacaggtctgttaacataacaaaatgaaagacaatcaagcatcgtatgcctccttgtaagacaacacctcacgtagatagatttcctgtttaaaaaaatcgagtttcatgaaccccactgctccagcttccaatccacaaaaaaacacagaagacagagaaaaatattacacaacgccccacaaggacatgattagcaaaatcgaaactaggaaacaggacaaaagaaactggtttcttccacaaatgttgaaaaaaaaaaatggctgggaactccagagatgaaaacaaaagatagtacagccagtcagcaggtgtggagctgttcagcgcctggttcaaaccgacaagtagaacctaaaatcaaagagacttggtttgaccccatatgacttttagaagacaaccggaaatttgaatactgagtggatttttgttgatattaaggaattactattttaggataatggcatcatggttatattaaagaaagtgtccttatctgttagagaaacatactgaaatatttatgaataaaatatgatttctaggatttgcttcaagataatagaggagtgggaaagtggatagaggtatagatgaagtcagattggctgtgaactgacagtcttaaagctaagtgactcactattctctctcgctctctctgaagctgggagttcattatactactatattcacttgtgtaagttaaaatattccataataggctgggtgcagcggctcacgtctgtaatctcagcactttgggaagccaacatggaaggattgcttgaggtcaggggtttgagaccagtctgggcaacacaatgaggccttgtctctacaaaaaatttaaaaattagctgggcctggtagtgcacctgtagtcccacctactctggagggtgaggtgggaggatcacctgatccttggtggtggaggctacagtgagtcttaattgtgccactgcattctagtcagggtgactgagcaaggccctatctcaaataaaataaaataaataaaataaaatattccacaataaataaaaatataacaaagtagaatgatttataatcctttgggcatatacccagtaatgggattgctaggtaaaatggtatttctggttctagatccttgaggaatcgccaaactgtcttccacaatggttgaactaatttacactcccaccagtagtgtaaaagtgttcctatttctccacagcctcaccagcatctgttgtttcctgactttttaataatctccattctaaccagcacgagatggtatctcattgtggtatgcacacgtatgtttattggagcactatttacaatagcaaagacttggaaccaacccaaatgcccatcaatgatagactggagaaagaaaatatggtacatatacaccatggaatactatgcagccgtaaaaaagaatgagttaatgtcctttgcagggatatggatgaagctggaagccatcattctcagcaaactatcacaaggacagaaaaccaaacaccgcatgttctcactcataagtaagagttgaacaatgagaacacatggacacagagagggaacgtcacacactggggcctgtcggcgggtggggggcaaggggagggagagcattaggacaaatactaaatacaggcagggcttgaaacctagatgacaggttgatgggtgcagcaaatcatcatggcacatgtatacctatgtaacaaacatgcgcattctgcacatgtatcccagaacttaaagtaaaatgaaaaaataaactcaagaattaaaaaaaaaaaaaaaaaacaaagtgcgagacaaaaactatgagttcttccaaacgagaagctctaagccaactttctcaggtattaggtaaggctctagccaaatctgtagccaccctaggtagcccctgatggactaccccgggccgccgctgtggacttgagaggtcaagctgaagacttgtggttattgccgctattcaaggagagaagagcctgggtccagccaggttcattggcaagtgtttcttccacattcacaggaaaaactgggcaagataagatgttccaaatacaagccctgagaagtgatcgagctatagaaataatctcagaaaaatgatctcactcatactgggagagtggcagggaaggaggcaggggccacatacaaaagagactatagtttcttctaacaggcagtcaacagataatgtctaaaactaatactatatcatgatgtaatgctgaaaacacctttttaaaatggaaatggaccagagagagctgcaacaatccagcatgctttctcctgggaaagcaaacatggagtcgtggggccgtatgagagaggaaaagggatgcttcttaaattataagcactggatactcttaattatgtgtgtatttcacacatatttaaactttaagatgaaggttaaaaaaaaaaaaaacaagcaatagcaataacaacaaaaaccagaatgtggcccaacctgtaatcaggggaaaattcctggactgaacatcctcttattattaataaagtggctaaaaacaaatgaattaaatatttaactgaagaagctaagaaaaaataagaaattaatgaataaaataggtgaaatggaaaacaaattagttgtatagaaaaaaattaaggaataaaaaacagaattgataaagtaaagaaccatagctttgaatagattaagatagataaatctcttggcaaacttgagcgagagcaagagtgagaacaagagagagagaaaaactaaattgttcatgatagaaataagacaaaatacttagtgatatggcagagatttataaaacttagagaatgccatgtataccctcataccaagaggtatgaaggtatgaatgaatccttatctggatgaaaggaataattaccagagttaaataaagaagtagaaaatctggataataattatttaaaaatgagaaggatgtcaaaaatttaccatccgaccctctaggaacagataaatcgtctatgatttaaactatcctgaagcctagaaaaaaacacagaaaattttctagtatattctacaagactgataaaattctgacaccaaaatctaattaacagtattatatgtatatttaaaacatacaactataaacccaaactaatatttttagaaatgtatctaacaaatggagaaaaaacccttccctcataaatgaacttgtttaccattaagggtttgttttttcaactgttgaacttcccagaacctttaatatattaagatacagctttaaaatttttgtgtgcgtaagaatccctggtaaagcttgttaaaatgcaggtttccaaacccaaatcacagatttttattgaataaagcctgaatatctgaatttaacagatacctaggtaatttggattcaggtggtaaaaacactgcactaacgagcattgtaaatctccaagaggggcattcattacacagatgcttcccagagtggtttaatagaattgcctttgtcagagctccaattaaacttccagaattacggttcttgacaaacaggttaagaaatacagattgagtttaatcacttttgcaaataagaataataaaactcaaaatttactatcaacaaattgaatccatcggtgtattaaagaataatataccatgactaaactatttttcttccaataataaaaggatgaaataacatcggaaaacttttaaaaatcaattagtatgtgcattagttatctaccattgcataacaaatcacctcaaaccttagcagcttaacacaatagatatgtatttaatcacagtttccgttatgtacccagagcaacttaggtggctgtagcttagagtgcctttcaagaagttgcagtcaagaagttgatggggctgcagtcatctgaaggcttaaatggggcagaagactggcttccaagatggcagccttggaaggcacccatggctgttggctggaggcctcagttcctggccatgtggaccttttaggactctttgagcatcctcacaacatggcagctgattctcccatagcaagtaattcgagatattttatggcctagctctggaattcacactctgttattccacatcgtctattgattacacaggtcagccctatacgatgagggaggggacttcatggtgtgtgaatgccaggatttgagaattattgggcattttattgaaggctaactactacaataggttgaaggataaaaattatgattcaatcattaaatgggaaaaattctgaggaaacttgataattattactgctttcccttggctattgacagaaggaagttctaacggtaaaagatatataacaataactagtaaacattagataaattggtgaaacatgaaaggcagtgctatctgctggtaccagggtttttcaacattgttctgggcttgctagttaattcaatgaggtaaggaagaaagtaatagttaaaaacagtgaaaagaagaaataaaattcttacccatgtatttgatctctctctgaatgaaattataagactatactgaaaaggataaaagaaaactcaatagcgtgaagtcgtaaattaataaatttagggtatatccaatcaatattttaatgaagcatttattaacatgtcatatttattaaaggttacttgaagagaaaaatgcaagagaatagctaaaaatatgttcaaataggaagtattatgaggaagacatattttagcagatatcaaaaacacccaaacaataaatatattgagagatgcccacacaggtcactcaacagcacaagagagagtctgcaatcaggacaataaacttctgtctagacctcttacttttggaagtgattctgtacctaaccccagatttacagctttctatgcctaaggatgtatgggcagagtagtttgtaataacaaaaatcaaaacaaccttggtgttcactgaatgaaattgaaacatggatctattaaaaagaatgtagttgatttggcatattctgccctggaaaaacagtcacagtatattgttaacttttaaagcaagttgcagaaaaatatgcatattatgttgacttttatttaaataaacaaaggaaaaattctgcagggatataaagaaatgtgttagtgtgggaagaaatctttcactttctaccccatataaatttgtccaaaaatgtgtaaaccttgttttatttctctgaactctgaaaattgtttcaaggtaagtttcaggtatgaattttgtttggtcttttatatagaacctggttcccttactgacttgggggctgtattaggctggtctcacactgctcataaagacatactcgagactgggtaatttataaagaaaaaacgtttaatgggctcacagttccacatggctggggaggcctcacaatcatggcagaagacgaatgaggagcaaagtcacatcttacatggcagcaggcaagagagcttgtgcaggggaactcccatagaaccatcagatctgagacttattcactaccacgagaacagtatgggggaaaccacccccatgattcacttatctccacctggtcctgcccttgacacatggggatttttacaattcaaagtgagatttgggtggggacacagccaaaccatatcaggggccctctgtgatttcttccttagttttcttttttgagaacaaggaatcccaaggtgtcccttctcctagcacaggaggtgagagcaaaatcaagacaaagattttgtctcacaaggaaggcccatgcaaatatttgaacagatgtgcttcttgcaagagacctttaatagttcctgatgaaatgtatcagatattggggctcccctccctgggcctcagttccctcttctgttcaatagagcgggcactaaaagacttccaaagtaacttctgtatccatccagctctttttgttgcaagtgaaagaagaaagaaagcacaactcaagttggggtaaggcggcatgggtaggttatcgattaccaatgcacataatcaatcaatcacacactcacatgcacaccttctctctccctgccttcctctctctattacgccctcctctcatggtgaccagatggcttccagaagttcctaacttgctcttagcctcagaggtaggtaggtaaatctttctccccagtcattctaagaaaagttctggactgaacctcactgggacaaactgggtccttgcccatctccataccactcacagtgcataggggacagaatatgctgatcagcttgggcctgggacttgggtctttttctttgctacaggctgggaggatgcactgatttcctgtcttgcagtaccgtgtgtgataataacgtgagtaacagcatcatccaaaacaaaacaaggacttcgtaaaaattaaaaccttttatgcatcatcaaaggtgcttgccaatacagtgaaaagacaactcacaaaatgggagaaaatatttgaaagtcatatgtctgagaaaggattaatatccagaatatataaagagctcttacaattaaacaacagtgacaaacattccacgatccagggacagatccataagggaatatagagaaccacccaactcaaccctactagggatagttctagctccagaatgctctgtggggtgggttgtggctgtcctgggtcccgtgggtgaggctgacttctccctctgcctgctccctggcccacctgtcctctctgcagaggttcaccacagggatcctcacagaagtcaggccacactctaccaccacctcaccgtccgcctccagggacaccactaggcagcactttaagctttcagatgttttaagacttttcagaggccagatggggtcctttgagctttaaaaacaagaacttcttgaatctggctttacggatgggacttcctctggggaacacattcaagaggacatcacagaaatgtccctgcccactttgtgttgctgctgatctcctggcccacgatgcaccctagcctggcctgacagcacacacctttgcaaacagcttcccggcctcaccctgactctacagctgttggcaggctgggcgtgggtgggtcagcttgggaggaagcatgaaggtgactgacagacagaccaatttgtccttcacgccagccatgtgtgggcctgggtgtgggatatcgggagaaccacagcctcttcaagctcagcaagatcaaagggatctcagaatgttttcatcagcagctccttctggtttcaagctcatctcctatggctgtaacccaaagatgaggctcggcccctgttgtcaggggcctgtccccttctcaggatgtggccgttggactagacatggctccatgagtgttctcctggtcacagcaattgatctagggatggttgtgggactagattagaaccagtcagctgccatgaggctttttctgcgatgtctggggaaagggtcctgtcttttctgctgggcgggaggcttcaggctgtcagggccggagctttgggtaacttgagtcttcctggagcccaagagagcatcagcgctgggagcagagctgggaaatggggagatcctcattgcggcagccttcccagagtgctggcccccaagatagctctgatgctgccctgcgtgctcatgcaaacgaatcacttccctcccgccctccataaacttaggtgataaaatggccatggccactggaagaggccctaaggaatgcactcccctcctcgctatttcatgggagctgagctggctgcttctggtaatggggaggtttccacactcggctttgatctgtctggaattgatttcttcctcgtaagcatctgaatttgtcagtaaccccggtcaccacagccttcacagatgaacaccttgccatggcaggaacccttgtgcattctctatcacacacgcctgtcccatcctcaccctcagtagaagttcagacgaggtcagttgatgaactttctccacctttcattctacagacaaggaaatccgctcctaccgggttgccgagcttattggaggtcaggaatagttacgaaataaatgttgcagcatttcaccagcggcctctggctgggtattagcgtcaccggaggcctcaccgcccagagaccctgatttaattggtctggggtggggctcaagcattactattgcatcagtttcctacccagcctgtaacaagtcaccacaaatttagtcacttaaaacaacactgggctgggcccggtggctcaggcctataatcccagcccttggggaggccaaggcgggtggatcacctgaggtcgggagctggagaccagcctggccaacatggtgaaaccccatctctaccaaaaatataaaaacttgctgggtgtggtggcgtatgcctgtgatcccagctactcaagaggctgaggtagaggaatcacttgaacccgggaggtggaggttgcagtgagctgagattgcgctattgcactccaggctgggtgacaagattgaaactccatctcaaaaaaaaaaaaaaaaaaaaccacacacacacacaaacgaaaacaacaacaaaactccacagattcattatctcgcagttctgagggttgtaagcccaaaacaggtcttgctgggctaaactcaaagtttcagcagtctgcattcctttctggaggaaaatctatttctgcagcttgttcagcttctagagacttccataattccttgggttggggcaccttcctctgtctcaagccagcaaaggcgggtgggccctcatatcacatccttctgacatttcttccctaaccaccctccaccttgccttcttttccacttaaagaccccgtgatgacatcgggtccacctggataatcccagatcctcttcccacttcaggtcagccgacctgccgccgttgcctgcgatctaacatagtcttcggttctgtggatcaggacctggatgcctgcggggtcattatttcattattccccgcactacgtgtgtatcttaaagctctcaagtggtgccagcatgcaacagaatagaagctgcatcacagatgaaggttaatgtgtctgtaataaactggttgctttctctttctggtagaattcattaagctgttatggtttgcagaagaattatagatttgggaactatttcaacgataaggtgaggaataaaagccataatgcgaaagaacactttttgtaaaagagaaacaaggaatcagaaatggctgtggaatgctcccttgcctgcccgtttttaaacttggagagtttgggacatgaaggtgccctcacggtcggtcccctaagccaggctcttggattcatggacggagaactgtggcctcaggagatgaggtcattcccccggcttccacacggggccatttgtcccgactcccagtccagtgacaacaggagtgagcctttcccttggcctccactgccaattccagaccagcactcttccgccctcgtgtgaaatttcatactcctttgatgtttgattttatcttggggcggaaagtgtgcctggggctctgccaaagggatgctgagctggagctgtttctgcgtgatgatggcccaggaatcagggaaggtcagaaataccacatccattggagtgggcagtgggcaaggactggagcggacgccagggcacccaagagctcccaggctctggaggcctagaggttaccgaggggataggacaaaagtgctgggagggtgttggtgggacattgagggccaaaaccatcaacagggaggtcctgtgaggttgccccaccctcctgccctgcggcccacagggtttgctccagccccatcctcctctcatcttcctggctgcaaacagccaggaagctgtttgtaaaagtgtatgctgtcaggccaggctagggtgcatcttgggccaggagatcagcagcaacacaaagtgggcagggacatttctgtgatgtcctcttgaatgtgttccccagagagaagtccctcctctcctcacccctgccattgaccagcctcttgtccacccctccctatccatgcgtaactcagggagctggctcaatcttcttctctgtactgggttaaatagtgtgcccccaaactatgtccccctgtaacctcagaatgtgatcttatttggaaacaatctttgcaaacatgttaaagcaagctgaactcatgctggattagggtctgtcctaaatccaaatgactggcgtctttatacgaggcaaggacacacagagacacacagaggagaagtccacgtggcaacggaggcagagcctggagtgatgcctgtgcgagccacagaacctcgaggattgccagggaccccagaagccaggcccactgggaggagccaaccctgccacactggtttcagacttccagcttccagaatgctgtgagaacaaattcctgttgttctaagccacccagtttgtggtgttttgttatagcagccccagggcactgctgaagcctccatcccatgtcctgccatagtcccaggaggtttaaacatccatacagactccctgccaacagccacagctcagaacttgaccctctttcactccactggttgacatcttacctcactccagtcacccacacctgggacacatgctgggtcttggcaccacctggaataattccacctgggaaacttgtcagcccaactccttcccctgtcttttggggctttcataatgttattctgggtataaattatctccaacctcaaggtgaaagattagaatgatggcccaaattctctcctatgtcattggttccgaaacagagcttttaaatacatcttaacatttctgatatcaggatgtgcctggcaacagatcacatccagcagcaatagtgacatattggccttccctaagacgttgacagagataaagtatgcagcagcttcaacaatgcagaagggccatcgagacaatggtgggggactcttccagagaaggcagccttccctgtcgctcatgagcacatgtagttcccaggtagattgaaaacctgaacatgggtgattctagtctcaaagtatttcagaggagtcaaactctgaatgtgaagacgtttgcaaaatctgaaccaattaattttgtgcctttcttttctgcatgcatggagagatgcagggtatgaatctctatgtctaagtgtggaagggcacctttaatatgcatgtaatatgcataaagggcaaactctaagtgacacaacagtaacccaccataatgtaagtcttaacataatttctttcttagaaggatacaaaataatgaccgaatttacaagtgatgtcttggatgaagtgaaatatggtattctcccagcagcatccctgaacccttgcatagcttctgccagccaaacctgcccacaaaacgccaaactctggatgcgcggatgctgcgggaggaggcttcctagcttcttcgtgtgcacccatccctgtctggtctcatccaccccatacccttccttggggtctccaggggctggcagctccccacacacactccatggttactttgttttgcaactgtcatttggtctgcctagaatgaattctcattttctcacctcctgctctgacccgcttcacaatgagaggggagatggccactcctgcctcaggctggcttggccaaaaaccctggagtcattcctgacatcgctcttgcctcaaattccacctcctattggccgttcaatcttatcagctctgtcttcaaagtacggtccccatccaattacttcccactcacaccattgcttacacctcagtttcacccaccattttccgtacctggttggggcagccacctcctggctggtgtctctcctgccaccacttctccccttcagtttcattccccattgcagccagagagagactatgaaaacattagtcaagccacacccatcttctgctcataaaacctcggtagttcccatctcactcaaaggaaactcagagagccttcagtggccaagaagcctcagcgtggcgtgttccctgtcctcatcaggaccgcatctccgtcctctccctcacattcattctgctgtggccacactgtggttgctcacgttgagcttcccagggagcccctgccccaggacctttgcacgtctggtctttgtctggaaaaccattccctgatgtgccatgactcatgtcatcacatcctttagagttttactccaatcccactttctccatgatgccttctcttgcaatcctatgtaaaattgcaatagcccaaccatagttttgctattctctttctttatagttttcacacttatcacgaacatatcctatgtgttaaaagctcaaactgtgcttttcctgtaagtcagaagctgcctgcttgtccctggggcaatctgaaatgcaggcacatcacctgagagcagcagctcccagagtgtggctcacggacctgcggcaccaacatcgtctgggctcttgtgacaggtgcacatttctgggtccctcccagacctcccgactcgggtgcttggggctggggctggcatcctgtgttccagccagcactcccaggatgttctgatgctcaagcttggggacaactctctcaaagcaaacccatgttacatcccaccctgtttattgctaccacctcctcccccaagaacacaagctcatgacagcaggttgtgttcagtcgtttatccccggggctaggcctgtgcctggcagggagggacactcaatagctttctggatgcatgtcggtgggatgaatttcctcttaggcctgcatactcctttccgtcctctgcctcttcactccagcaccgtctccactcagcagcccatcccaccctccccggcctgggctaggaattcctctttgatgtcttcataagacctcattcatatttccagcggtcacaaaccttgttcttttgtaatgatctgtttccactacagaacataaggaaaccactcccagtgcagcctggccacagcagccctcgctaggaggaggttcttatcattgtgaccgagtgcccgcctctccgcttcccacaggggaagccactgggcagccgtgctcagcagagggccctgcacacagagggtcctccacatccctatgacacgagggaaaagctggttatctgatgttcctctgactccgatcactgaccgagccccatgcacctcagaaggtttctctcccactgtgtctgtgcttcgtagagagttaacacacaacaaacacctgctaatctgaattcagtgcccacgagttttccgggtctgtggctactggcgccgtcttcccaaaagtctgtttaataccattgaacaggcagccctcctagaagtttttccctacacctgagctggccacaagttctccatcctcttggtggctttgaaaatcccttcaggattctgagtgaatacttcaagagtgtgttataaattcagacacgtctacggggctttaaagtgccgcagcgggaacctcttactgaggcaacctgggggtaaaaggcttttcaccttcccagagtggctccacccacagcattttcctagcctgaagttaaagaggaagaggaggaggaggaagagaaactacctggctgagcctcttaccaccccttcgtctctcacgaggcagctgtttgattgctacactgtcacgtaagttaacacagtcacctgcccgtctcctccgtgggatcagcctcaggtctcactgtgaccacgactttgcccaaaacatagtgaactacagacttaattaaatgcatatagacagagagtggaacgatggcttcagggacgggatgggaggtggggacgaggtgttggcgcatactgggcacagagctttagccgtgcaagcagaaagcgtgcgggggcagcacggcgtgatggttgcacagccacgtgtgtgcgctgaacatgactgagtcgtagactcacagggggtaaggtggtaaagtttgtgttactgcattttgggtattttgccacaattttttaaaaaccttaattttgtagatgtgttgcatacaagcaagagatacaaaacccaaactgtgattttcctgaaagccagaagctgcctgcctgtccctggggtgatctgaaatccaggcacatctcgcgaggccagcagctcccagagtgcggctcacggacctgcggccccaacatcgcctgggctcttgtgacaggtgcacatttccgggtccctcccagacctcctgactggggcactccaagctggggctggcatcctgtgttctagccagcacccccgggatgttcggatgctcaagcttgggaaccactctctcaaagcaagcccgaggcgctcccacggcatcccagcagctcctgcatctcatgctctgcagggaggaggggtgcagagagcagggaacacacttggaagcaaaagaatctgaatggtgtatgagaacccccagcatcttcctccctgcactgggcccagggcccagcttacctgcgtcaagctgtgctgtgattcccctggcatctgctcgagttccaggtctctcctgaaaacgaacacgcctttctccttccaggcctttctgcatctgaggtttacccagcacaggcctaggtgcctcaggtctgaaattacataaggggtgacagaagcgtttcaatgttgggactgtgctctctgtcgatgtatattaaatatatatatatatatgtttatttagacttgcatctgattaggtggtgcaaacatgagtagctcaaatatggtaggggcctccatggaagagtcattttctgttgaaagaggatatttaaacaagcaaagaatgccttctaagagacttgagatacgaacaacccaacctcaaggttatcttgcgtgactctccctccgcctcttgtaatgagatcaatgggttctgtttcaagctctggacagccctgagccctctgcggctgggatctcctgccaggggcggctggggaagacccctcgcaggtgctctttcacatcagaaatcacacagatcacctcaggcccaattgccttcagatatgttagtcttcaccacagatacacacacagactctcacattcacatacacaaacatgctcacacacacttttacacacatccgcactcacatacacgaacccacgcaccgttcacaaaaacacatgcccacacactctcacactcacgcacccacacacacatacatacatagacacaggcacacatatttatactcacatacataaaaacatgcacacattcatatacacacacacctgcatacacactcatatacacacacacacacacccacttcccactctctcacactcacatacacagatgcacacacattcatactggtatacaaaacacacacacactctcatacacacaaacacaggcaaacacattcatactcatatacacacacattcatatatgcaaatacttacccatacacaccctcactctcacacacacagaggcccatacacacatccacaaacaggcacacatgttcatatcacacagcggacgcaggtgcacacattcgtatcacatacaaacacacacactcacacagctgcattagttgtcaacgtttaaacactaggaggcagagccctgcagggagaggcgagcaggaatcccaggcgccatgcgtgaggaagggcgcagtgggatctgcagactggggcgaccctcactcccggttcctccccacattctgcatcccaggggccctccatctcccccactctcacccagtgtctggatgtcaagttagagaactcggaagctgcagccacacctggctggccctcccacacgaccacgggctcttcctactcccccaataaagaaactatagatctttgttatttggtcatcttaaaaagttacctattaaatcattgcaaaattaatttttatatatgcatagagtttttgaaagcataatcctatcattttacttatacatacattagtgtgtatttatcacctaagaagactttttgaaacacaccacactaccgttgtcatgttcagaaaagcatcagtaattcagcaatgtcctataagacccagactgcgttcagttttcctcagctgcctcagaaggtttttttttggtaaaatatgattcctgctttcccctcatttataagctgtttatttctgtattacaaaagtcatagataaaagaaaatacagagattaagatgcaaagccacgtccgtcagtcccatgtcgattgatcttcactgtctgtcctggaaaataaccattcacgagacttctaggtgtggcctttcattttggaaaatactcagaatattctgagtatttgtacaagtgaatgagcacatggtttttctgcagaaacacagtcgtgtttatttacattctgctccttgctctttgccccttactgtgtgtcctggagacctttccaccagcatgcacacagcccctcgctattccttttaatggctttaccctaatacaaaacagtgtgcaaaccacttgtgaaaatctggtttatttccgattctttgctattacaaaaaccaatgcagtcagcctcagcctgtttatcctctcatctcggtgcagatacgcaaccgcgtgtgcaggacaggatgcagggacccctgctgtgtggactgtggctctgaggaagaactcccggtgtgacaaggagggtgtccgccacagagcacagggtgacggtccttcccatgatgtgcaaatccaccctggccgtcttctcaccgcagcagcacatctgccaaggtcacgttttcaagagtttccatacctccagtgctggccggaattaatcatttatgatatttaataaaacacacatcaaaagcatcagccttctcattgatgatgattttttaatcataacacgaggtggggaggattccttagatgtctaaagtagctcattgattgaaaaagtttgaggccgggtgcagtggctcatatctgtaatcccgacactttgggaggccaaggcgggaggatcgctggactccaggagttttagactggtcagggcaatatggcaaaatcccatccctacagaaaatataaaaattagccaggcatgcctgtagtcccagctcctcaggaggctgaggtgggaggattggttgagcccgggaagttgaagctgcagtgagccgtggtcatgccactgcattccagcctgggcaacagagcaaaaccctgtctcaaaaaacagagagaaaaagtttgagaaataactaatacgaaggatctggatgcctaataaccatcttacagctggtcaaataacatattaggaaaggtcccttgttaccactgattatgaaaattgaaacaaggtaatatacatttggaagaacttatcaataacgtgggctcaaaaccctggagcacattgaccaagattagctatggagttctgtcttttgagtatttcttgaaagtggcagcatttaaatgttggatacagttttgttcagagacagcagcacgaactatacaacatcctcgggctcctcctgttttccggggtttatactttctatggattcctgaacaatcagatttctatcagaatgttagcttttcctgcatgcataggattcatgctgtatatccactaagattggctgtttagagaagacagcaccacactatttcttacccactctttcttgtcttcctctccttttatttttcttgagatggagtctcgctttgtctcccaggctggagtgcagtggagtgatctcaactcacggcaacctctacctcctgggttcaagtgattctcctgcctcagcctcccacgtagctgggattacaggtacctgccaccacgcctggctcatttgtatttttagtagagatggggtttcaccatgtgggtcagactggtctcgaactcctgacctcaagtgatccacctgtctcggcctcccaaagtgctgggattacaggcgtgagccaccatgcccggccctctcctctttcttaacacctgaactccttgtccacagttattctgtgtcttgctaactgaaatgaatattgcattgaaggagttaagctgacgataacgacgtagatggggaaacatgatttggaggtgacaggagtgtgagcctgcagaagccgacagatggacacggcattcaggtgtggagaatatctgcaacatgtcccgaaatgcaaatgcaaaaatccaggcagcctctccccccagacagtcgcagggaagtggggaagcaagctggatgctaacagaaaatccttcccaacgctctcttcaggctgtgagcacacttgcgagaaggaagtgggtcaggacaaagctgctgcctcccgcggattcattgtgacaaaaatagccctaaggatcccgttgcattgtgtgcacctcactattcttcccacaggaccccgggagccacagcccccagaaagctcctacatgtgagatgctggtcagtccacacaatacatcaaaatgggagtcacctcagcccccaaggatttcaaatgggactctctagggtttggagggggtattttttgtcttgtattgttcggggttttgcttggcttggctttcaaaatggcatgcggtgttggttgactgcaccagaatccacattttacctacatcaggtcaaaggtcccagagaccaaataaggagaccaaaacgaatccaaacaaagcagaccaaataggaatcctttgtccattgagaaacttctagaagatgcttattgaacagccagatttatctagctactcctgataaagtcatctaaagaggaagactgccaaggaaattagttgtctctccaaagacagagcgcccatatcctgtcacccttgcctgctccagggctagttgccatggactcagggtagaaaggatgaagacgggccaggcgcggtggctcacacctgtaatcccagtgctttgggaggccgaggtgggtggatcgcctgaggtcaggagctcgagaccagcctggccaacatggtgaaactccgcctctactaaaaatacaaaaattagccaggtgtggtggcaggtgcctgtaaccccagctactcgcgaggctgaggcaggagactcgcttgaacccaggcggcggaggctgcagtgagccgaaattgcaccactgcactccagcctgggcgacaaagtgagacttggtctcaaaaaaaaaaaaaagacaaagctcatggaataactaagatgcagagagtcccaagatgagccagagactttcccagaattggtcattcccttctttatggaaacagagcctcctgggttgtaagaggaacacctggctagtgcctgcagccacaatctcgcttgcagcctggtgcggggacacacagggaggcgagcagctccctggaatcctcctttaaggaggagctggtccgccctgcaccctctatttcccttcccccttcctgctggtgtaatgcccatgggtgctggtgaacagctaccacaggagggcgagagcggcacactagggaatggaggggcaacaacacggcgggaacctggttccctggacagcctcgtagagcagaagcacctgccagccctggccgacatacctctgtatgttacaggcggggaaaacaataaagtcagatgtttctgtccttgtcctgtggtgtctccttcagcagctttgcctgtatcctcactgaaatacaggaaaatgcaagaacagccctggatcccgctgctcactcccaggagagtggaaagagttgtgggcctgtctgtgctggctggctgcatgtgactcggggtctccgccgggtctcgcttcatttctgagccatcagcatgcgtgtgactcccccacccaggcccagctgcatggccgcaatgcctcagcccctcatgtttatgaaaatctgtcagattgttggctgctcctacaacgacaccagtattatgtcaaaataattctgaaaagaatttaaatataaaaaataaaagaggttctcaaagggtgagctggggacccctggaggtccccaagaccattttgtgggatgttagacgtttttttcactctccttcttccaggagtgcagcagagttttctagagcccacgtgacctgagataacaccacagacacagagatgaaatccagttgtctttgatgatgccagacatgaaggaggcatgcacacatcagaaacaacgccactcttctaatacttttgctttggaaagtataattagttttcatgagaaagatgttatttgtgataacatgcaaaggtatcattatcgttatttttaaacaaatatttttaaaactgtcagcgttaaattctaacaaggtaggtgatatgttctccatgaactaaagctctttgggatctccaataatttctacaactgtaaaagggtcccaggacccaaagtttgagaagtgccagtctacatacacctagggatccagaaaccctttgattcgatgtactctgcttataataccaccactaccaacctccatatacacatatgcacataaacacacgcatacacacacacacacacaccatatacatgcacacaaacacacacgcatatacatacgcaccatatacacacatgaacacatacacacataaatatacacgcatacacacacattcacacacatatttacaccttatacatacagacacacatgcatgtatatacatatgtaccataaacacataaatacatataaacacacacatacacacacattcacaccttatacacgtgcacatacacatatgcatgcattacacatgcaccatatacatatacataaacacacatataaatacatgtaagcacatacatacacatatatacacatacatatacacagcactagaacagcacatacacccatgcgtgtatacatcacacacatacatgtacatacacaccacccacataaacacacacatacacccatgcatgcatacacatatacacatacatactcatgaatacatgtctacacacacacacacacacacaatcagtcatttctgactcttctttatcacaggtgcagatcttggtccagaggatccccatgagatgccccagggacaggcactgtcagcctcatcacatggtcatcccctggaaggacagcatggcatgggtgcaggtatttaaatggtggtagctgctctgatgagaatggtaggtgactattctagtgctttcattcatactcccttgctcctgcctccccgttttctcattaaggcactgacgggatgcacagacccatgccaggggcaaagccatttctgcttccttctgctaagccttttgttcagaatggtatctggcacagcccccagggacttttccagacttccctgtggagcactaggagacaggggaaaggagaaaacacccagtgcttaaaactcggcctgaccacagcccattgtcatagctttgtaccctccagcaaatagatcctttattaagccacctggggaccaactacaaaaacgatagattagacacaaagacaaccctaatacctttcttttttttattattattatactttaagttctagggtacatatgcacaacgtgcaggtttgttacacatgtatacatgtgccatgttggtgtgctgcacccattaactcatcatttacattaggtatatctcctaaagctatccctcccctctgcccccgccccacgacagtccctggtgtgtgacgttccacaccctgtgtccaagtgttctcaatgttcagttctcacctatgagtgagaacatgtgatgtttggttttttgtccttgccatagtttgctgagaatgctggtttccagcttcatccatgtccctacgaaggacatgaactcatcctttttatggctgcatagtattccatgttgtatatgtgcaacattttcttaatcccgtctatcattgatgaacatttgggttgattccaagtctttgctattgtgaatagtgccacaataaacatacgtgtgcatgtgtctttatagcagcatgatttataatcctttgggtgtatacccagtaatgggatggctgggtcaaatggtatttctagttctagatccctgaggaatcaccacactgtcttccacaatggttgtaaactacttaaaccctaatacctttcaataggcttccggccgggtccttgctttctgaccacggcagaagcacactatgaaagtttaaatgagaaactcagttttctaacattaaaaactcaccttctaaaagatctcctaagtaaacaggaaatagacatttcaattgcagatgtaagaaaaacaattacagaatactaaaacttataggatatgctgttgctcataaacatttgtatcaccctaaatgagtttaatatttaaaaaaagaaagctcagagaaaaatgaaagacatatttaagtcaagaattgacttaatatatcaaaatcatatcatataccaaaatcgtatacacacctacatatctctaaggaatatactactataaaatgaggtatacatgcaaataagaaaaataattgaagtaaaaaggagaaagacattgaaataaacaaatcaatgagtaaagaaaccaaaagaatttataaatatatttaagaaatacacgatgttcaactttcaaataatgtattaaagcaggaagagaaccaaacgcttctctgcagcacacgtgaagcccgctgtaggtttccacgttctttaggaagactgaataaggttctcagtattatccaaatgaatagagagaacaccctttagtattcaaaagtcccatgagattatctgacaaaagaagttttaagtttcaccttaaaaatacatgcacgagggtaataaaaatatgtaaagagaagagtaatgaggaggggtcacttcccctcattttcccctagggtctcgtatagagcttagcacattgtagatgccaaataaaggttgttgaatgaataaaagaggtactcgaattaccaaaataagtagctattataaaattaaagcaatgtattattgatgtagtggtaaaaaaatattggaattgagtcgaaaattcagaaactaagtatggaaatatatttacatgtgtcaccatttgaaattgagataatacttttgaaataatagaacaacaatttgggaaaaattcaaattatatttcctgtaactacaacaacattacaccaaatttttttttagtattttaaacataaagaataaaattgttaaaacattagaaaaagatatagttactagaagactttatattcaggacactggaggcagaactaatatgggaaaaaatggattgacttaactccatgcaaaataaaatatattctgtaacaaaaagaccttaaacaaaataaagtgacaaagaaaactgggaaaatgacttatgatgcatagtagctttgttaaatcagtaagaaaaaataaacgcttcagtagaaaaatgggcaaaagtcaagcaaatgattcaaaagtagaaaagccaataatttataaacaaatgaaaagatgttcatcctctttactgagcaaagccttgcaaattaaaagatgccataagcactgggaaaaatggaaaaaatacagttaagaaccaatgttaagaggctgtgaggcaggtggagttcatatacacggccagtgagggttcagattgattcatccttctcgagggcatctgacaattcgaacatgaagctttagtaatgctctaactctttgaccccagcaattctgctcgggaataatcccacaagctcataacagctgcgtgtacagtaataccctttatatttagagaagaaaaaagaaagaaagcaacctgaacacctactagtgagagattcatttgataaactacagaaattgtattatggaatacattaaagccatctaaaataatggcatatagttgtctgttaattggcatggaataaggtttataatatataatatcaagtggaaatattataaaagagaatggtgacatgaacccatgttggtaaaaatgataaatctatgtagacatgcacaatagaaatctagaaatgttatcagatgacagctgtattctctatgctgcaattttccatgcaaatacatattaccttaggaatgagaaaaaaaatcaccaaaataaacacctttacttttcattctttgtcttttggacatgaagtttggaagatggtggttatatctacgggggactgtggctgaaattctgatgggcacgtggtttccaggccgtatatctgaggaaaccaggtgccggggcacacttcccgcatgcaggggaacccaaagaggatggggaaggacaggtgccggggaggaaagggctacacatggtccagggtgcacaggcccagttcaggctgctggggcctgtcctgtgtctggagattacaaggacagcagaaggaacgtgccttcggaagaacatattctaaggaccatgggaagattcttagataactacgacagtactgaggtggcctaatgagaattttcattaaaatatttacaagctaggccaggcgtggtggttcacacctataatctagcactttggtatgccgaggcaggaggatcacctgaggtcaggagtttgagaccagcctggccaacatggcaaaaccccattgctactaaaatacaaaaattagccaggtgtggtggcaggtgcctgtaatcccagctactctggaggctgaggcagaagaatcacttgaacccgggaggtagaggctgcagtgaactgagatcgcaccagtgcactccagtctgggcgacagagtgagactctgtctcaaaaacaaaaacaaaaacaaaatatttacgagcaccaagactttcatattctctgcaaaaatctcctctgctattagtggaaagcgtaaaagtagctcatccattctggagggcaatcagatgagactgtttctataccaagcatcgcctttatagaaaaaacagtccacagcattgaacctaggaattctacttagaggaattggtcccaaggaaatcctccaagatgagagcacagatttcactcaaaaggataaaaaatacattgtcattttaaaaaattatgtgcaaagtaaacagaaacacagcaatgttaatgttatctctgggtgaaggaattttgagtgatttttactttctccttttgtcttatttatatttaaacagtttttttaattttataaagtagtcgctttctaccgaaaaacaacccctgtagtgtaagtaatttaaaatcttctgtcaaataattccatcttttaacgtggtttagttggttttcctttctgttacctttatttcccattggttcttttctcttttttttcccctccagttagaaaagcaggagcaggaagtgggtgagaagagccgtctggctttagatttacagagcgtatccatcaatgactaaggcgagggcttggctgactcacccttttcctgcctcgcctgctgaggggtccactaagctcccaggaatccatggatggtgcacctgcgaaggagacacgtcctccttgggggacacgtctgtctcatctcttgctttttttctaatcaaatccattggttctcaaactgtaacgtgccttggaaccctcccgagagtttgttaaagcagatcttgggggcctgcctccagggcttctgactcagcaggtctgaggtggggctgagtccgtgctcctaaccaggtcccaggtggcggtgatgtggctggccaatcacacacacccatccactttgagtggatctgaagctctcgcactttgagagcacaggtgtaaatcagtggaaggtattggctgcagagaaaccagtcattgttggaagctcacccaaatgaattttaacctttcaggccaacaacaaaaacagtaaggataattttaaaactttcgcctcaatgaggagagcaaaacagaaaaacattgctacagcagcaagtgtgccagtatcacgtctcactggcctttatcttggcgaggcaggttggatagagactttcaaagagatttgacacagaaaaacatacactagctcccatccccgcaaataattcaaaaccaaagcaattctaacatgtggggtaagcctaaggaagtccggcaaaccgccagcacctgccatgttgacttctcttcaatgctccttttgaaataccaacttcataaaaataaattcctggcatccctgcttttccgtcatgcatcccaggcgtgttactaggtggcctattgggtaacacagccccggtcagagaggaaatctccgctgtgacttacacagctccggagagaaatgcgcaaagtgtgttcgcctggcctgaagtcagagtcaggtttctggtgtctcgcgtcccggagttgtgaaggctgcctcaaggtcaaagccctcaacttaatctcttgctcagttgcaatctaggctggcacagatagtggcccctccttgccccgcagccctccacacagcgagaggctgccttcctgaggggactggcttgcctgttgtctggtataaagccggacggtgttcatgtcccatggagaatctcctaccagatttggccagcagaactcgctccccacccaagctccagccagctgccggttccggctgcttgaacttgggctgccctctgtagagagccatgaaggcagcctaggcagggaggcgtgatgtcggggagaggtgcctacaagatgcatgggccatacaaagccttctgcagggaggcatggagccggggagagtgcctacaagatgcatggaccatacagaggcttctgcagggaaacctgggatcacaaagaggagggaaacagcaccccggccggtagtgtggccagtgtgtactgacttcacaccctgcagggcgttcccgggaccttcagtgttatcattgcattgtcgatgccagccattttgcagggaaggaggctacgcatcatctagacctctcttcccaaaaaagtccgacttttgggaagagtcatacttttgggaatccatcctcacgattaccttgggaaggagaccctacttcccgctacagaagtccgaaagcttctctcctttcccacccagcttaaccgaggaatggcagccggtttaggcctagccagtgggacagtctcaactagagttcttggggatcagggtaggaaactgaggacagctgggaattattatgttaactgtagccacacggagcacggggcaagactatctgccctacggttcctggttccaaattctggacttctgacctgctgttcatgtccgttcccctccaaccccacacccccaccccttagctgaaaatggctgaagagggagtttctgtggcttgctaccaagaaacctgtctgatacagcggggtaaggcagtgtgctcagagggaaacgtgaggaatcgagaagatggagcaattcatacacctatggatgaagaggacttttagaaacctcttgacaatgattgtgctcccctggctttggatggtcaaatgttcacctcgactttgctctgtggccagcgtgtcaggcattggcaataaagaggctggactgagggctgaggggactttggagtcaggctgccaagttccagaaaacagctgctgagccttttgaagttagtatttcattacagacccaggtgcagttgtctctgtctgtttgcccctaaatgtctgagtcagctcaagggatgggcagggtggggagggagcggaaggggccgcgtttggtcctggtcctccaccacgaagttcacttcccagatggctgcattggagaaatggctctgccttcaggatgctggtgcgcattctccttgctatcctcatgctctttagcctatgagcagcaggtcacctgtgctgagacaacagggcagggccgagcagctggagccagctcctcaaccgcccttcagcagtctgtgtctctcctgcctctgacgactgcagacagctaagatgggagagtggacggggagagggggggcccatctctggaagatgccaatgtgtgactgatctgagacaaatataggccatcacatggcaggacatgccctgcgtttcatagcctaaatcccaaagccaaagggattctgtgcatggttttgttttgatatcaagggacgagactccctcctcagccccccagaggacctgccatgcgggaggcacagggcgagctgagcgtggcagttctgggagtgtgtcctctacaccctaatacgtcctgcctctgtgcagcctttattgtgtctctgaaggaagctacacccggtggacacagcagaagccccttggcctagagtgacttgctgtctcggggggctgaggaaaaaacagggaaaggtgacccaggaccatcccagatgccacggggcactgcagggaggcttgggaggcctgtggctgcccctgatgtgtctctgggccttggtttgaacgaggccccaggacctcgcctaccaattcctgaggctgggggaggcagcgttctttattctttccctgccccatgctactccccagctagataattgtgcccatagattgaacacctcttaaaccagcagaaatgtggtcccacccaccaggggagcacagaccctgtgaatgtgtgaactccactgcgtgtgtcagggctccgggcagaagacctgcagacaagcagacccgtcggagaccagaggccatggctcgggatccagatggtggttgtggggggtctcaaaatcagccagagcccgggagcagtgtgggatagggagccggcgagcgtgccattgcagaccacatgggacccctattccctggagacaggagcgaaggagaagtaggcttacagatggcgccaagggtctgcgttgagatgatgaacagacaagaaaatcatggctggaggaggcaggggtggaatcccagctgcaggtggggctgcagccgtgtgcagcaggggctgctctgacagtcacttttatggacctacttggtcctctaggccccatgaccaagatgccatagtgtccttctcttaccaatgagccactcaaatgttacatccttgcccaaggtcacacggctagcaggtggcaggaggcaggatttagactcagtctgtccagcttgagaatctgtgttctaacagcccctctaagcacacttttggagacgtgtgtgagtttcctgccataacaaaccaccacaaactaggtggtttcaaacagcagaaatttattcttgagcagatctggagaccagaagtctgaaaccatggtgtccacagggtcatgccctctccaaatgatctaggggagggtccttgctgcctctttcaggttctggtggctccaggtggccccagctcacggctgcatcactccaatccctgcctccatcttcacacagtcttctccctgcatctccgtgtctcaaatctccttctcctttctccagttatggatttagtgcccaccctaaacccagaatgatcacatcccaagatccttaacgtacttacatccacaaaggccctatttccaaataaggaaggtcacattcacagaaccaaggattaaggacttggatgtacctattgggtggcacgattcattcaactgcttacagggggtttatttattaagtttttttggggaaagaaaacgagctgtggtaaacagaggagggactgggatcgagagaataggtccaagggttcgcgcaggagatatggggccacaggcggaagtgaaaggatggtgagaataagcattaacttggagccatatggagtggagaaggaccatcaggtgaccctccaggtcttcagggaagaatgaggggggctgggtggagcttggcctgggggaggaggacccactgggaaatgggattgtcaatcagatgggactggaatgacccacagaagcagaaaatgctcagctgaggtagaaaagcatgattttctactatggccaatctgttccaaaggaaaaaaaaatctttcccactggtccatgacattttggaaattctccacacagaactgtctattctctacatcaaacaaacctactatccaatggaatgaaaacatcaaccttaaaagagaggaaaacacatgtcccacacagaagaagtacacaaatgctcatagcagtattattcacaatggcccaaaaattgaaataatccaagtgtccatcagagagaggatgaatgggtaaacaaaacacggtcaatccccacgatgaaatattatgcagccatgaaaaggaaagtatggatttatctgctgcatgaatgaatgctgacacattctcttaagtgaaagaagtcagtgatgaaggaccccacactgtatgatttacatgagatgatgtccagaatagaaaaatctatagacagaaattagatttgtgtttgcctaggactgaggaggggagtgtgggggccgactgtgaaagccatggttttctttctagggtgctatgaatgatctaagattgatgatggtgatgattgcataattctgtaaacataccaaaagccatgaaattgcacaccttctatggatgaatgtatggtatgtgaattatagctcaggaaagctattaaaaacatcaacctaaacctttgtacatggctggtaggaatgtaaaaatggtcctgtttctgtggaaaacagtttggtggttcttcaaaaagttaaaaatagaattattatgtaaaccagcaattttattcataggtatataccctgaaaattgaaaacagatgttcaaaccaatacgtgtacacatgccacagtagaacagttcacaacagctggaaggtgaagacagcccaaatgtccatccacggatgcataaaacacaaagtatgatctgtccatatgaaggaatattattcggtcatgaaaaggaatgaagctctgactgactctgcaacatggatgaacctcaagaaacatcatgctgagtgaaagatgccaacacaaaaggccgcacgctgtgtgattccatttctacgagctgtccagaagaggcaaacccggagagacagaaagcagagtgattgccaggggccaggggagggaagaatggcaagtgactcattattgggtggagggtttaccttggagtgacgatgttttagaaccgcagagaagtggtagttgcacgcactgtgaatgttctacgtgtcaccgagtgatacactttcaatgtttaactttatgttgtgtgaatttcacctcaatgaattatttaaagaaaaatcaacctgaagattgataactgttctgctcctgattggtggccttggctatgcaagcatcctttcttttccctactttctctttaaccctcatttctccttcctggaaaactggaataacaatatttttgtggggatggaaggagatcttatgtattaaatgcctgataagctttcatagacttatagtggtaagagttgtttgtttgcttttcccccatgcctagcagtattcaataaatatctgtgggaatgagttaaatagcttaagttgatgtgagaagatggtctattgggtttcctgcaggagacgggtggctctcagagggcagatgggctgtgtccccccagaattcatgtgttgaaggcctggccccccatgtgatggtattagcaggtgagggctttgggggagtgactggggtgagatgaggccaggagagtgggggccccatggtgggatgggaagaggaaagtgcctgacacttcacccacacacgccgaagatagacagtaaggaggctgccgtgtacactccagggatggagccctgatgaggaactgaattggcaccttgatcttgtatgattgatcctgtgctgcctccagaactgggagcaggaaaggtctgttggtgaagtcacctagcccatggtattttactggagcagcatgagctccctaagacagatggtttccctggaaaggacttaagagagggactcttgatcaaggtgtgtgtgatggttaatactgagtgtcaacttgattggattgaaggatacaaagtattgatcctgggtgtgtctgtgaggctgttgccaaaggagattcacatttgagtcagtgggccgggaaaggcagacccaccctcaatctgggtgggcacgatctaatctgctgcctgctcagctcaaatataagcaggcagaaaaatgtgaaaagagagaccggcctagcctcccagcctacacctttctccagtgctggatgcttcctggatgatcccttgaactggacttggacttggactggctctccttgctcctcagcctgcagacggcctattgtgggacctcgccatcatacttaataaactcccctttatctatatatctattccattagttctggccctctagagaaccctgtctcatacagtgtgggtagagttaagagaaacataagtgaatggcgaggcccagagagaacagccaagtgggtgtcgctgcaatggaaccagtctgatggggtccaggaggagctgggcagcagaagcctgctccggagagctgcagcctcgatggaggagccacagcccgcagcagctgaagctgcagggaagggacggcccccaccctaggcctggccaggagggacagggcggaacccgtgccctggaagctcactctctccccgtcctccagtctcccttgctggtaccactccgttggccaaactggacccaatccagaggtcagggggccctgagacatgtggtgtgtggggtcagccttctgggggcagagaggaagagaggggattggaagagacaacgggagaaagacctacactgaagcccctctcggacctactcagtgctgaggatgggccgccggtggatgcacgaacctcctcttcctctgtgcttcctccacctccttctacacccacaacaccgaacatggacagaggcatccaggtgatgctaaatcgttgctgccacttgagtgcactcggctgtgctcagagctgacctgtgccctggtcagcaggaactgaaaggtatttctaggaacggtgcactcaccccacacatcttgcaggcctgctcctcggtcaacggtggcccagagggacaggtttttgctgtttttcatgtcctggtgaccagtctttcttgtctctgctgatcacaggtggagctacaacataattagtaggtggagttgcctcggaaaacattcctgtggtcaattttattttttaaagctgggaaatccaggtctctgggtggcccctgtggtgtcccttgtgctcttcagttggctcagaactcgtcgtcttttttaagtaactcaagaaattatgtgggtcagctgcacaggcgtacacaaaaactccagtcttgacagcatcgctggaccattttttttttttgaggtggagtttcgctctttcgcccaggctggagtgcagtggtgcaatctcggctcacggcaaccttcgtctcccgggttcaagtgattctcctgcctcagtgcctcagcctcccgagtagctgggattacaagcacccgccaccacgcccggctaatttttgtatttttagtagagacggggtttcaccatgttggacaggctggtcttgaactcctgacctcgtgatccgcccacctcggcctcccaaagtgctgggattacaggcatgagccaccgtgcccggctgctggacccatttttaacaagtcttagattcgtgaaggtttcctaaatgaaaatcttaaaaaaaaaaaaagtgtgtttatatctttgcagtcctagatcgtgaaatatttctccagaaatatcctctcaagctgaaatccccacgtctctggttttacttctgtatacctcctaagtatcggagcttcaacttctttgtccatctgctgaagcagagaatctgctccatccatgatgaaatgtaaagcctgcagatgcataaatctcttgaaaacaggtgagagaaaggccaggcagccatcctcggatagaccactgaacttaacgagccctgtgcttcctgggcccttaatctaaataagaaacataccgaaagctataaaagctacgggcctttctttgaaatctcaattaaaaccaacacaaaacaagaatgctgaatgtccccatccaggaccatctctcaggaataaacctttaaaatctcagtaacttgaattagaaccacttccctccacgcgcgtctacaattcttccgacgtttactgaaaaataaataaatcttacaaaccgggaaggatgggctgagagagaacacaattacatctaccatctcaaaaccgtttttcaaatcttttcagtcttggcgaaatgccaaaacatgttttgacatgattcttccccccctaatttataacctatgtgtatctgcaaggaaatttaatccttatgtttctgattcctttacacttaactcatcaaatgttactgtggaagagccatttgatgtgaaggggccttagagccttttttatgaggacttttaaacctgttcccccttagaaacaggaagccaggtttttccaggagtaaacaaactcagcccacaaaaagtgtccctcgtccgcctggagaccagatccggagtcctccagcggctcccaaactgtcagcacatttgacaaaattgcagtacagcagcatctttcaaggagaagttcctctggttaaaaatcagcgtgccgcaaaaggcagggacgggatcactgtggcaggaaggagttaattattctatctagaatcaacttctgttgccattttatgagaaaacaaaagatggggcgtccggggcaggagatgaaaggaggccgtttccgctctttctctttgtggatttaggggcaccctgtcccgggtggtaagaaaggccacagggtcctatccccttctctgattgagaggcagggactcacttccctctccttgaagttaggtgggctacgtgactgctttgtcaaaagagcatggtggtaatcccagcactttgggaggccgaggagggaggatggcttgagcccaggagttcaagaccccatctctacaaaaaattttaaaaatcagttgggtacagtggcacatgcttgtagtcacagctacttgggaggctaagctgggaggatccctgagcctgggaggttggggctgcctggtgcagtggctcatgcctgtaattgcaccacttagggagactgaggcaagggatcgcttgagtccaggagtttgagaccagcctgggcaacatagggaggtcccttctctacaaaaaaaattaaacattagccaggcatggtggcacacacctatggtcccagctactcaggaggatgagttggcaggatcacttgaacccaggagtcagtgagctctgatcacaccacagcactgtaccctggacaactgagcaagaccctgtctcataaagaaagaaagaaaaaaaaaaaaaccagcatggcagagggagtgccctggccagccccattttctttctcttaaagaatgctctctctgggcagagccaattgccgtgtaagaagtttaactgctcttgatgagttaatgggtgcagcacaccaacatggcacatgtatacatatgtaacaaaccttcacgtggtgcacatgtaccctaaaacttaaagtataataataataaaataaaataaaaaataagtttaactactctgagccagccatgctgtgaggaagcccaagctacagccaggtgagggggcccaagaggaggcgacaccatgtggggtttgggggaaaagagagaccaaggtggcagcaagaggccaagttcatgagtgaaatgaaaagcagaagtgtatcctccagccccagccaccccagccattgccaaggtggccagagacaaatgacccagccaatgcctgacaacattcctgacttgccaaattgtgagctgaatatgaataaaagagtcatttgaggaagctgagttttgaggtgtttcactgtggaataacaaagaacccgaacaccctgagtgaatcgactcccctcccctggctggtctcctgcctagtgaggcagctgcttttgtgacaattatattcgtgtctcagttggttgcaagtaagagaaaaccccacggaactgtctctaaaaagtaatttatggactgaaaagcacaggagagattttatccaggcactgtttgattcgaggtgtgtcatgtcaccatggcttagtgtcggagtttctgaaaatagccccactccaagtgttgaccttctcctgggatcgggggcccttgaaatagtaaacatggcagaggccctttgaacccgacgtcctgtgctgcgtgacccagaggaagagagggtgtctgtgcccacccatgcctgagcctcacactgattgggttggtttccgtcaatgcccacctttgtggatatctcaaggaagtgagccagtggagacggggtggggacaacattgcctcagctgcatggatacccaaagagaaaaggggtgaaatgaatattaggatggcaacctgcacatgcccactcatgaaacagacaccattttaacacttgctccggaataagcagatactgcaaagtctgccagccttcctttctttttttttttttttgagatgaagtctcactctgtcgcccaggctggagtacaatggtgtgatctcagctcactgcaacctctgccttctgggttcaagcaattctcttgcctcagcctcctgaataactgggattacaggtgcccaccaccatgcccagctaatttttgtatttttagtggatacggggtttcaccatgttggtcaggctggctcaaacttctgacccaaggtatctgcccactcagcctcccagagtgctgggattacaggcgaaagccactgcacccggccttcctttgcttccccatccccttcccttccctcccctccccacccctccccttcctttccctcctctcttccttttctttctttttattttttgagacagggtctccctgtgttgcccaggcttgtcttattcaggaattatataacttgctttgtgtagtaacaacagggcaatatttgaaatgttcaacaactgatttggcataggggtgtggacaaattcaaaaacacaccagacaaaacaaactggaagggctgccctggtccgtcctgtctgaagatcagcctgcttagcagtgccgtgtggccattttcccatgttaatgacacggttctacgtaattactttaatgactacatgttactctattttaaggattttccataattggcttgaatagtcagcttaccggtatatatttagactgttcccaattttcaatacaacatttatttggaagtggaattgctgggtcaaaggacatgtatactgcaaacggcactaggtacacatcacacttgttctccagaaagggtgagctactttatggttccactctgtgatacagggagtccatttctccatgcctgagcaaaatccaggtattatccgctttaaaaaaaaaaaaaaaagtaccaagctggccaggcgcggtggctcacacctgtaatcctcgcactttgggaggctgaagcgggcggatcacttgagctcaggagttcaaaagcagcctggccaacatggtgaaaccctgtctctactgaaaatacaaacaaattagacgggcatgatggtggacgcctgtaatcccagctacttgggaggctgaggcgggggaattgcttaaactggggaggcagaggttgcagtgagccgagatcatgccactgcactccagcctgggcaacagagagagactctgtctcaaagaaaaaaaaaacggggaaacctgttaggcacaaataatcatttttttatgcatgcacccttggattattagaagtgagcttaaataactttccacaggtttatgggtcactagcatttcttctaatttgaattgcctactcatagacccagacaagaaacttaagtttttgtcttttaattttgtttatggagattttgcaattttttttaaattaactgatttcttacattacagaattttacatttttatgtagtgaaattatgatttttaaaaaatggctttagctttgatgtcatgctaagaagacattttcctgataagtttataaaaaatgtttacctgtaatttctttctattgaatgaaaactttagataacattttcccctaattactgtattatttttatgtttaaatgttttatcaatccaacatgtattttggtgaaaggcatgaggtggggatggaatattactttccccacatctaaactaagcctcaacagtattgactgcgtaatccattctttcttatttatttgaaatgcacttgagactctttctggatttcctattttgttccattattttgtctgttttaacacttggcccatgctgtctgtttctgcagactcacagtgtacttcactgatagattatgtcctttcttatccctgttccagggttttttccttgactactgctcaaattttatggatttaatatcatcttgtggagttccacagaaatacatattttaaagttgcaattgcattatgtttaggaattaacttggggataattgacatatttacaggcacatgacatgagcttccaattatttgagccaattatttatgctcttcagtaacatcttcacattgtcttccaaaaggcttgcacaccccctatgttaatttctagatagtttgtgcttgttgtaggcattgcataagtgatcttaaattttcttcatattttcaactggttcctgctggtgcatgaggatgctattggtttttgtagctatgttttgtcctggtctccttatgaaaatctcatcaattctatttccagctaagtcacttttcaatgacaacagctgcaaataatgacagtttccaatggttttaccttcctttttctttcctcttctctgacttcagggttaatcatgttccgggtagtgaccagtaatcatagatagccttgtttggtctctggttttagtaaaaatgcttttagtgtcccattatcttgtataacatttgctgggtgtctaatgatcccactccttgttagatgcttcctggagatttgtctttacttgggcacattcttccttgacaagaattgagaccatggtaaacacattcaggggacagccagcaagatgaaaccaagttatctgggcaacagttttaagaataaaaagaaagatccagggagcacatattactctctggatcccctgagagttggcaggttgggtgttctgtgcctcttaggaaaatatacctgatatagcaaattagtcctgggcatcttgaaccctactctgcacacaaatcactggggctcttgctaaaaggcagctcctgagtcagtaggtttgggtggtaccccaaattctgcatttgtgataagctcccatatataagtggctttcccatggaaaaacaagtagacttgctctgtgaagctctatgtggcaaaagtagagataataatagaaaatagttacaaggaagcaaattttaactcaacataagaaattgttttaattgacagctagtccactacaggacacccaggaagtgatgcccaagatgtgttcatataattacagccaggagtaagtggggtcgttctgaacttctggtgggtggccaaatagattcttcactcaaaggggtcaggagcaccagaagcatcgacatcaactgggaacttattacaaatgcagaatttggggtcccacccagacctaaggaatcaggagctgccttttagcaagagccccagtgatttgtgtgcacagtagggtttgagacacctgggactcatttgccacatcaggtgtattttcctaagaggcacagaacacccaacctgcaactctcaggggatccaggcagtgttggctacttggcataacaagaatcctgggggtgcagtcgcttaatgagtgctcacgaggctggctctgtcttgcttacctgccatctcagaattttggctttggtgttgggcgtattgcctcgtggtcacaaaatggttgcaatagctccatatgtgattctcacacaccacattgtgtgcagaagaaaaggacaggtttcctcatcattttttttttttatcatgaagcaaaatcttttattagaaccttccttcactcccacacgcacaccctcattttttttttgtctcactaggaaagctcccctcacatctcactgaccagaccgagtgacatgcacgcccctgacccagagggattattttacctgatttttttttttcttggctcatcccctgggacatgcgtgaagctttttgtcttggaaagaataaagcttttagaaggtagaggtgagttaaaaataaaaatactacatttccaacttcttttgatgcctcctttctattgcatggttttttgctcagaggccctctgtttactcaagagataagattcagctcagaacattgctgtagtattgtgttttttcttttaattgaaaatggttacaatcatgactgccatggaagaatgtcaaatgttataatcggccgtgttctcttgttctcattgcttttgttctgtcttcttagacctgggtcatcatgatagcaaatcagaatcacaacttcttcatggctatctcatgttctctttaccctgtgccatgtgtggaaaagtaaggtggcacttagattcctaatacttaaagtctcttggggaaaaaaaaagttttgctgacctaaaatgcttctgagtttagttcaaatttgagccttctgctgtgatcctggaatccaaagaaaccgaggtgatattgacccaagttcaataagactgtttcagatgagctgcaggaagagaggcagttcgcagatgaatgatcttattcagagccaacaacatccaagtgttttatgagaggcgaaaatagtgcagggagagcatgggaggtaaacaggtgctgctgccctgggggcaggggtggaatggggagggctggggtggggagagagctgcaccaccccatgagcttgtcagttctgatcaaagtcagcacctgcagctcccgatcaccatcgcccccttggaaaatgggtgttgattcatcatgtcaaggtcgatcactttgtagttctgcctaaaatacttaaaacattgttaggataggttttagatgtttttttaagtgcaagtattccctaaaatgccacaaattgcatcctttgaggacatctgttgcaagagaccacctgggaacatcccatcccatctacagaacccctgaagcccccagcatctgggaaggagatgggcgtgtggcaagggttgctgttatgaatcccttcctataaaccaaaggcccctggagggcagcctggtaccaaacaatgtatataaaaacagaaacattcagaaagtcttagaataacaaagcgacaggcactgactttggggaagtccggatgggctgcggacattgtgtgggatccaacagtgtcattttcctaggagtgtccccaattacgacagctcacctcggcagctgaaacttattctttcagatttcaaacgtctccttccctcctccctccagcttggccttcacactcttaataaaacattaaaaaacaccccacactatgctgcctgcacgtgtttcgcgagcttccctgaagtctgaccgtttctctgcatttccatattacagccatctttatccatttgcgtatagaggtgtccgtgcatgaggtctgatttcctgggaagtcagctgtgatgttattgtgttcaaagggaaagacagagaatatttttcactgctgtagaggctctgtgcctgccttttaaacttgaaagatcagtgggttttctgtggaacctgaacacagtattggaaaaagtgtttctgtaagaaaaaaactcattttctttaaagagccctactcattagcttacaggatttaactttctttggggggagggacaaaaaacataaaaatagatcactttattgagcatttgctctgcgccaagcagccttccaagtacttcacacaaatggttttatttaatctcgtaccatctctcctagggctgttgtgaggagtagacgaattaataaacacagagaacttaaagcaatcgagcatgtaatacttgttcaataagcatgagctatttgtgagtgacagtccagtgagataggtaccattatcatgcccattttacagatgaagaaacagaggcaggaaagttctggtatcttgctcaaggtgaagcaatgtgtaagtggttgagtcaaactaaaaaccagctcatagagaaggcaagatatagttcagtcctaaacgatgtttatatctgcacatcctttaagtgtaagatgccagtttgcactccaatctgttatcgttttctgtatttctttctcctccttctgagaaaataatctagaatgtaggataatatctatggcctcaggaatacttcttgatttttctcttctgtttctctgtcttgaaacagcatccccaaagatgctagtggagaatttaaaactatgagctcttggagctgattttaattttgctcgggtagcccaagggttaagttaaagatacagaggctgagttatcacgggcaggagtggatcctcctaagtcactcctgtaagacccttgctgcattcccccttagtgctatccggatcacgtattttgacgttggataaggccatttgcataatctcctctgccaatcctcttatagtaaaaatgggcacccagcgcccaagtggttaaggggctgctcccagtcacagctccccttgcaacctcctctttgttcacctggccctgaggtctgccctcctccctcctctgtccctggagagacccacttgcttcctgaggttaaccacagctccaactctcaccatttcaaacacccgcctgtgaccatgacctcatcccaaattctctacagacacctcgatggcaaataatccacactgcactcatctttgcttcccatcacactgcctgtcctctgttggttttctcctgtcttgatgaatgtcactttgccaccaaagtcagaaatggtgtggtcctccctgaccattccttcttgctccctctctacataaaacctaatcctggttctaccttctaaggacctctccatccacctgcttccccctagccccactgctagcaccctcgcgactgctgcaaaaatgcaggttgccacggcctcctcccttgggctcccccacactggccaagtggcttttgctctttgccatgcaaccttgttccccttttgcttggaataaaggtgcagcagtgctgctgtgaagatgaaatgatttagtcaagtcctgagaaaccagagacgtgggaaagcctcgtggtcagaggtgcaggtctggagtcccacagcccaggtttgcatgccagactctctgcttgctgcctgtgtgaccttgggtaagtgacacaacttctctgtgctccaaattcctcgtctgtaatattatgagcatgagagcagtaccaccaaagtttgtcagaggattgaattaatgcatgtaaagtggtcagctattgttcattcattcattcatttattcaacaattgcttactgaattgggggttccagatctgttatcagaccacccagttcctgttctgggtcttttagttgtcatgtgaccctgggaatttacttaacctctctgtgtcagggtcttcacatgtaaagtggggctgatgacagtacctccctgaatgcgttgaggattcactgagatagtcccagcagcctgttcagcacacagcaagtggtctcaaggctgtgctgctacgattactattatcacagccattgctattattgtagttattcttactacgtccaaagccctctgcaaggtgtgggcttacataggggatcatgagccagacccagtctgggtcccgatggaatgttttgatgctctgttgataacttctcttgccttctatatgaccctgcagcttccccttgctatgacctcacataggctgaatcttctgccttgtatgcatttaggggccctgtggaaatacatctacttttgggcctcctgccctgatgcctcacagaggcgcatataagatgtgccatgcaggtctctcctgtccactgcaaaaccacacacagaccaggtaccagttctgtttctcggccttagcatgtggtgggtggtgattggctggaggctggaggaaggaagggagggatgaatggatgtagatcttggacaatctacttctttgggcttcttctatgactccaccactgccatgcaaaacaggttgccatttttctaaaactaaggccgtggggtacagatgctgagaaatctccaaattaatgctgtcaacaattcctttggaaaccctgtactgagctaaagagaatctaaggactagtgatatgtgtttgcctttctttctttctttttttctttctttttctttctttccttccttccttcgttccttccttcactagtgatgtgtttgcctttctccttccttccttccttcactagtgatgtgtttggctgtctttctttctttctccttctttctttccttccttccttccttctttctttcctcccttccttccttctttccttccttcactagtgatgtgtttgcctgtctttctttctttccttctttccttccttccttcactagtgatgtttgcctgtctttctttctccttgcttctttcctccctccctccctctctccctcccttctttcctttctttttttccccagctttctgacttaaggccttgatgcttctcctaaaactcactgtctgtatgtgagggagggtcagatttcagcttagtagagagagagagagagagagagagaggaagagagagagagagggagaggaagaccttggagcattttgcttggaagctctacagctgctccttgcactgctcactgttaaactcacccagctgcgcccaacccagccacatgtcacaatcccttcacattcgtaaacaagatcagtcatttctgggatggatccacagtgagacacattcagggataactaacaacaaaggctcttaggtatgttgttgaatatgactttccttgggaccacattttcgagcctacacacctgagcatgggcaggtctgaagctgctgtagtccaggaattttagaaccaaatgtctttgtgttatatctagccttgtggctcacagcagcatccggacaatgttacccttctggactttttgaaagttctattccaaatatgttattttcattttccctaagagtgacaaaaaggaaacgctatacccatacatgcacagagacatcaatatttctatgtagtcttttgggggactaggcgaaaacaatcaacaaagaaattttatttgggggcatttctgaagcttttctgccttcttttttaatgcactgaaagctctttgggatcttgcattcttttactttgcctacctagctggtgtttcctccgtttgtcaaacttgatcccaaaccaccgatctgcctgctcctgtgccctgcaaatattcacggccaagtgcagtagcccctcaaagccaatgtaagcctgtttccagccctagtgttgatgggtgatcttatgtttaccaggctgaagttctgaacaccctcttcagaaaacagactgcactagctccaggctctcctcctcgttggtaagcgtgtcatccatgctccaagttttccagagctccttgtttaacttggagctggacaaaagcatggccccaggggcagcttggcttgctttatattaatagagtcctcaccacagtaggactgcactgtgcccttgcttccttctggctggaacttgagtgtagctgtgcctttgaccagcagacctggggcagttctttacagctacccagttctaacaggaaaccctggagaagaaccaagtaccatgaagttccaaagctgcttaacttcctcttaaggattcgccacccttagcaggtattttatcccgtccaggtctataatctgttttgtaaatgtcttcatagttcagagtcactgcaaagccagcacactttgggctgatgtatacagctctgtctaggtaccatttgagcctagcaggtcaattgaatacagatgatttaattctcctaatcggttggctctactctctgaatatattaaaactggctaatccaggctcatgagtgggtccacgcttagtggtgaggctctccttggtgatgtgtgtctacaactaagccctcatgtccagctaccaacagtcacagaaacgacttccaacttcacacattgcctgactgcagttcctcagaaactcacaagtgaatgattcttccaatcttggaatcctctgatctgcaattttatacagataaccagtactctctggctagaagcacaaccccagaatttgcttaaaaagcaaagggagaaagtgtcctgtagtctctccacacacagagaagggaaacctcaccatgaaccagggactagcagcaaactaaagaacatattttatttttaataaaatagtggagcatgaaaaatatcatatattacaaatatacacacgcagaaaccactctttcctggcactgtgaagagaatacactagacaaagtgtctctgccaacctagtgcttcctgatctgtttgtggaaatcatttgtttaacaatagaaagagtcaataagccctttgggtaacttttgaatgatccttctccctcttcccccctcctttccacaaatcagtccaaacgtctataacattggcttggtttccattaaaaagccacaaaatgtagcactgaagggtttctgagggctgggcctcttagttcttttgttaggagatttcttttgttgtctttatatatagcaaaatacttgtttctctttttattttcaaggaaagagaaaaaaatgtattgcacatcgtttgagttcacaaatgtgaggtttgatggaggtttctgtcttgcagagagactattggtgaaggccggagtctattttaagcaactccaaatccactggggtgtgaggcgggccccgggtcctgtctttcctctgcagggatgccgcccagcactgtggccttcctgggggtgggccctggggatggctcatttgttaacccaggggaggctcttgaatttgcaaagcagttatctgtcctcttatttgtaaatgggtagcaaagccaactcaaatacacagatgtatatttagggagggctctaaacaaaagttttcttctgagggctgaatcaactactttaccacaaattagttacacaagaggctacttcactggaggagcttcccttcgctggaaaaccaaaacaaaacaaaaccctttaagtacatttttcctttcagtgtatcacagcatcctgaatttcagggtaaacacttttttatgtatttctcttttgcttttataaaaaaaaaaaaagaagaagaagaaagaaaaacacaaccaagaaaagcaccacatcttagctccgggcgcccctgtgcccttccctccagccctgttcacacgcaggtgggcgactgggcagggatctcatatttcccgtggtgagttttctggggatgctgggcttttttgtaaatcccaccgctggtgatcacgctggccggttttctccggctcttcttctttaacctacggctgcacacctgctgccaggactgcagagtcttggaggtccaaatccacatcccgctggtgatccccaccaccagcagcataaagatcttcaccatgaagatctccacggcggggatggaggcggccatcaggcagtccagcgttttagtctggttgttcattttgcacttgtgctgcgccgccaggatcttccagtaatccatgttgaggcgttcgtaaaagtagcaggcgatcacacaggtggccggcacggtgtacagcacagagaagagcccgatacgcaccatgagcttctccagcttgtccgtgttctcgccgcccgtcttcatcaccctccggatgtggaacagggccacgaagcccgagaggatgaaggacgtgccgatgaccaggtagcaggccaggggaatgagcacgaagccggtgagcgcgttgacgtccatgctgcccacgtagcagaccccggtgagctcgtcccccgccaccctgcgcatgaccaggatcaggatggtcttcaccgccgggatggcccaggctgccaggtggaagtagctgctgttggcttcgatggcctcgtggccccacttcttgccggcggccaggaaccaggtgagcgtgaggaccacccaccacagcgagctggccatgccgaagtagtagaggaccaggaagaccagcgtgcagccggtgctctccagtccctcctggatgacatagagctggccgctgtcccggtcgcaggcgatgctctcggcgccggcgaagaggcggatgaggtagcccacggagtagacgcagtagcacatggagaggaagatgatggggcgctcggggtagcggaagcgggccgggtcgatgaggaaggtgagcacggtgaaggcgctggagaagaagcacagcaccgcccagatggccagccagaccactgcgaagcgcttgtcctcgcggctccagtacacgtccacgccgggcgtgcagagcggcgcgcacgacgcgctcttctccacgtggtggaacttgcccgggttgtcgcagccgccgcgcccggggcccccgtccttcagcgggtgctcctgcgcgctgtggggccgctgcggccggaacagcggcgggaacaggcccgagccccgggtgggctcgtccgagccgttgttgggcgcctccatgcacaggtagttggggtcgttcttgttggggagtttccggcagtccagggagtcgggccacttgaagttgaactgctccataatcggggagcacttgagccgggcctgctcgcacatgacccggcaggcggggatgggggtagagacctgctcggtgcacatcggcgcgtacagcgagcacaggaagaagcggaggtggccgtggcagccgtactccaccagcggcgcgaactcgtgcaactggatggctgcctcgcgctggttctcgtggcccatcaggttgggcatacgagtcatgttgtagccgatgtccttgcacatcgggatctcgatgggctggcatttgccgtcgcccgggcgctccatgtccatggagctgatggcggcgcacgagcccatcacctgcaggaccagccacaggcgggggcccgggcgctgcatgctggcgttggacgtgtcctcgcggggagctccgcgcccctcagcgccgccgctcccgggcacgggctgctgctggccccggctctccacccctgctcgggcccccgcccatgcccgcccggcctggcccgagcgctgcgcacagcgcccccggctcggctctccgcgcccggcgtccgccgagttgggggccgcggcggagagcagcaaagtttgcaaacaataccgggaagcgagggaagcccccggagctcccggcgcagcggcccggcgcgagctccaactcacggccgcggcaaacttcggcctcttcttggagcgcccaggtggcgcgtctggagcgggctggcggcgcgggcacaccgaggccggcccagctcgcggcgcccccacagcccgggcggctcctccctccctgcgccggcctcggccgggaccagccggcagctgtttcgaggtttgcgtcccgggatgagaagactcgcaaaaaggcaaaggggggcagaaaagccgagcgctgacaggccccgcccccgggccgcgcgccccgccccgccgctgctttgcatgagaaagcgcagcggcccggggcagcctcctccccgccgccccgccgcgggctcccgggccccgcgggggccgatcccccccggcctgcagcccagcctgcggggggcgcagcgcctagtcccgcccgcgtcgcccgccagccccgggacagcccgcctggcgcgcggggctctgcgcgctgcgaccctccccggcagtcccgcccgcctctcctcgccctctctctgcctggcctccaactttgcctctcgctatcctctccgccggcgccccctttcccggcggtccccgggatggtccccggcaccccgaggacgccgaggttacgggaagttcggggactggcgggagaaggggtttgggggtggtccgcggcgaggggcgcggggtgcatcttctcttccttttatggtgagtcccgggcggagggcgctttcaaagggaggtgggatttgcgttttatagcctgggccataaagtaggcccttgcttgtaaacctgcccgcatcttcctgaggctggggaggtgctaccagccccgggctccgggctccgaggagggattttctttgaaatttcaaagagacgagctaaggggagggggaggggctcgagaatccggattttagggccgctcatccgaggtctcctctaagaaggcgggaagggggaggggcgggaagcgtcccgggactttgaacaccgcctcccaccccgcgggaagtgcgggcttggtttgtaccgcggtgacccccgccccctccgaagccgcagagccggggcctcgcgccagcagggctggagatgccttcttggcggctgagtttatttattataggaagtcattcgctcgtggggtatttatgtgatttggcgagtgatgtgcccggccagcgccctccttggctgcagccccgcaggaggacccggagtagggtgggatggagtgggtcgtgggaggagcgcgtcagcgcctgcccggggacccccagctcccgcgaggacacggaggcgcgcacgccgctcggttttcctggaaagtggagaaggagcgtcctgggcaggtcctctgagctcatcccccctcggattggggcgggtctgtgacggggtcacttaggacacgacgtccccccgccattcccttcccccgcccagggcgttcgcggtgggcgcccaccgccaagccccactgttcccaaggatgcgccaggtgcttcccgtagcgtcctgggttgacccttaaaaaaacagcacccctaggaggtggccggccctctcctcccagggtctctccgggtcacgatcttccaaagttcggaaactcgcaggatcgcgtgtgcaatctcccgctacctcccggggggccggggagaggtcagaggagcgagtcccgcgtccaccggcctcgcttgccccctgcccgtttgaggatagttccagggagcagggtggagtgtgcggacatctttggaggcagtgctggggcttcccgcgttggcggcgctccacccggcgtggggggcggctgcacgggcccccgcggtggggacgctgcgcacggggcaaggtctccctaggaagcgcccgggaaggagatggggcccgccaggaacccccctcactgaccagctttctgcacgccgtgcaggagggggccacttcctcggagagtattggcttttaattaaaacaagccctacaatttttacatcggtaagaaacttggggaaatctcacctttccactcattcattcatccgttcaacagacatttgagcgcccagaatcccagaattaataggcaggttcaggcacccacccctgggtcgctgtccctgggtgtcctgggtctcactaggaggtgctggaggaagtcggggtgagggagaaagtgaaaaagaaggtagaaactccgggcagttagaacaccaccttcaactgtgttatttcccaagtgaaaagttgcatgattttatttttgaaagactgccatttttattatagtgtttttttttttgttgttgttgttttttgtctagtgagtaatttttcaggacctttaaattaaaattaattcagcggaaatcacttggcttttctagaattttcctggcaaaggtccttcctgggccctattttccttcttttcctttttgtgtctctccctcagcaactattagaaatatttagtgcaagagtgagagccaaacgccgggagctgggtgtgagctatttgagaaagtgcctcctaattgatcttttctgtgctgttttaattcagccacgttcaggcccattattttagctataaccacttcagattgcctttttctctcgttttttataaaaatgtctgcagaagtgcttcgccctgtccagctgagatggaaaccaacaaatagactttattatagagaaatgagggttctgagaaatcagcaactggaagataagtctgtaactaataaatgaaaaggctcttttgatggccccagctgaaaagatattttattttattttttttcctgtgtgtgggatttgagatgtgtgagtctaaggagcagccggggtcccccgctgctcagccctggctggcaaccgacccccctctggcaaatgttatggagaattgggaggaattttatggctgtctttccctcagctcttttttcttttgtcttctttgaagaatgactttagacattttatttacatatttaaccatggatgaaagacggaaaagaaagctttggagccgtcgtgggaatagtgatatgtttaaattaatggaaatcttattaggcttctaaaattttgagcaaagatttttaatgaaactttataattaaacatgatttcacataacgtgcagagacaaggaatatgtttttacccccaaccacctaaaaatgtctgtctatcggaaagctatcagtaaacattatccgccttcaggttcttgcaaacgttcaccagggaaagtatgaggtttttgagagagaatatttcaggagtcaggcagtgttttgaacaagaactaaatattttttggaggtggaggggaattgaaagagaggcccagtttcattccatttaaactcacaaagtcaaaagtataaaagtactttgacacggatattgctaaaaatcaaagttgtatcttttcttattatgtaatagtcaatggaaattataagcactgtgcgaggttttctgaaatgggattagagaaaacccaaataatctctttaagataaaaaagtactgagtctttcagcaacagaaagaaattaaaccataagcttagcatgttacaagctaattgcaagagtaaactggtggcataggaagaaagctcataaacagaagtaaaatcgtgctggtgaatgttgagataaaaagtggttcaggctgtcgcaacgcctttcagtagctgctgcttgaatcacctctcttggtacattcaagtgtgaggatccacgtaagtgattcttgtgtttcttctcttgtcttctcgtgtcgtcaatgtttgtatttagtccgggacatttccaattctaccttcaagtatgagaatgaaaactgatctatttaccaataattgcttcacatgcagggaagtctgatgtgaatagaccttgttttctctgacctcatctagtatcaagtttctgcagaaacttatcagatataaaacatgcacaaaaaattatgttttctgatcaagtaggcatgctccccgtggcgtgcccccatctttttctccagggaaaatacctttagtgatctgaagtgatacttagcaaagaaaacacagtttgtaccaccagaaaggccatgcaagtcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctacagcatgcaaacctcataattgtgagtcaggcacttcccatatgagggaatcacttgtggtacccagcgttggcagcaacaaatggagactgagaaagttgaatcaatagcacagatgctcagatctggaaagaagcaaagctagaatcaagtgtggtgctcagagccctgatactttccaccctctgacctaagcatggtgagataacgttctagtctgggtataatgagctcacgggtgccctactatttttctttaatcaggcactgtctcaaattttaagtaagaagcacgagaaactaaaccattccaacattccacaaccagggcaccaaagttatggtagctagaaaaagcaatcttttaaactctattgtatgacactagtcatctttttattttttgaaaaaatgacaaaatgtagctcaaagatccagtacttcagacactcacattcatcttgagcagcaagaaaatattttctcaaacgcgagcctgtctgcggattaaaggcaaacatttcaaaaattattctgtagcttaagaaaacatacttcaacaattactgtttccttttccatgtaaccagattcactgtacattacaaccttaaagctaagatctaaggtttagatcaactctttaatcctggctgtggctttgggtacttcctgctcttcatgagaagggctctaggcctgcagctgcctgtgaacaacatcaggaaaaaagaaaagaaagttaaaaaagaacttagctgactgggaacaaggttctatagcattgcaaaggttaagctatggcatctgaaaatctgacacttgaagaatgcatagcttaatgacacaactcaacctctgtgccctttagagagcttcatgtcaaataaaataacttagaagagaagtggcaggtaatatccttcttgtcaactatttaacttaaaaaaaaaagtttgcatgccaggaacacctaactctgtttttctcaattgaatccacttttgtcttaatttgatatactgctttgtggatttgcctagctttgtgaattccttggttttcatctatatcaccttagtttgactctactacagacattaaaatgatacaggcatggagggaagcccagcaaatggtgctgacgctcacactgtacttcgtgatgccaggcagaatcttcatgagcgtggattcgtgtgtggatgtgaatcccggttccataacttaccagcctgtggccttgagcaagtgactgaatctctctgggccttcactgtttccatctgtcaactagtcacaagactacggactcggcagacttgctgtgaaaacaaagcgagatggtaaatatcaagtgatttgcaacctctagcgccctgatcttatttattgaattgtattccatagacccccccgtgcttcacacttcaatgtgctgctgctaactttattgtcactaaggtaaaaagttaccttagatgttccttagaaaggagaggaggtcgtgcagtcttaccctcttagaaaaagaaaatgccctggttccacacatgtggaacctttagggagaaaggagacatcggtttcagttacatcagctgaataaagcaggaaattcaagttcaaaggtgtcatgagaatttccctttccttttcctttattcccctcccatttttacaccatttgctctcaccagaaatgtttgtttctggcttctggcccaagatcttctagagtatatttaacacagcataggagatgctgtggtctcccgataaaaatcgagtgaataccaggattgtggttgtttctccataactcctgacacccgaatgcacccctgaccctgttatttattccagcttttcttaaataaaaccaggctgtgtcaaaatccagcttgactcagcagcatgcaaagacactgcaacctccaacacttgaaccttatcctcagtggcctgggaacgtctcccactcctctgcctgcagttagagttgagtccaagtcttcacaccttgaaaatcactcagagacgaagtgtccagacttttgtaaatgtcctgccccatgtatttgaactaactcctactggtaaagttgaataaatcagacatttactcaagtctgcaagtacaaatgtaacttgaagcagcaacggaaaggcggaattttccttgcaccctctcctttcctgtgtcctcttcctttgcaagttcgcagacagctccatctccctgagtgccaccgacaacacccactaacagctgtctatgctgacaattccgatctcccctggcatctcattcctgtttacacttgcacatcaaatgtgcctttggaaaattccctgatttcttgtgtcctgttttctttgttctatttctattttgagatgacatataagggaaacaacttattgtagcaacagggaagtgataggaaagtgaaccaaactatgcacacacacacacacacacacacacacacacacacacacacacaagccagaaacagaaaaccacaggctgcaagaaagtaaatctcaaagccaagccttcccaagtaaccaccggccacggctcatctggtaggatccagtgaggtgaactgtggatttgtttggggaaaactgtatataaaatggcaggtaggctgggcacagtggtttacgcctgtaatcccagcactttgggaggccaagatgggaggatcacttgaacccaggagtttgagatcagcctgagcaatatggtgaaaccccatctcaataaaaagcacaaaaattagttgggaggaggctgggaatggtggcttatgcctataatcccagcactttgggaggccaaggggggcccaaggtcaggagttcaagaccatcctggccaacgtggcaaaaccccatctctagtaaaactacaaaaattagccaggtgtggcggtgtgtgtgtgtaatcccagctacttgggaggctgagacaggagaatcgcttgaacccaggaggcagaggttgcagtgaaccaagatcgcaccactgcactctaccctgggtgacagagcaagactccatctcaaaaaaaaaaattagttgtgaggggtggtgcgcacctgtagtcccagctacttggaaggctgaggtggaagaactggttgaacccgggaggttggggctgcagtgagccgtgatcatgccattgcactccagtctgggaaacagagcaagaccctgtctcaaaaaaaaaaaaaaatggcacgtcaccagcttctctggaatgtcaccagctatacctaaacaccagtgcctgttgctggcacctagcactgccctcaagatacaggctccactctttggaacaggcagcaaggggactccaagacagagcacctggggatgggatatagcttagttcccaccagagtcgccccagatgagcataaaattgaagtataaacagcttcttgatatgcacagaggtaacgccactgccccaaaatccatggccaccccggtcttatcatgaaaactccggagctggcaccgttgcccaacgctgtgacaaatgaaacaccaagggaggacagtattcatggacatttgttttaatttgtagcatttaatgaagtgggagaggccagggagaggccttcaaccatttcaaactaaaaacaatccatatctggaaatagaactttgcggagttggggctggggtgggcacgtggcatcctgagtatttcgtgaacacaacactggtgttgacaggtttggttgtgattagacttcctatccctgctcccccaaccccacccccatcgcagggcatttaaataacatcgtaaaaaggctttgtgaatccctctctttacctttccaacaaagctgagctcagatgattctcaaatcatatttctgtagctttaaccccctgacccccaggagagctcggcaggctactatataataaaattctcactgtagggaaaccgcccagggcaagttcagtactatcaggagggaccatgctgtgcataactgtgctccgttttgatgaaatattcatctatattgatattggagcaatcaaattatggttgaaaagctctgtaacctctttgtgagctcagtctcgacatgttaaatgtcattctttcaaagggtcaccgtgattttgatttggtggctggattcccgccctttacaatgaaaatgaaaacacaattaaaacctctgatcccctaagctgacatcaacagctactgcttgattatcttttaatggaaataaactgttgttcttttatttttatcattttaaaaggaatgtattttcacaaaaaaatgatacaaaacgcattcagtggaaaataagcatgaatactgctactctccagaatatccgaccttccagatctatagattcactgcaatatgcatgcacatgcatgccacatgcacacacacacacacacacacacacacacacacggggagtagttctaaatacgtggagagacagaatgaaatacaggagagaaaaagtagaggagccaagaataaggcaggagacaggaggggaaggaaggagagcaaatgggagggccagagagggacaggaatgggaggagaggagaggggatgagaggggagggaaggggagaggacatatattctaagaagaggtcatataatacaagcaagttcacaactatcttttaccaataacaataaattgtgtattttttgatgccagtaaacatagacctacacataatttttagtggctgcagatattactgctgtacatactgtaatttattccaacattctcctccgaatggacatttctgttgttttcacatagcctgttttaaggacatctgttttctatcattttagctggaggttgactcaaacacaactgtccctagagtgcattaataaaagccaaatttgaacagtattatcagttatctagctctcaactgttatcaactcagtttttaggaatgtattaatattcccttgatttaaatatgtcagatctccttgaggaacaaaacggattggcatagagaagaaataaacctaatccaaatgaaaagaataattatgagaatgaggctacattcgggaaatattctaagatcccaaatgtaaatgtaaaaaaaaaagttagatatatatctgtaaaattggtatatttgcatacattaataaccttgactttcaaacaatgaggtgccttcttcattatggtattacactcatcaagggtgtatttttaaactacaccaaaccaaaaatctagccatctgtctttagaaccaaagaatacatgtcagccacatgaattactttatatgaatctacaaatatcatatcattatattgatagactcaaacagactcatcgactatagagaattgtgtcaacatgatcgcaatgcatcaatttactatgcactgaaatatatgtgtattgatttaggtagagaaatacaaacacgtggacggggtctttgggcttaatcatttattaatcatttagctattaagaacatgcattgaggctccaaagagaactggactcacaagctgttgattctaagtgtgtggtgcccttgaacaagttccttaatccatgcaagtctcagtttcttcatctgtgaagcaaggatgagtgcagcacttagctcccaggagtaacattcttaaccactcagcccggtgcctgatacctgcaaatattcagtacacattggttatgatggtgatggcgatgatgaaagaagaaaggcatcgtttaagctgaagctaatgatgatgaacaatgctggacatggaagcaaagtttatagctgatcaatgatatcattggatctgagggcaagtgggaggcaggaagagtgttccaggcagaaggaatggcacctgcagcaatcctgatatgagagagagctcatagtggggaaaggagccgagtccggtttgctgtggctggggacaatggagaaaggtaaggaaggtgacagcgcccaggacaggctgagccttggggcccatgcggagatcataggaggattttctatcgagtgccaggatccagtgtagatgatctacatgagctaaagtaaaacagatattggaatgaaacaccatcgttttggatggaacaatgaaaattcatgaagatgtccatttttcccaaatcaacatacaggtttctgacatgaccaattacaacagaacttttcttggagcttaacggtggtgtcacagtagcattaacagtaacagctatcctttaaagagtgtccagggtgcaacagatatggtgttcagcatttctttaaattttatctcattttatcttcataacaaccctatggacaattatttccatttttatagtagttttattatatatatcatacaattcactcatcaagggtataatttaaggtataaaacaaatgacttagtatattcagagttgtgcaatcatcaccactattttagaacattttcatcaccctcaaaaggaaccacgtacacattaaaagtcacttctcatttcaactcaatctgcctagccctaagcaatcactaatctaattcctgtccctatcggttagcctactctggacatttcatatcactggaaactttcaatatgtggttctctgtgactggcttctttcacctggcataatgtgttcaagacgcatctgtgatgtgacatatagcagtccttcatcttgtgtactgctgaataatattgcattgtatgggtccaccacactttcttcatcatccagttgatgaatgtttgggttgcttccacttgggtggattatttatgatattgttatgaatattaatgtaaacatttttgcttggatatatgtttttatttctcttggatataaatccaggagcagaattgctgggtcctgtggtatcgctatgtttaaccactgagaaacttctggactattttccaaaatagctgcatcattttacattcccactagcagtgtacagaagaaccagtttctccatgtcctcactcacacttgttctttttatcataatcatgttaatggatatgaagtggtatctcattgtactttttattttatttttcttgataataatgatactgagcattttttggtgtgcttatcagcatttgtgtaccttctttctctgttcagatccttcgctcattggattgtctttttattattgaattgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggttcagtcaaatagagccttccattcctatcaagaggcacagcatagggcagccaaaaataaaagggggattgaatcgcccacagtgttaatgaaataccttgtaaatgtcaaacaggcagaatgcaaaacatctctctgctcaagagttcttgatatctacttccacggagcattggattaatctctttcaccaaaaaaaacaataagagctgagagtagagacaggcagaggaagcatccacttctgcagtcagaaaaccaaaattaggccaattatattgttccagaacctagatttcacggtgagaggcaccatatgaataaaccagtgattgatagatacatctaaatgagcgtttggcaaagcagtgaggaagtaaagagattctgtcgttttggcattaggattgaatttattcctcctcgagacaggtgaggattcagagcttattcatgtgtcatccccatcctattctactttgaacttcctcagtcactggaaaagagacatgcacagaattttagagttagaatctgaaagatcatcattgcacaggcgagaaatctgaggctcagagaacataagtgactttgccggctgattagggtcacaaccagaaccagaaccaggccctggactcttagctgagtgcttgtttcgctaatctgctctgagcccagaaacctggcactaggcaagaacttcttcgaggaaagattacgatttcctcagagacttttttcctttcatatctctccctctctctgagaatctatgtcacccagacataggtgtcaggacaaaagctataccagtttaaaagctttcagcttggcttcctatagggataaaggccaaggagcaaatccacaaagagagaaaaagaagccactgttgccgaatgagcatttcttcccaagaaacagtccatgtacaactgtgtgtgtgtgtgtttatatgtgtgtgtgtttctatgtgtgtatgtttatatgtgtatatgtttatatgtatatctgtaagagcatgtgagtgctatatatatacatatgtatgtatgaatagtgaatgtatgtgtgaatctgtgtgcttaagtgtgcatatatgtgtgcttatgtttgtgtgattgtgcatgtatgtgtaggtgcatagattttattttttttttttaattgagatggagtctctctctctgtcgcccaggctggagtgcagtggtgtgatcttggctcactgcaacctccgcctcccaggtacaagtgattctcctgccccagcctcctgagtagctgggactataggcgcacgcaccacgcccagccaatattttttgtatttttagtagagatggggtttctccatgttggtcaggctggtctcgaactcctggcctcaggtgatccactcacctcggcctcccaaagtgctgggattacaggcgtgagccaccactgctgcccaactcatccgttatttattttattattattatttttattttatttatttatttttagacagagtctcgctctgtcgcccaggctggagcacaactaatgtgggaaattgtggcagataaagctggtctggtaagtagggagcagattgagagagatggcaatgccaagctgaatctagttgtgggttcaggaagcctctgagggcacagctgaaagagcatggactttggactcaagcagatagaggttttgatactatttttactgatttcaggctatgttttccagtttgcaggtcctctctcagagtcttgctttttttttctttctttttttcacctcgaacaaaattaataatatctacttaataggctgtgatgagtcaatgggaagtcaagtataaaatacctggctcagcaccttatgcgtaaatgaattctgccttcttcctcttgaatgagcctttggcctatgccaggcctgcctcatggttgcctttgggatgaactaatgtaagacatttccggagaaaacatgcaaatacatgtcaagatgataaatggaaagagatccagagttgtcctttaatcccagaggtttccaaaaccttcaacagaggttgtactttgatgaacttaa

SEQ ID NO: 705 - DNA, 183539 bp, Homo sapiens
  misc_feature (1)...(183539): n = A,T,C or G
tctctagtaaaaatttcaattagaaaaatgtcggagccaggctgccaggatgtgaggctcgagtctgtcactcaccagtctgggcaaacccaggtccacaacttactctctttgtgcccagtttccttatctgcaaaaggaggctaataataataataatagtaataaaaatataagcttcgtagaggtgtggggatacacaaagctaatccgtggaaaaggatcaggaagaacagctcatgctgagtcatcctcgcggaattcaaaaaaaaaaaaaaacaaaaaaacaaaaacaaccggaacaacaggccctgaagatgacccacataagaattaggaagaagcaggaagagggagccggtgatgactgtcttggaaaagtcacatcctggagacatctgtccaagagatccactggaaagttgtgtgttagccaaagcagtccgctggctgtaggcatcgcccatgacatgagcagaaagagccaaggtggacaaagatagcaagtgtttaaaagagatggcctgtggcgtcaggaggcacaggtccctaggacggagagcctgcatgccgggccctctcccagacactgaaaggtctgagcgtggaaaggaagacattcaagttcatgatttggaggggcgtgctaggtgccaagctctctagcttttttcctcatatttaatacttacagcaacttctaagacagcttttatgacattccccacttgatggattagtttgcagaggtgcagagaggacaagaaatgtgcctaaggccacccagctaggaagtgaagcaaaacaagagttgaagccagctggctggctccttcgtctgctcctggctgcctgcatcagagacgacccctcaggccgggggtgcgcacctggctctcacctgcccccgataccttggtgctaactcctgcctttgcgtttttgcctatcctgtgtttgcagatgagctacttgccctgctgtgtgcacggatggctcacagtgggtgcaggcggcctgcgggcacagtccacgctgtgattagcagcagcagagcccctggatacctctgcccagagctccgcggggtcagccatgcaatggcaccatcggatgagctggcaagggcctcccagacaggcggaaagagggcttggcaactgcaccatgtgtatgtaagtccagctgggtgtcctggtgtcagttctcagtctgtaaatgggcatcattggctgttcatggattaatgaggggtacgtgcaagaacttaggttctcagagagaaatcagataaagtagcaaagaacagagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccaccgcgaacgccctgggcgggggaagggaatggcggggggacgtcgtgtcctaagtgaccccgtcacagacccgccccaatccgaggggggatgagctcagaggacctgcccaggacgctccttctccactttccaggaaaaccgagcggcgtgcgcgcctccgtgtcctcgcgggagctgggggtccccgggcaggcgctgacgcgctcctcccacgacccactccatcccaccctactccgggtcctcctgcggggctgcagccaaggagggcgctggccgggcacatcactcgccaaatcacataaataccccacgagcgaatgacttcctataataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccctccccttagctcgtctctttgaaatttcaaagaaaatccctcctcggagcccggagcccggggctggtagcacctccccagcctcaggaagatgcgggcaggtttacaagcaagggcctactttatggccaggctataaaacgcaaatcccacctccctttgaaagcgccctccgcccgggactcaccataaaaggaagagaagatgcaccccgcgcgcctcgccgcggaccacccccaaaccccttctcccgccagtccccgaactttccgtaacctcggcgtcctcggggtgccggggaccatcccggggaccgccgggaaaggggggcgcggcggagaggatagcgagaggcaaagttggaggccaggcagagagagggcgaggagaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgagtctcatcggaatccgcacctttggagccatttcagaccatctgaacaaggtcttggggtagctggaagagtgtaaatcatcgctcatgggagggaaggacttggcttgggtgacagtcacagagctcagccgtgacgggcggtgctgaggggtggtgaccaagccacgctcagctgggagctttgactggcatacccttctctccagctgagcagaggtcctacccacagcgttcccagggctcttccaggggccagctggggatggcagtgggcggatggaaaaagccgattatttccctggttcaaggccaaggctcaagtttgcaaactctgtgaaaacaaacacaagagtgaatgttcccagtcccagcaggacagaaaacaatcaggagggattcccagagggcggaaccaggcctgggagagaccccagggtgaggtgcccatgcccaggcccaggaggcggactttcccatcggaagcaagggtcggtggtgacgtccatgcctcgtgctggagtgaccgggacgggtgaacccaaacactcagtgggagcatcatttctgcaaatggcattgcagattttcaaacactgcctcatcaaagggcttccagatggccttttgcaaaaccagtgaattgtcaatattcccacaggagacatttgttttgacactgagcatccatctctcccatctcccagaaacggggttttacattttttccggggaactcatctccccttatctcagccctgtggctctgcagggatggtcatgtgcagacctggccagtcagagcactgcatctctttggccactgtgattgggtcagggataggcatgtgacccagttctggccaatagccaccaggctgagaacttcagttcacacaggcgagaaaaacaaggttcatttccactgggcttgaagcacagaggatatcagctgggaagcctgcataagggacatcatggggagcaaactgcctgagaatgaggacacctggaggagaacagggctgagagatgattttgacgattgcatttgaatttagccgtgcccagatccttctcctgccatcagagtcaatgcattccttttcttttcttcctttagacatttgagtttggtcttaggaacttgcaactgaaaaaggcctgggtgggagaaaaaaaaatcctatctcaaaaatgatagaatgggtcttccaggagaatgtgcatctcgccacagaatagggggaagaggcatgagttcgtcactggacgagactctatggtttccctaatgaactaccgcaaatttagtggcttaaaacaagccactaaaataagcatgtttattttcttacagctctggaggtcagaagttctgcaatcaaggagtcgccagctctgtgttccttggggaggctctcagggaagatccagtcccctcttttttcagccactaggagcacccacgttccttggtgtgtggccccttcctccagcttcagagccaccaagttctcatctctctgacccttcttctgccatcctgtttctctgtgaccacagctgggaacagtcctccaacgtttagtgcctctgtggttagactggtcccacctgggtaattcaggaaaacctttccatttcagggtcgctaaccctactcacatccacaaagcccttttacatgtaggtgaatatcacgggccaggggttggatgtggacatttggtttggggtgcattattctgcctacactgtcactcaatagcagacatttattatgcacttgatgtggacttcatatttgttgagggctaacgggtctgtaaaaagtttttaaaatcaagaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaaaaaaaagtttgccttgcaggactgtaggggagcatttggccccttcttttctggggggtcccacaacctcttgagtctgcgcctccttacccaccctcactgctctcactgctgcaccctccatgcggggaacagtgaaaagattccagtccccctgcactgtcgaggactcaagcagcccctgagcagctgggcaggtggcagggctactgagccagtccagccggctccacagcctggctacccttgagcagctctcagaccttaggaagtgacttgaccactcagtgcctcagtttccccatctgcaaaaggaggctgatcataatggtgctcactgctgggactggtgagagaatgagaggggccgatgcatggagactcccatgggtacgtcctggcaggtaggggcgctcaggatcggctacctttgctttcccagctcaggatctgctctgaagtgagtggttggttgtctgtgtgtggttgtgtgtgtggttgtggttgtgggtggtggtggtgtgtgtggggttgtgtgtggttgtggtgatgtgtatgtggctgtgtgtggttgtgggtggtggtggtgtgtgtggggttgtgtgtggttgtggtgatgtgtatgtggctgtgtgtggttgtggttgtctgcatgtgtgtggttgtgtgtgtttgtggctgttgtgtgtgtgactgtgtgtatggttgtgtgtgtggttctggtggtgtgttgtgttttgttgtgtgtgtggttgggtgtgtggctgtggcagtttgtgtgtggttttttttggttgtggtggtgtgtgtgtggttgtgtgtgtggatgtggtggtgtgtatgtttggttgtgtgtgtggatgtgtgtggttgtatctgtgtttttttgtgattgtggtggtgtgtgtggtgtgtgttttggttgtgtgtgtggttgtggtggtgtgtgtgcagtgttttgtttggttgtggtgtgtgtgtgtggttgtggttgggtgtgtgtgtttgtgtgtgtttgtggtggtgtgtgtttgtggtggtgtgtggtgtgcggctttgtggggtttgtgtgtgtggttgtacgtggctgtgtgtgcggttctgtgtgtagttgtggaggtgtgtggttgtggttgtggtgtgtgcttatttgtgtatggttgtgtgtgcatgtatgtggttgtgtatggtgtgtgtggtggtgtgtgatggtgtgtgtggttgtgtgtgtgggaatttgtgtgtgtgtggttgtaagtatctggttgtgcatggtgtgtgctgttgtatgtggtggtgtttagccatgtctcttgtgagattgtcactgcgatcactagtgtgtcaaactatgtacttatgcgtgttacatcatgcttcagcgaagcgctgcaacctactggccttacgccaacactgaccgactgtgcctctaaaccgtcgaccttgggagcgacaactggggggctagagagcgaacacgtgccgcgtctcgtcagaagtccgccgcttcggtagcggggtccaaagcgacgcctatgcagccgctagcttgtcgccgtgtgcctcccctagcatcgctgtcgcgcgcggcatatcgtactcctgcctctcacgcgccgtcaggtccccgttagctcccgcacctccctccccacagagcgacactccggccgtacccaacgacgcacctagcatagccaccccccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagataattgtagattcataagtaatatagagatcccatgtaccttttagccagttttcctaatgataacgtcttgcaaaatgataacacagcctcgtggctagaagactgaccttgatctagcgtcacttttgtttgtttgttttgggtttgtttatttgtttgtttttgagatagggtttcactcctgtcacccaggctggagtgcaatgccatgatccgggctcactgaaacctccgcctcctgggctaaagtgcttctcctgccttagcctcccaagtagctgggactacaggcacatgccaccgtgcctggctagcggctaatttttttttttttttttgtagagacagggtttcgccatgttgcccaggctggtcttgaactcctgggctcaaacaatttgcccaccttggcctcccaaagtgctggaattaaggtgtgagccaccatgcccagcctggcttcacttttaaccacaacactgccttgccacgcaggttaaaaggttgatggtgattcaactccaaaccttaggtccatctgaccacttgtagtgatgctccattatacttaaggccacatatgaaaactttcaggggcgttgagtaagtcacctcaaagacgctttggcttagtgtcccatctgggtctcatccatccaccatctgtcgcacaccatgctcctcaaaccagctgaaacaccacctgccatcccacaggctcatctcaaatggtgactctgaccccaaccctcccatcgagaggaggagcctgtatttcttccccttgaatttgagtgggcttgtgatgacagaagtgatgctatgaggataagatgcttctgaggataagccatagacagtaacaaagcgtcctcctggttcttttgaagatactactcctggaatccagccgccatattgccaggaagcccaagctagcccatgcggagagaccacatggagaggccacgtgagtaggtgctgtggtcaacaaaccagctgaggtcccaacccgcagacagtcagccacaaccaccacatgtgtgagtggagacacctccaggtctgcactctagctactgagtcagccctggacacacacgaatgctcaaagccgaggccccagaccatggagcggagcgaaaacagcccaagcatgccctgtccaagctctggctgctcagaagccatgagtaaaatcacggttgttttatgccattaagtgtagggtgttttcttgtctaacaacaccatcctgcaaacacttcttgagcacctgctctgggccaggcaggatgctaggagcaggatgtcacagtgaacggcccagacacaggtcatgccctgtggcatctccattcttgtgaacacagaagatgaaagatagtcagggttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaacctgctgcccacatgagtgagccatccaggtagcagatcctccagccagatgaagtagcccagccaacactgcatggagctaagatgagcgcccactaccaagttccacccaaactgcagattcataagcaaaataaatgattgttgtttctttaggccactaagtttcagagtagtttgtttttcattaatagataactggaatactctctgcgcagtacaattgtatccaagtgtcctattatgcaatttgtgtcaaaaggttctattagttcgcactggtgaataattacaaccatttttgggcattcaccacttgccagccttcatgctaaatacactctttaaaacttatgagatgcatattatctccatttgacaaattctacagagaacataaatgcagtgaacaccaccaagagacatctactcagcctcccttttcttgaaacaggctctcttcaaccatacagttgcagccagggactgccagtaactgtgttcaaacagtgtggaccagcatccacacaccagccaatgacaccaggaaagggtgtttcacctgagtgggaccagagtttcttccctgggaatcgggaggtggagctacgaggttgtaggcttgatttgacttgaaaagaagacttgaacataggagagacgctggtggcattgccaccccgcggactgagaagcgatgagggtcaggtctgaaccgtgagcggagtgtgtggcaaagacacgcaaagaaaagtgaagcaagaagccaggcccaggtccagccactccgcacctcctgggtttccacgttgggtccccactctctttctgtgggctctgctgttttttatcagttttgaggaaagtgaatctgcttacattccaagagtaacatttgcccaggaccccaccgccgacaagcagtagagccaagatgggaagcccggcctgtgctcctggcctcctgacccctcagtcgctgtgggggtgggtgggcccttttctgcgctttctacaatttaatgaaaattcagcgaagttcaagcatccgcaagaacactcagcttttcctctagcactacaagtgggagccctctctccattcatcctgctgatttttagatacattttagatgaggtagctgacgtccatatcctccacttgtaaatattgaatatgcagaccttcctcaatctccctccataacagaaacaaacaccacacatccccactactcagtgctgacaactcttcctgctttgtccccccttctgaacagcaagagttcgtaaccagcagcagaacagagcagcagaacatactcttcaagaccctatctttacagcattttacgaccgcaaccttaaaacatgcccgggctactgtcgagctgcacgcatgcaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggacatgaaagacaaaggcagggaaaattgtgagcagcacagggaaacgcacataaaataaagcaaacggcctttgaaagccagtgagcgagcgaggcagaggagcacagccccagctttgactgggggagcagcgaacgtcctgtcccttcccttggtggcgaggaaggaagtgaagctacatctcatcccttagcaaaatagtaatgggaaattcggggctctggggtggggtgggagtgggagaaccttccctgctgtctcccctgactgcccggaagatgtggacaagtgaagaagagcagagaaaagggaagacatgctggaagcttctgcacctttgctagaaggctgggatttggcctcttcttttcctggctagcccaagctcttcttctcggctgggcagggctgtctgctgtgattcctttctctgcagggctgggtgacacatgctggcttccaatcacctccaaggcaccctcctctcattgtcaaagtgaaaacccggcacaggtagcctggagctgcccccagggccacccagaccctccacagaggcccctgggtctgagcagcaataccccctggccgcctcaaagcaggtggccctcctgggctctgggcttaggtctgacgtgctccggagtctcccggcctctccccctgcttccggcaggtgaccagagagcaatgaggctcctgggggcatttgagtgaaggggcgggagtcaccccctgcacctctgggtggaagcaaaaagccctcgtgcagggaagcgtgggggcagaggggagggcagagggccctgctaaaaccccaagccgccctggagtcccttctttcagctccatctccctccctaatctgatgactgactgttaatgttatggagtctgacgtgccaggctgtgtcctagccagacccatggactcacacgctccctctggcaaccacagacagcagtgccattactgtcccatttcacagttgagaacactaaggtccaagacgaaaactcaggatcacactgctgggaagagaaaggccaaaatagaagcccactccatctggctgcatagcccacgccagggtggtgattcacacactcttaagggtgggctacaggctgggcacctgcccatcgcatcctgagtcagggagcagtgagggaagcaggcccagctgtcctggcgacccatgtctttctgcagaacggggaattctccaatgttggtgctgagtcatcagggctgcggatggagacccggactgcagctcaggtaggcccacaagccctactctctaaaacaatgcaatcgaatataagacccagaaatgccagggaaagagtctgcttatcttgtgtgttcccgagcagtagtagtgacaatgtcaatcctgacctttcatgcagctgaggggtgcttatgatcacctgcagccgagccttcgtttccaaggacaaggctctgtgctgaaaaccaagctcctctcccttgctcaagagccctctcaccctaccccaccagctcaaagaaatcactagcattaccatttaggaatggaaatcagaggcctacatacggctgcccaggaagcagccctggaagaagatggcttcccaggaggctggcttgctgcattctctttctccagagtcttctccctgctctgctgtgctcaccactgcaccacctaccacctctccttctcagacctgcttggggccccatctccctgctacaggccttcccagcaccttcccagaaatgtagacatttctctacaagcaaagggagttagttaagtcctcataggaaatgcagggccgtgctgtttaaacatccttgtttataatgaggatggcgccctggcctgatcgtctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcctcggctggggaagaattgagttagttaagtcaattatggttattcacttccctttgccggtgattggctttggaatgggcacgtgacatcattctgaccaatgagaggacgtctgctgtgaggcaggctctcctgagaaagaactctgctgcacttaaaggggccagtgatggacattctacctttggacctgtgggtgctgctggttgaggtgatgatacttgggggtgctgcagccaccttgccacgttgagtagacaaagctgaggtcaaggccaacctgccaaggatgccaagagatgatgggaagaaccagttcccaagtggtcactgacccactgaggttatcaacctgggtttgtctatttctggacttttggtaatatgagctaataaatatccaagtgggtaagcctttttgagctgggcgttttttctcatggaggcagcttcctgttatagggggcagtgaagaagtcagagttcatggctgaaagcacaggatgcagacttagacagacctgagttcaggtccttgctctgccacctacttgctgtgtgaccttgggcttagcttctctgaccttgagtttcttcatctgcctccaaataagggagagccctggcagaatcatgggaggaacagcgtgtggagccctcagcacagagcccagcccagtgagcagtcaataaatgttagctctcccaaagttggcaaccagtctgaaagacttcatgcccagtctcacagcagagctccgtagcccaggatcttccaagcacacgttgctcgtagccatgaagaaataaaaacaacccatgtttggcccaatcttctacacattagggcttttgagcctttcctagggataccaattatgcagcattttgtgctaggtggatctgggattgttttaagctctctttcaaatgaaagcaacagtcttttttaaaaagtaaaaataaaatggactcatcacccaacagtaatgcacatgtatgttcatcaaagaaaatatagagggatccaccgctgtatgattggtaccagcctgttatggggttgaattttgtcccccacccaaaaagctgcggtaagtcctgaccccaggaccttggaattggccttatttggatggagggtctttccagaagtaacaaagctgaagtgaggtcagtagggtagaccctagtcctcatcagaagggagaacttggacacaaagaaacccacaaagggaaggcgatgtgaagacacagaaagaaacgcccacctacaagccacagagtgaggcctggaacacgtcctccctccccacacagcctcagagggaaccagccctgctgttgctatgatctcagatttgcagcctccagagccatgagataatacgtgtccgtgctttaagccgcccagtctgtggcactttgttatggtagcctgagcagactaacacaggccccaggctggacacaacacaaatgcccgtcaggaggtgcgcaggtaagtaagtggcggtgaatttatacaaggcagccgtgaaaccgaactacctccaactagaggcaacatggaaaattctcagacatgaagtccagccaagaaaccagaggcaggagtccatcctgcaggagtccacccactgagataaaattaacacgtgggcaaaaccaactgagggtgccagaaggcagaatagtggggaccccgggggccagtgatggcagggagctcgggggcttctggggagctcgggggcttctggggagctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcactatggacgtgcggtttgtacactaaacggggaagcaatggtcaaactatcaacatttcaatgctataccattgaccctaataggaactgtcttagacagcttgcccacgtgactttattacaccaaatacctgaagccatctaaaatgctagccacataaatacatggatgccagtccctccgtacgatgtaatataatgcggcattaaaaaggaaaagggaaattttaaaaaagaaaggagcaaggtgcagaactacggaaacaatgttaccacgggaggaaggaagacagaatacatgtgtatgtccttgtgtgtaggtatcaatatatagatactatgatggttcgtttcatgtgtcaacttaactggactaagggattcccagatagctggttaacattctttctaggtgtgtctgtgagattgtttctggaaaagattgtcatttgagttgttagattgagcaaagaaggtctgctcttgctagcgtgggtggcatcatccagtgtgtgggaagtccaaatggagcacagaggcggagaaggggcgaagttactcgccctgtgtgatctggaacatccatcctctccggcctgcaggcatcagagctcctgggccgccggcctttggacccggatcaagacttacactacctgcccctgcttctcaggccttcggacttgcaccaaatgactctacaagcttttctggttctccaacttgtaggcagtagatcataaggcttcttggcctccatagtctcataaactacttcctataataaataagtaaatattatatgtatgtgtatataaatatatgtgtgtgtattggttctgtttctctggagaaacctaatagagatacacttatgtgtttatcttcataaaggagacggaatatatttacacacatagattatatatatataatagacacctacttgcctatactcatatccaccatttaacccttttcccatttgcactgagaatacccgccagcagcacttgcctatacttacatctgccatttaacccttttcccatttgcactgagaatacccgccagcagcacttgtgggttggtgcagcattcaccccaagataactttgtcacgaaatatctcacttttattatcattttcacatcgctctagtatatcgacgttggaaacaaagacatcgttctatttacagcattctgtttttagccgtgaccattccatttgcaaaatatagtaattctcgatcactggaaatgtcgtatcctagaacacgtagcatttccatgtgtgatgttaacattgttcttgaacagttattggctgaggattcactcgatgaatctgatttttctgaagtagacaattctgatgattcagatgattctgatgttcattctgtttagaaataactccctgaggccaggcgcgggggctcacgcctggaatcccagcactgtgggaggccaaggtgggtggatcacttgaggtcaggaggttgagaccagcctggccaacatggtgaaaacccatctctactaaaaataaaaaaattagccaggcttggttgccagcacctgtagtcctagctactcgggaggctgaggcacgagaatcacttgaacctgggaggcagaggttgcagtgagccaagttcaagccactgcactccagcctgggcaaaatgagatgctagctgaaaaataaataaataaataaaaactccctggacaggttttatattttatttccccatggaaaatcagacagacttgcttcagcctcaaagagtgtgtttatgtaaaattcagtgagtgctggcagtgagctgcacttttttttctaaacaggaaaagtgtttaacacatgcatgtataggcctaaaatagctctgtagagatacccaagcaattgaaccaatgtccagttgcttctgagtaggggaacgtagtggctggaggtcaagagtgagtaggagaaagacttatgttttacaatatattctttggtactgataaatttggtactatatgcatatattccctttacataaagataaataaagttatttgtttatgtccattgcccggactcctctccagacctactgaagcaggctcttcaagcatccagcccaggcatccgtttttttaacacacctgttcttgttctcctgacacactccctcgttgagaatctctgccctcgggctctgcacttctgatatagattaacatgcatttacagcgtgggcaagtggctatgctttgtctcccaaactacctaagcttttgagggcaaggactgaattttttacatttatgcatggaagatgggaaaatgttgaatatattcacttcaataaatgccaagaatacagcagtaccatagcctgatactcaaactactgcttggaccaactgtggtagataaaaaatgactacacattctttgctccctctcccattgagaggtggaattaaattccctttctcttgaacatgagctggccttggtgatgatttgcttgatccatagaataaagtagaaggaatgctctgagccttctgggactatgggataagaagcttgcagctttcactcgggcctcctggaacactcactctgggagaagcagctaccgtgaaacaagtcagtctatcctgagccaccatgctgtgaggaagcccagaagctctgtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtctgcagcttcactacctgagcccagcacgaccacgacccaccggaggaacgaacaactccagacgcactgccttaagagctgtaacactcaccgtgaaggtctgcagcttcactcctgagccagcgagaccacgaacccaccagaaggaagaaactctgaacacatctgaacatcagaagggacagactccagacacgccacctgaagagctgtaacactcaccgcgaggtccatggcttcattcttgaagtcagtgagaccaagaacccaccaattctggacacacttggaccaatgaaactgcgggggccatgttgtggcattggatgggacactgcccttatcgggtctcctttccaggatggtcactctggcagggagagagttggatggattggagagattagggaggacacacacacacacacacacacactcttaaactgtttctaattatttgctcttggttgggatgaaaaagataccgtgtctgttgacttgtgaatgtgggggcattcctgaagagggagggaggagagagacagaaagagagacgaagaggaagggaggggggagagatggaaggactcatgagtgactgtcacaggcaggaccccccaagcatttgcaaatcctagctcacctattgccctcctattttaaaactccttactcctaaattcttaacaagaacctgttaccaaagaataccattttaactccacctaggctgagtgacagcacagcacaggggtcaggaccaaggcttacagagcagcccaaccacctgcccctaggctccaaatctgaatcctggattcagaatattcaggtgtgtatgcaaagaaggaaaggcaacttctgtgactgagctacaggaaatggaaagaaggaagccccccctccccacggaagtagctcacccatatgctagaaaagaaaaccaaattctatctggaactgaatctgatcagattggattttcctcttttggcaagtgggggcttggcattgcagagagaggtggaagagagaggagggaaacggtgccccggacgattttcttttccctcctgtaagctgagcttccggagtcacccccactcacctgtcatgggcagcacccggaagctgccgctatcgggctggtcaaagctactggggacatgcaggattcattctgctttcattaaggacccctaagcatcctggcccagccagacaggaagatgcaaaagaaaaaaaatccgaggacaatgaagcagtgagtgaatcggttgtgttaatctagggaagaagccggtccactaccctccccaccttggccagaactgggtaacgcagagacctgagtcacgggaagagggtgcaagatgccccttggagggcacggccctgggtcctcattggcagccggttgcacggagtctctactcgtctctcccaggcgtggaaaaggcctcccggaatatctgcagctccaaagatcatgacttcaacctctgatgaaaagacaactccaacttcattttggggcttactgttgtctccttgtcgtggaagtattttttaaccttaggaaagtttagaattatatgtggaacagaggcaactattgaaatcatagtatcatgtcatgttacctataagaacagctctatggccaggcgtggcgactcacgcctgcaatcccaacactttggaggccaacataggaggatcgtgtgagcccaggagttagagaccagcctgagcaacatagtgagaccccgtccctaaaaataagatacaaaaacttggcctggcctggtggtgcacgcctgtggtttcagcttctcaggaggctgagatgggaggatcacctgagcccagaaagttgaggctgcagtgagccataattgcaccactacagtccagcctgagcgaagagtgggatcctgtctcttaaaagaaaaataaggccaggtgtggtggctcatgcctataatcccagcactttgggaggctgaggtgagatcacctgaggtcaggagtttgagaccagcctggccaacatggcgatactccatctctactaaaatacaaaaattatctgggcatggtggtgggcgcctgtaataccagctactcgggaggctgaggcagaagaatcatttgaacccgggaggcggaggttgccatgagctgagatcatgccattgtattccagcctgggcaaaagagcgagactctgtctcaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagttctctgtgttgacgtgggtgctggttgtacagatgcaggcaggttatcaaatcttattatctcaacagatattcttaagaggcagcagatacccactggaatccctcgaagcctggcagccccccacggagcagagggggccctgtgcatgagggtgggtagtctctgagcacctcccctcctgccacgagcccctcggtgcctcagtatcctcagacactggttaagcgcacccactgtgatgatgaaaggtgacttttactctgtcagtctccttttcagcctcaaaatcaccaacttctcatcattaaaactgagagagagagagagagagagagaacaccaaagcctcaccgtggaaacacatgaacacgaatgagcaggtttgcttccaaattagaccacatcccagtgtggccagggacccagcccccttctgtgatggacacgcgtgccctttccccactctttcttgaaaatgactgtccttgatgtacaccgtctttccctgttgtgaagatgtgggttgaagcaggttcgaggaggctgagtgagaagcccagtgctacggtttgagtgtttgtctcctctagcatagaaacttaattcccgatgtggcagaagtgataggtgggggctttaagaggtgattgggccaagagggctccgcctcatgaatggattaatctgctcagggattgatgggttatggtggcagtgggactggtggctttataagaaaagagagaaagctaagccggcacactcagtccctcgccataggatgtcctacgccaccttgggacaccatagaggccccaccagcaggaaggacctcaccaggcttgcccctccaaccttagacttctcagtctccataactgtaagagacaaattcctttttaaaaataaattagccagtttcatgtattctcttataagcagcagaaaaatgaccaagaccctcaggatcctacacttggcagcagccaagcccacgctgggtcctgggtccttccacgcagctgacagcccttggctgtgctgccaatgcctgcacacaccttggctttgactactgtgttcgttcattttatgttgctgtaaaggaatacctgaggctggacaattaataaagaaaagaggtttaattgactcacggttctgcaggctgtagcggaagcatgccatctactgccatctgcttctggtgaggcctcagggagctgccaatcatggcggaaggtgaaggggagccagtgcatcacacggcaagagcaggagcaagagaggtgccaggctccttcaaacaaccagctctccagtgaactaacagagcaagatctcactcatctccaagggtagggccaagccattcgtgagggacgcacccccatgacccaaacacttcccaccaggccccactaacaaccctgggcatcacagctcaacatgagatttggaggagactcatccaaaccatatcaagtaccctcctctcccagctgcctgcagcctccctcctttacagttttggcagggccaagcagtgtcagaaaagctcctgggactctggaaggggagcagagggaaggctgggtggcggggtgctggatgctccaggaggtagtagaactggcttcaggtcgggccatagacattgattcatttagaaaaatgtgctagtccatggcttgcaggctcgctcccaagacattctggggatctgttctttaaaaacattttctctatcttccttgccataaaccttcaggttaagaaaaagagagaacaccgcctttggtttgcttcttacaataattccatgtgatcagtggaatcagttatttctattcctatttcagagtctcactctgttgcccaggctggagtgcagtggcacgatctcggctcactgcaacctctgcctcccaagttcaagcaattctcctgcctcagcctcccgagtagctgggactacaggcgcctgctaccacgcccggctaattttttgtatttttagtagagacaggatttcaccatgttagccaggatggtctcaatctcctgacctcaggtgatccctcccggctaggcctcccaaagtgctgggattacaggtgtgagccaccgcatctggcatacaatttaaaggttacaaaggaaaaggagaaagagaagaaaagagcactgtcatcctcagacatataactaagaagcctggagaagatcccaggctctgacaaggacacttgtctttctgaccataaaaccacttctgtttcttgagcacttactaggggccaggcactgggctaaggaagccctagggggcatccacactgccaggcaggttgtattatcctcccattttatggacagttcaactgaggtttagaaggattaagtaagttgctggaggtcacgcagccagaaaatagcagatccaagactcctgcatggcagtaagatgcctgggccctcgggggagcttgtcaggctggtccaaagccatccagcccactgttctgtgattccccatcaaaggtgagtgatgtggtttgggtctgtgtcctcacccaaatctcatgttgattgataatccccagtgttggggagggacctggtaggagataattggatcatggggggcggattttccccttggtgttcacatgatggtgagtaccagttgtttaaaagtgcatagcacctcccctttgagcgctctctctcgctctgtctctctcctgccatcatgtcagatgtgcctgcctccccttcgccttctgccatgattgtaagtntccctgagggctcccagccgtgcttcctgtacagcctgcagaacggtgagntcagtaaacttttttctttataaagtactcagtctccgataattctttatagcaatgcangaaataatgaatacagtgaggcttggcttaaaaggcacaaagtccatantaaaggaccntnctcaaggggaaccttttcaagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccggcaccgttctaagtgtttactcataccaactcatctaatctgtgcaaacacactatgaggtagatgctgttatcattcccattatacagacaaagataccaacgctcagagaggtccaataacttgctcaaaaccacccagataacctgggatttgaacccagcacccagcatttatgcgcttagccgctatgtgttagtgcccgtctgctgaaagatgcctgcacaggctcggggtgccctggcactacagccatggccaacaagaggtgtgaggagtgagagagggagccaaggtggaggctggacagccttcgatggagacagagctatgtgtgtcccccagggtccggagctgattctgtcttcctctgattcctgccttgaaagggtgtgtggtggattatataactggatcccagctcctccagccctctccccctccctggcttctccgtgggtagaatgcacctcccactccattgcccctggactgcccaggggatggaccttggcggatggaatgcaggcaccaggacagtgcgctatcccaccccccccagggagtggctgctccttcagtgtgggttctgggcctgtttcagcttgataagcccctcagggtctgaaaccaagccagctcaagtgcagccaacccacagagctgtgagcaagaaataaattctttttggtgttttgttttgtttttgagacagagtcttgctctgtcacctagccggagtgcatggcgtgatctcggctcactgtgtcctgggttcaagcgattctcctgcctcagcctcctgagtacctgggattacaggtgtgcgccaccacgtccagctatttttgtgtttttagtagagacggggcttcaccatgttggtcaggctggtctcaaactcctgaactcaaatgatctgcccgcctcggcctcccaaactactgggatgacaggcgtgagcactgagcccaaccataaattcttttggtttcaagctcctgatagttgtgggttactgctatgaagcagtgtcgcaggataaacccgctgagtccagggaggccacacgtcagcttgcatcacgggactcctgggaaagaaaaccaacctaaaacgacagactgctgcgcagtagaacctgtttggttcttctgaccaaagcaggccatacccagtatgatctccacgccaagactcgcccaaaactcatcggggctaacagatgagccacctgtgaagacaccaaggcaggccgtgggccggtcgcagagtttctgtaaagccttcgccaccgccatcgccatcggggatgatctccactccgtccgccctgtcacagtggtgccagatttcagccgccagcttcggttcttacgagcgggctctgacgggctcatgcttggccacagcagctggtcagtgtttgaatattaataggacatgggttctcatatttgatccactgtaaaatgcctctcccacccttgcccttttgcaaagccacctctctgagtcagtaattaatttaaaggattcacaataagaggaaaaatcatacatgcccgtaggggcaggcaagcaacgtaaacagatgaaggaaccggatggtggtttctgcacagacaccctccgtctgcgtattaaacacgcaggaatactcttcccttccacagagaaagaactttgctgtctcgcatttttctggtaacacctagctgtctcgaactgcatctctttttctcgttgttgatagaaacagggacataaagaaagcttcttctcttctaagaggagctgcggccgaagcacaaggatgaacagctgcggatactcggctttggtgccaggaagaccgcggggcgtggcggggaccgggccctgcgaatggagcagctgagactcagctccgcggaatgacacaagcctggggctgccagctcttcccatttttcaaaagaagctggaaatgggttttcgtttaaaataccctggttttcgaatcttggcctgacatgtttttaaacaccgtatgagccaagcaaaacacatctgcagtttgtattcagcgccacgggccgtgggatttgggacctcttctggggagtctaacaaaggcactttacgtcccagcgttgctatttcctggctaaacgaccttgggctacaaacaaaaggctccaggcttcggtatcatcccgtggagagtgacggtgcctgcttcgcgcagtctgtctgagaatcaagtgagatgagagacacaaagtatctaaaaatctacttttctaccggtgcactttcaggtttattcaaattacagagaatgccaggcgtgattctccagcgagtctatgaaaacaagaaaagaaaagctagcacttctaatgtgtgcgccgagacacaatgacaggcttgatgtttctctgtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttcctgccctttgtctttcattgtccaaactccagagattcacggggacagattaaactttcttccgaggtgagatcaaaggctctgtgagaggcctgcttgtctttttctggcaaagcaaacttccccacatctgttctggccggctccactaggaaaaaaaaagctatcagggtgctgcagaagtcaggacaacttcccagggatgattctcacgtcccgccctggatgtcacagtttagctacagaaaccgagtggcccaaatatctggaggctgaagataaattgacaaagaggcgggccgcgcacgctctcacgcttcggcagctcagatacctgttacctggcgttaattgcatttacagcgggagagagagcttgggctctcaccaggtaccaattgcacgtgtgtgtttaactttttatggagacttttattaacttttcattctggaaatgcatgcatatcctccctgtgcagcttgaaaaatgttcacagcgtgaacgcccgtgtcaccagcgctcagctcaacacacagaagatcacccatcctcaggaagctgcttctgtgccccagcttgtttactgagtgtttgcataaaatattcactgattcatgagtgtgggtcagtaataaaagccactccacgttgttattccaaagaggagtgagtttatccccaagattagttctagagtccctggaaggagagagagagagagagagagagggagagagtttgagaaaaaagaagagagctttctctctttctgtctctcaagtcaaggacacagacctggtagaaaaggccttgctttttcaattacccaggttcttggtgcccacacgaggagtaaatgctattgttttgactttctccacccgacaggccagtcgccacaggaaggaggagaagcccagcccagctggctgctcaatgtggcaccttcatcgtctgcctactggctcactcacctcctcctgctacctttgatctgggtggcgcttctgctctcagccagggaaatgatagtgtggttaagcagcactgttaggggcctgggtcccgggctgggaccaacctccccacacccagagggtgctttcctcctagctcgggccctgatatacaccaggtctacaaaagtacggcgttgagccgtgtcgatccaggtgatgctttaaatattttccagcaaggctgtgaacggtaaaaagagaattcagaagctggctgagagctggcctgggcagctggcatcaacgtgtgcccaccttgtgccaggctctttaagtgcatgatggcacttcccctcacgttgactccgtaaggaaggcaggatcacaccagctggagatgatgagaatcttgaggctccgagaggtggcggggacctcgttagcatgacacagctgcaggtgaccaggaagcccacaaaaagctgctcagcatcatcagagaagtggaaatgaaaaccaccctgaggcagtggaagcaattgaaggcccaccactgacgcgtggacagatcggccgcactccatccgtccagtggcgtaagactcagccataaagaggggcgaggcgctggcacaggctaaagcacggaggagcctcggaaacacgacgctgcgcggaagaagccacgcacacacggccgtgtattgcgtgattccacggatgtgacacgtccagaacaggcaagtcctcgcgaacagaaagcacactagtgtttgccgggggctggtgggtggggcaatggggagtgactgcttacaaggtgtgggatttccttttggggatatgaagatgttttggaactaaatagaaatgatggttgaccaacatggtggatgtcctcaatgccactgaatcatacacttttaaatggttaattttctgctgtgtaaattctatctcagtaaaaacatatgtaaatcaaaaagagagagagaaaaaaccatactgcgatgccctttgacacactagaatggctaaaatgcaaaaggctgacagcaccaaaggccggtgggaggcggggccggtgggaggcgggaaagagagcttgggctctcaccaggtaccaattgcacggggaggctgtgctcacacatgcctggcaggagtggaaaatccgtaagtgctgtaccaggtcatcagggctaccgtcaaaaaggaccacaggctgggcagctgaaacaacagacattcattctctcacagttctggaggctggacgtccaaagtcaagggcgacttcccctgaggcctctcgcgtgacttgcagatgaagtctgctccctgtgtcctcacgttgccgcccctctgtgcgtgtctgcatcctcatctcctctttaaaaagacaatttatggattgtctttttaaagacaatttatggattgtcctatgggataagggcacaacctaagacctcattttaacttaattacctctataaagaccctatccccaaatatggtcagattctgagatactggaaattaggacttcaacatctgaattttgagggaacccaattcagtccatagcagccactttgagaaatcgcttgccaagtcaaacgcatacttaccatacaacctatcggttccactcctggtattgatcccaagagaaatgaaacatatcaccaaagacttatacatgaatgttcaaagcagttttatttacaatagtcccaaactggggaccaccccaatgtccagcagctgctgaatggacataactcgtggtatgcgcatacaagggaacagagctcagaagttaaaaaggaatgaacgactgcttcactccaaaacacaggtgaatcccaaagacaccgtgttaagaaagccaggctcacaagaattcatgcagtatgactctatttttatgaacttctgggacaggcaaaactaatctagtgacagacgttagaatgatagctgccggctgggcgccgtggctcacgcctgtaatcccagcactttgggaggccaaggcaggtggatcgctttgaggtcaggagttcaagactagcctggccaacatggtgaaaccctatctttactaaaaatacaaaaattagctgggcatggtggtgagcatctgtaatcccagctacttgggaggctgaggcatgagaatctcttgaattcgggaggcagaggttgcagtgagccaagatcacaccactgcactccagcctgggcaacagagtgagattccatctcaaaaaaaaaaaaaaaaaaaaaagtgatgactgccaggggtggtacattgattgggatagggcaaaacggagcttcctggattgatgaaaacgttccgcgtctcatagggtgttggtgacatgaatatatacagatttcacaactaataaggcggaggcaggaacatcacttgaggccaggagttcaagatcagcctgggcaatatagtgggacccccatctctacaaaaaaaaaaaaaaaaaaattatcaattagctgggcatggtggaatgtgcctgcagtcccagctactccggaggctgagatgggaggatccttgagcctaggagttccaggctgcagtcagctatgatcacgccactgcactccagcctaggcaacagagtgagacccctttccaaaaaaacaaaaaccaaaacaaaacaaaaaaccgggttatgtagcgggtaagaggtaaaattcagttctgtctgccaaaaaactcatagtttgtgtccttttttggtccttttaaagcttgttttcctgaaacaaaatattaggcaccatgactatcatttttcaaaatatttctcactgtatcaggtcattttcatgctgctgataaagacataacggggactgggcaattttacaaagaaagaggttttattgggctcccagttccattttgctgaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcgagcttctagagatatcccctgttttgtcagggcgctgattggtgcgtttacaatccctgagctagatacaaaggttctccatgtccccatcagattagttagatacagagtttccacacacaggttctccaaggccccaccagagcagctagatacagtgttgattcctgcatttacaaaccttgagctaaacacagggtgctaattggtgtgtttacaaaccttgagctagatacagagtgccgattggtgtatttacaatccttgagctagacataaaggttctccacgtcctcaccagagcagctagatacagagtgtcgactggtgcactcacaaaccttgagctaaacacagggtgctgattggtgtgtttacaatccctgagctagatataatgactctccacgtccccaccagactcaagagcccagctggcttcacctagtggatcccgcaccggggctgcaggtggagttgcctgccagtcctgccccctgccctcgcattcctcagcccttgggtggtcgacgggactgggcgccgtggagcagggggtggcactcgtcggggaggctcgggctgcacaggagcccatggagtgggtgggaggctcaggcatggcgggctgcaggtcccaagccctgccgcgtgggaaggcagctaaggcccggcgagaaatcgagcgcagcgccggtgggccagcactgctgggggactcagtacaccctccgcagccactggcccgggtgctaagtccctcatatgcccggcgacagcagggctggctggctgctccgagtgcggggcccaccaagcccacccccacccggaactccagctggcccgcaagcgccacacgcagccccggttcccgctcgtgcttcttcctccacacctccctgcaagctgagggagtgggctccggccttggccagcccagaaaggggctcccacagtgcagtggaggactgaagggctcctcaaatgccaccaaagtgggagcccaggcaggggaggtgccgagagcaagcgagggctctgaggactgccagcacgctgtcacctctcacaagctagggtttcccaacctcagcactatggacatgtaggctggatcattttttggttgtggggctgtcttgtgcattataggacattaacagaatagaatccctgtcctctacccattagatgccatagcaacctctcccccaagttgtgacaatcaaaaatgtcttcagacattgcccagtctggcaaggagagtgggagttggttgcctgtagtccagtgtcacaggtagagtgggagttggttgcctgtagtccagtgtcacaggtggagtgggagttggttgcctgtagcccagaaccactgatctattggttgctaaatcagtaggcctctgtaattctggcactttgggaggccaaggtgggaggatcgcttaagaccaggagtttaagaccagcctaagcaatatagtgagacctcatccctacaaaaatataacaagctagccaagtgtggtggtgtggatctgtagtcccagctactcaagagagaggctgagatgagaggatcgcttgagctgcggaggtgaaggcttcagtgagccaggatcgggccactgcactctagtctgggtgacagagtgacaccctgcatcaaaatccaatcaatcaataatttatcaatcaacatgggggtgcaaaataaatcataaataaataagagaacaggtacaaaataatatgcaatacacttattatgagcaagagggagctctgtatgaatacatgcagtcatatgcttggaatatttccacaagtctatgtaaggatctggtagtctttgagaggagaaagagcgatgaaaagtttggagagagtcactttcttttcactgtctgctttttgtataaatcaattgttcttacaccatgggcttatattctttttttttttttaagagacagggtttcactctgtcacccaggctggaatgcagtggtgatgggatcacagctcactgaagcctcaacctcctgggctcaagtgatcctcccacctcagcctactgagtagctgggactacaggcgtttgccaccatgctcagctaatttttatttttaaagtttttgtaggctgggtgaggtggctcatgtctataatcccagcactttgggaggctgaggtgggcagatcacctgagggcagaagtttcagaccagcctggtcaacatggagaaaccccttctctactaaaaacacaaaagttagtgggcatggtggtgggcacctgtaatcccaggctgaggcaggagaccgaggcagaagaatcgcctgaacctgggaggcggaggttgcagtgagccaagattacgccactgtactccagccttagtaacacagtgagactgtctcaaaaacaaacaaaaaaaagtttttgtagagatggggtctcactatattgtccaggctgatcacaaactcctgggctggagcagtcttcctgccgcagcctccaagtagctgggattacaggcatgagccaccatacccagcactgcatcattttaaaaggaaagtttcctttaaccttctctccagatacccgccctctaagccaaagctggctgatcacattaatttgaaattatattttataactttggttaaattacagtttacaaaattttgttctttgcaaattaatttcaaagattttcatttccaaggagctaatgtcctctataatttaatgagattgattattgtatttttaaaaaagtatttacttatttttaagtgacaaatacaagttatgtttatcatgtacaagattgataattataatttaaccaaagagctgatgactgtttcaccggtcttctctcctaattgcacatatgtgaataagttcttgctaaaaattccttgaatgtatgtttccggaagagtgttaaattgaatggaagctcctgaggccctggaacctcatctcccgtccatgtcaatgctcaagcggagctgggctgccttacagttcctcagtgtggagcttcccctcccatattccaaccaaggatttggtgaacaatgcgtgtgaggagtccaactagggctctgtttctttctttctttgtttgtttgttttttgagacggagtcttgctctgtcgcccaggctggagtgcagtggcgcgatctcggctcactgcaagctccgcctcccaggtgcaagcaattctcctgcctcagcctcatgagtagctgggattacaggcgctcgctaccacacccagctaatttttgtatttttagtagagacaggatttcaccatgttggccgggatggtctcaatctcctgaccttgtgatccacccgcctcggcctcccaaagtgctgggattacaggcgtgggtgcccgacatagctagggctcttaatacagaaccagaaaggccatggataacctgtctaaccttgtggataggatggccgaggggacacttgtcattcttggcaggtcagcatctatttcctcttggtaacagccccctagtttctttttggggacccacggctccatcatagtatacggctctatggctgggtcattcctgctgccgacttcccactctggtccttaaaggagctagatcctccctctccccgcaagacccaggaggatgctggtgaggatgccctttcactgtggatcttgaataaataacacgggcatataagggaatgggaaggctgccgatggccaggaaggcacctgtgcataggtgacagtgtcctatacaggtattaaatgatgctgtcacctgtccaggtgagaggcagcctcttcctcctcgtcagcatcctgaacctcccttagtcctttcatatcttgtcgatttcagggcctccaaatccttcctggttgtcttcagctgccttcccagagtcaggtctgtggcttgcccctatctgcagtggatggacagtgtttatgggctcatgatcagaagacagtgaaaaggccacaaggaacggaaaagcaaagtggacacgaagacaggtgcatgctcggatggcctgggcttgcccctggagttccgttccgcggggcctctgattggccgccctccttgcctggaaacaccaccagctagccgaatcccttccctggggaggtgtaaggaccatcacacgggcttccgaggaagatgcccaggttcagatcccagctctgccatttaccaactgagcgattttagaaaagccacatcacttctcttttcctcagttttctcatctgtaaaatgggaaaaataatagtacctgccttctaaggtagctatgagaattacatgaattaatacccacacatttccccagcacaaagtaagcattgtataataattattattattacactggtaaaatatttgggatgtgtctggtacatctttaccttcagtatattttatgattctgattattatcatcatcatgatcgccaccattaccattagctccgaggcaaggcccgtgacggtgttgctttatttgcatcactgatcactcatatattttgttttttccatctcaacagattcccttgtcagatgagtcagatgactcataactcatttcacagagaaaacatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagttctgaggcagaaactacaccatcacaagtagactctacttcgcccgaactcacgtggtgtattagtcactatttataatatacttctggagatgaatctgcttgtcacccaggctgcaggagtgagtccatctcagtaccgtaaccacatctacccagttcaagctattctccagcctcagatcctgagagctgggattacagcatgcgccaccacgcctggctaattgttgtatttttagcagagacagagtttcagcatgtaggccaggctggtctcgaactcctggcctgaagtgatccacccgcttcggcctcccaaagtgatgggattacaggtgtgagccaccgtgcctggccccatattttgttttctaaacagactgtgacaaacttgagagcaggccctgggcccctggtgaccttccagtggggaccgcagaccccagcccgcaccgcccttgctctggctctgagatggccgtgtgtttcggaggagagggatgacctgcagctggtagggccccaggccaagcccggcctctggtgcctctgctccagggtcagcagcccccatggggaggtcaagggtctgccctgcccttgggccagcccagggggcatgccaagctcctcctggcctctctgcaggggctctgtcaggcctccctgctctttgaagccacagcctcaaccctgcagctctggagaaaggctgggcaggtcagtgaggggaagcctgagccggctcatgctccaagatagtgtgaatgagacacacagcccaggccgcctctgtatggcaggcccggagccctgcccatctgcccagctcgcagacgagccgagtgaacccctagaagcacccaatggtaccctccactgtggagagctggccgtagaacagtgtttgtccccagggaccttcctgcaggcagttgctgaagtctcagcctattcacccaataagtgtttggggagcccctcctgcctgccggggacaggctaggttctgggtgcagctcggagccacacaacatcctacccacggaccttccagcccagtgagcggaatcctgaccctgcctccagctagacctgcagatagttccatgccccaagtcccgggcaggggtcctgacagcatctaccgtctaagagtgggacagacggcagagggggcttgcgggaggcggcgtggccagagcctgctgcctgccgcatccacgcaggcttctatgagcaaatgctttctcaggcaaacgaaacagactcctccaggctgaagctgaagccggaagatgagcaggcgttgtgcgcagctgcccaggaatgagggaggagggtctgggcatgggaactggagggagagagggagggcaggcagtcacggccgacacggagggcacacagcccacctgcccgccaccgccctaaactctgtgcacacatcggccatttcagtccaggccctgcgtggtcggcccaattgttgcccccacgttgcagacgaagaaactgagccctgagaggctgagaaacctccttcgggtcacagagcttgtgggtggcaatcgggtttctagccctggcattctgccaccagagctttctgtatctattataaagtaagatataatccacaagccacaaaattcaccagtttaatatgtaaaaatttcatggtgtgtttttttttttttttgtttgtttgttttttttttttttgagaaggagtttcgctcttgccgcccaagctggagtgcaaggcgtgatctcggctcactgcaacctccgcctccttggttcaagcgattctcccgcctcagcctcctgagtagctgggattacagacatgtgccaccatgcctggttaattttttgtatttttagtagaaacggcggggtttcaccatgttagccaggctgatctcgaactcctcatggttcttaaaatattcacgggtctggtgattatgggcactaccaaactttagaacatttccatcacccccaaaagaaaccacgtaccgactgagcagtcactccccacgtccccgtcccctcacccagcccgtggcacgcagtcctctccttccagtctgcacaggctttcctcctctggacactttacacacatggactcaggccatgtggctttccgtgtctggcttctgtctccaagcatgttttcccggctcctccaggctgttgcttgtgttggtgacgcattctttttcgtggctgaatcatattccgtcacatgtgtacaccacgtttattcatccaggcatccattgaaggactttggggctgtttccacattctggctcctggaaatggtgctgctgtgaacatccctctgtgtgtgcatctgggtgaggaaacgcgctttcatttctcttgggtggactggtcaggtcatggggttcttctgagtttgaccttttgagaaaccaccagactgttccacacagcaaacacccgtcctttcatgggcactcctctgtatgaccccaacagatgccgccaaggaggcaccgttagcattggggctgatggacaccatgccaccagatcccaccggttgtggacacagtcctattccccagctgacctgacagtggaggccttgaggctgagtcacccctacagtcttccctgccccaaggttgtgctgctctgcagggacggcaggcctctgggggcatgtaggtgcatcccctctcctcagcgtcagaggactctgcagggcccggtgtcagggactctgggggttgctgctgcttccatggggctgcacctacctcgatgtttcccatcacccagcctgcctctttcctccccagcaggtgctgtcccacacccctccggctgtgtaaagaatccttccaaactctgggggcttagagcacggtcatcttattataaatgacagaattctagacacattggagtggtttccatgcagaaagagggtgtggggctggcacccggggaatacgcagctgggcctggagcactgggctctctgggccgttccagctctcggcagctgctccatgcgaacctccagagtatgccccagagcacctggactccctgcacggtggtgcacacatcctaagtgtgcctgctgagagcactggcagaggatgtgtcacctttcacagcctagtcttggaagccaggcagccctggtcctgctagacttcattagaaagacaggcacagagatccagtttaaggggaaagggcatgttttaaatacagtgtataatagaacatttgaagtatagtaaggccaacaaatcaggagatgacggcctttgaaaagatagtttgttacagttcccaagaggaggggacatgccacaccatgccaggccatgccaggccactcgggagcaccagatagagcaggaggcagaggcagagggagaagctgtgggccagagctttctgggaatttctgtaggaggagcaggtgatagggtttggctgtgtccccacccaagtctcatcttgaactgtagctcccataattcccatgtgttgtggcaggaacccagtgggaggtaattgaatcacagatgtgggtctgtcttgtgctgttctcgtggtagtgaataagtctcacgagatctgatggttttacaaagggcaattcccttgcacaccctctcttgcctgccgccatgtaagacgtgcctttgctcttcattcaccttctgccatgactgtgaggcctccccagccatgtagacctgggagtccactaaacctctttcctttataaattacccagcctcgggtatgtctttattagcagcatgaaaatgaactaatgcatcaggcaaggcagggtaagcgtgcttatcattgactggcctgagtaactccggtaggtactgggcctaggagcctccctggttgtctggtgcctggtcttggcatgattggaacaggtggataatgatccagggtgtgagagccccgcagaggagtggttggggtatggactctggattgactggtttgcatttgaaaacagcacttgccggtggattgttcactactgctaggcattggctaagcccgggacggccgtctctccagggtcagcaaggccccgatgtcaaagcctcagggtacagaaaataaaatacacagtcaatagagcatagaccccaccccttgttggaggactcaccagtgctgggatgggaaacactgctgaggctatttctggcacataccatgtgctgtgggtattgaccccaggggcattccctgctagacatctggagtgatgctttctggtttggtctctgcttcctggagatacaaccaactaatttacagacaagagagaggaaggagtgaaaaatgctgtctggagacaaagagcaatgcacccattatcaaaaaggaggaacaaaataaattacactggctggaggtacagtgggccggcacagaaacagatgagtgactcttccacaacgcatccggctgtgctggatgccggggagaagacgtgaggctgtgtgtctgagctcacccagcattcacacctgcttgcacctgggaggtcttcgatcaacctctgtcaatggaatgaatgacgccattcctggcctcttcaaacttagaaatggaaccaactgatatgccagatagccggctttcaaaacatttactctctagagatacttagatgtctttagcttcttgcgaattcaccttcctcacatgtaaaatggagaagacaccaggacctacctcagggcatcacaaaagtcaatgggacagatagaaagctctgtgcttggtccagcacccggaacattgcaagtgtgcaatggatattacctgtgattattctttccgaaggtaggcacatcactaaaagttcattttcaccaaaagtcctaaacttgattttgtgcagccaacagagaaattgtccctttattaagttaatttcaacttaatgggttggccctagatcctaaagaagggaacaacttgctcacagcctccctgtccttgataggattagataagaagctacgtgcaaagtgcagcatagagctggacatgtagtaagtgctccataaatctttatgacaattaccaatactcttcaagagaattacatcatgtattgattataggtgagaagtattcctgcccatttttctcctgaaatgctctttaagctcagtgctgctaaggtctacgagtcatatctgatctccaaacgtttacaactgctaagaaaaataaaacttgtggagcatgaaacagagggaaaacacacgtggggaatggcccattaatctctgtcagtcgggagatgccaacgacagaccttaggcgaaggggaagggatcatagggctgttttctcttaagcacatgttttatgttagagatctggtaactaataaaagtgctccttagagggggaaaaaaaggatgagtgtagtatagttggtaagttgcctgtataatgtggcgctcgtgaaatacaagttaatttttgcaaaaatcaaatctgctacttaatttcatgcagtaatagagaggcaaacctacattgtatttcctttaatttcattgtgcatttacacagggacagttaatatggaggacatctcaaggagaaatcgatccactcaatgattttatgaattatatcacaaacattatagtttcttctaaatttctgctccaaagttgtttttttctttctccttttaaaactgccccctgacaatggggtggtggggaggtacctcagaggtcacggttctagagcacagtcaaagaaaggtgcttgctgatgcgtgaggtggggaggagactgaggtctgccaaggacgggggaatgatattaaaataagatgcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaggaacaagcttgaccatggatacggaattcgagcgcgtacccgtgtgatgaagacgaggatatctgacatggatgggccactgcagtccatgacacactcctgtggattagtgataatgtgtttccttcctacagactcgacacttcagtccctgctgtctgctcagccaacggttttgcagtgcactgcctgctcagctgtagtgaggccttgaaccccagaagcttgtatgttaatgagaatacgacagcacatgcagggataccaagataactaggcttggcccttgccctgtgggtcctcaaaagtcaggtgaaagaataagcagatccccctgcgttccagagccaggttcttgggaagttacttgaccacgatgggccttgagctagcctcgagggtcaagtgcagaccttgacaagtcgagagggtgacatattctttcaggaggaggagggagcaaagtcagagcagaagagggaacagctggtggtccagcgtggcagggtttcagcagaggagatgtccagtagtctggcatggtagggtctcagcagaggagggaacatcccatggtctggtgtggcagggtctcagaggagggaatgaatagcagtggtctggcgtggcatggtgttggcagaggaggggacgtccagtggtccggcatggtagggtcttggctgtgggatgctggactgtcacccgtggggtaccgattgccaggatgtggatttggggctttattcttgtggcggtagggaaccaggaaaggtactcagcaggggcggcaccagtgctatggtgtagtgtgatcatgagatctgagacagacattccccaaaaccttctcagtccaccagcaccttcgtgtcttagtgatgttttcatagtgccctaggagaaagaaacacctgtttcatttatgaagtcctcaggtccaaataacttaacagaagtaatttgcaaggtgtctgacagatgttcctgttttccttaaaaaaagaaaacatttgcatgtgctatgatgagttggctgcacgccccgtggtacctcaggaacacactttgggaacaaagaggccgtctaacctcaagttgtggctcagagtcaccacattgctgtttcagcttcctctttggtaatttgcatagaggaaaattgcatccctgccgtggggtgggtatgagtcccgacctcctagggttgtaagctggaataaatgaaatgatgcattcaaagcggtgagcagagagcattgcggtcatctccattatcaggggcctgggtgcagcaggacctgctcaaggcaggtggggttggggccccgtttggaggccctgtgttggtttgtggtcagtggggacttgggcttaatcaaggagctctgcaaagttccccacaaacacgaagaacagcacccaggatagtagcagtgccggggcagtgaaatgacccagtgaggttttccgtgtttttttctttttttacccaagtcttgctcactcatgccacctgcaggccaatggggaaactttctttttattttttattttgttttgaggagtcttgctctgtcgcccaggctggagtgcagtggcgtgatctccgctcactgcaagctccgcctcccgggttcacgccattctcctgcctcagcctcccaagtagctgggactacaggcacccgccaccacgcccggctaattttttgtattttttgtagagacggggtttcactgtgttagccaggatggtcttgatctcttgacctcgtgatccacccacctcggcctcccaaagtgctgggattacagatgtgagccactgcacccggccaggaaactttctgttggcatcatatgggagccatttctgccaggggacctcagtggttctgtcccagctgacgattaaaatcattaaggaacttaaaaaaaatactgatgcctgaatcctatcccagaccaaattaataaaaagtaaaatctaaggatgtgaactgggtgtctcggtttttgttgttgtttttgttttgttttctttcttttttttttttttgagatggagtcttgctctgtcgcccaggctggagtgcagtggcacgatcttggctcactacaacctctgcctcctgggttcaagagattctcgtgcctcagccacccaagtaggtggaattacaggcatgtggtaccatgcccagctaatttttttttttttaatagaggcggggtttcaccatgttggccaggctggtgtcgaactcctgacgtcaagtgatccacctgcctcagcatcccaaagtgctgggattacaggcgtgcgccaccgcacccggctgttttgttgtttttttaaagaaaccttcatgggaatctgacgttgggaactatggttgatggtattccccaactgcagagatgtccctggtcaccccctaccgaggtgcattccagcttccaactctttgctccagccccaccgtgggcaagctcgctgcgtgcctccatgtgcccacgcccgcccactggagggatctcatttagatccagatacctggaaccgctgggtcgtagtgagtgcactgtgagttttaaaatgtgtgccaaattgccctaaagtggctccaatttacacccccaccaatgagaacctttccttaacacctttccccgtacatgataatgtcaaactttaatatttttgccaatctgatgagtaaaacatttttaatggcaccagctaaaaaagaatggcagagactttacatacgagtttggtgagatctctgagataagttgctgagggagagatctaagttgcaggatatataaaaacacattggcagacaggcggaaaatgtgtcacaggagatggggcagagattccagctctgagttccaccctgcggtcactccatggggcacacatccatgcaggaaaatgaaaagcgaaggattctttaggtagagtcagtgggatgttctccttgtctggaagggtttaatgttttacaaggagaatgagtttaattatatcattagaggttaaattttaaaacacttaaggaaaaattttatgtgtgtgtgtgtgtgtaggcgtgtgtgtgtgtgtgtataaagagaaagggtgtgaaacagagagggagagagtaaatgtagttaaatgtagtaaggtgttccttcttggggtatttgaatgaaaggatccaggaatgctctctgccagtcttacaacttttctgtaagtgtgtcagaagaaattacccaaaaaatccccccaaaacaaccctcaaaactcaaaggaataaacgaggtcgggttgccgaccgcctgtggtctaggtcagctcctgccctgaagcctgtgaaccctgggaagtggagcctttgaaaggagccccggagggcagcccaggcggacaggctgccccggcgcgaaggaggacaggctggcaaatctgcagcacagtcacgcctggatccgtactctgtcccgccgccgacagaggacagagagcaacttcctcttcaaagaccatcctgcataagccaaaatgcctcctgggactgaagttcaaagtgatttcggaggagatctgtttggtgccactgtttggcctggggatttgagcggattactaaagccctgtgttccaggcagcagtaactcggggcctcaggtgcgaaacggcctttgataaacgtgagctctttagaggcccaaacaaattgaggacaaagcagctgggctgctcaggagggggccggctgttgaccctttctttccagtcttaggaaaacaaatacttgatattccaaaggctgagtaaactcattaaaaggatcttggacttcctgcctttgcgcacagcccttggaagcttctccgccaacccccggagagcaggagtggggagggttggaggcagctccctcagtcctgcatgcagaccgcagccactgactgttcccgagtcaccaggccactcttctctcctgcctcatcgtcttattcagggtccacgtcattctgccacctatttgaggacaccaggccttggctgtttctgcttcttgtacctcctgagtcaggtggcggtgggggagggcagacgccacacacacctgggtccactggccgcacgcgtcctggaaatgctagtgtgactttcctaagggttctttcaaaggacacttttagacctgccttttgtcccaaggattctagttgcttcatctttagtaccacagactggtggctaaacaacgaacatttactctgccaggacaacctcgctgccctcgtggttcccagcacccgcccggacctccacaccaggctactgtttccccaaacgagtgagtgtcctactcccttccggcagccctgaccttctcctgcctcggattctttcattctcttctcggctcctaaattcaagctccccttataaagctcagcccagattcccatgataacgtgctctgcgattatttgccgattccatcaacattttttgagtacctgttgtgtgcctgacacctacggcactcagagctggaagtggatccagctgtgagcagaacacagaccctcggggatcccccagcctgctggtagagacgacccccatccagggagatgcgggagcaccgaggagaagccccaaccctggggttcatggatggcttcctggaagaggaagcaaggtgaagtcagaggctaaaaatgcacacatttgcaggtgttgagcaagtagtgtggacgcgtgagcgatgaggcacaatagagcatgaaggcgcgggcggtggcaaagggaacttcgccatctggggaggcatcctctgcccagctttgatcactccctgggatgtgaataggagtttatcttgccagatatatgatcttccaaggtcacaggattttgcgaatttgtatcagatttctcagtttttaaatgttgccaacttgtaactttttaaaatagtcagtggaccatacaagacacaactgtaggccaggtgtgttctgcaggcccttgttgcaacatcttgtctaagtggaattcagccaggtgagaaaacagtaaacaggcagaggactggcaggtccaaaggccctgtgggggagagggcctcccctgtgatgtccatgtgtactttcacctatttggcaaatatttatccatccccaccagatgtcagccactgtttgggaggtgtgtgtgcacacatacaaacacatatgcaggcatgtgcgtatgtgtgcatttggagcaatgtatgtgctacacatttgtatgtgtgtatatgtttgcaggtgtattatgcatgtacacatgtgtgtacatgtattcaggggtatatgtgtgtatatatgtgcatgtgtttttatgtatgcacgtatatagtgcatgtgtgcatgtgtgtatatgtatgcaggtgtacatatgcacacgcgtgcatgtgtgtatacgtgggtgtattgtgtgcatgtgtgtatatgtatgcagctatatgcgtgtgtgcatgtgtgtatgtagtgtatgtatatgcaccatgcatatgtgcatgcctgtgtaagtccatatatatgtgtgcacatgcatgcacgcgtgcatgtgtatgtacatgtgttcatgtatgtgcgtgtaggtgtgggtaaatgtatgcgtgtgtgtgcatgtgttcatgtatgtgcatgcaggtatggataaatgtatgcttatgtgtgtgcgtgtgttcatgtatgtgcatgcaggtatgggtaaatgtatgcatatgtgtgtgtgtgttcatgtatgtgcgtgtaggtatggataaatgtatgcatgtgtgtgcgcacacattcatgtatgtgcgtgtaggtatgggtaaatgtatgcatgtgtgtgcacgtgtgttcatgtatgtgcgtgtaggtatgggtaaatgtatgcatatgtgtgcgtgtgttcatgtatgtgcgtgtaggtatggataaatgtatgcatgtgtgtgcacgtgtgttcatgtatgtgcgtgtaggtgtgggtaaatgtatgcatgtgtgcatgtgtgttcatgtatgtgcgtgtaggtgtggggtaatgtatgcatgtgtgtgcgtgcatatgccacacgccatgttgcacatcggcctgcatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttagaggatcccctgttcttgtgtgtggttgtatgtgtatgtggttgtgtgtggttgtggttgtgtgtgtggttgtggttttgtgtgtggtgtgtttatatgtgtgcggttgtgtgtgtggtcatttgtgtatgcgtgtggttgtgcgtgtggttgtgtgtgtttgtggttgcggtggtgtatgtgtggtgtgtgtgtggtggtggtggtggtgtgggtgtgtgtgtgtctcctgcatgtgacatttccccacaggcctcacgagttggagtcctgggtgtccacacgtgtgtatgcctgtacggagtccacacacagactgcagtgtgatttatgcagaagttgtaaattagcagttcttaggccaaacctggtccatagatgttttctgtttccccagaatttgagtctttacatttttttttaaatctagatttccaacaccaatgaaaagtcatatgtcccagcatacgttcaccaaatggcgacattcagcggaacggagcagcggcttccccttttcagatgaggcctgcagtcccaatttgccccagtctccactactccctattgtacacacctggtctcactgaatcatgtacctgtttcaacccagctgacacgcatactggtttccagccttttcaaggtttgggccactttgcactacgtgaatgtgggttcccaggaatcctcacaatgcccagtgctgagcaggtaccaccagggtcctcatgaagtggaaaacagcactggagtgggtagctccccacctctccaggtagcacttgacaccgtggcctctgaactgttcagcagttctaaatttgagctaaatttttcttatgatcaagctgaagagggtgaattccaggctggccattgacaaattagttagtaaacgctttgctccggcaagaggcagctgtctgccttgaagcaccagtgtgatggccagggatgaaggccgcctctgtctcggggactgtcagcccggaagccggggactgggctccctgccggagctctggggtgcagttgtagcccactcacagctcccgacccctcttctgtggcaggagaaagggcagcaggccaagaaagcattcttctctacctccttaatgaaaaccctgggccggctgtctttcacccaggggccaggaccagcctgcctgtgtttgaattagaggctgccacgccctttcgacagcaggaggccaggcggctgtgcttcctccctgttctgtgtggctcacaaagccacctccaactctcctcctgagcctggggaatgacagactgtggcaggtggctgataaatggagaaatgcagaggaaagtggggcgctagatcctcagcaggtgcagccccgggagcctgccgcgtgcacacgctcctgcctcaagcttgcccttctctgagcatctcagtttgtgaaacaggatcctgcagtccacacgtgggctgcctgtctcctgccaccgctggcattcttggggtgcagataagaacattttcctatcctcatgtctttaagcatctacagggatccctcctgtgcccaggctcgccctagccacaggattgccagagaaaatataaaaatacagttaaatttgaaatccagataaacaatgaaacaatttttagtataagtatgcctcaaatattttataggacatacttatactaaaatatcatttattgcttatctgaaattcatattaacatgaagtcctgaattattattattattattattattattattattattattttgagacagagtctcactctatcccccaggctggagtgcaatggtgtgatcttggctcactgcaacctccacctcccaggtccaagagattctcccacctcagcctcctgagtagctgggattacaggcacccaccaccacgctcgtctaatttttgtatttttagtagagatggggtttcaccacgttggccaggctggtttcgaactcctgatcccaggtgatccacccacctctgcctcccaaagtgctgggattacaggcatgagccaccatgcccggccctgaatttttatttgctatggcaagcccgccttgtcccatgaatgggggaagggtgttggagcccattgcctgggtttgaatcccagcttggccaccgacaggctgtgtgaccctgggcaagttactcaacctctctgtgacccaatttctacatctgtctattgagataatagtggtgcccacctaacaggagtgttgacagggagcagtgactgtggtggcgcgtgggaaagtccccacacggaccagccctgctcagccttggtcgttattacccagtgttgttcaacaatgtccacgcacagagggtcctcgcgaccctgctaatgctagtcctcaacctcagcacttggctttctccactccagctgccctgagcttccttcaagcaccagaaagggccaccttcccctccgcacctgtacctgtcccatgccgccccctctgtctggatggttatttctctccgtcatctgatcaattctctcttatctcacatttaagatccaaggtcatgttccccactcagtcagcaaatattcattgagcacctattacaggcaggctagggggcagccaacgacggctctgggactgaacccagatctagtctgcctgcgaataactatttttacattttcaaataattagaaaaaatcaaaagaagactacttcgtgacacatgaaactcagaggaaagtcaactttcagtgtctacaaataaggctttatgggaacacggctgcgctccctcaccgagatatcatctgtggctgctgtgtgccctggcggcagggtggaatgcttgccacagagaccgcagggtctgcaaaggttgaagtatctgttacctaaccagggacagagaatgcagagaatgcatatgccgaccctgatctagacgccgggcatagggtgattaaagcaaacagagaaaagcaaccccaaaacccacacaaaactctttggtctcagagaagcaatatttgggtgggaaaagagacaggggtgtgtgcgagagagaaacagagagagagagagagagaggcgcgagtcagatgattcagaagcttggggctgtgctatcaggaggatgggtgttaactgttctggtggggacaagtgtggaaggagatggtgtgtggaggaagactaagagtttgtttggggacttgaagattttgagaggcctctcggcatgcccatggcgatactgatggggcaggtgtgcaggtgcatctgaagaaataactttagagtcatcagtttatagatggtcttgacccggggcatgagtctaaagagagaaaatcctttcctgacctcaagcctaagtcacgttcccctggaagataacagatgttcgctatgcttctctgatgaacagactctggtttttaattgtttcagaccatgggttctgtagcttgactgcctggattcaaatctcagcttgatgactgaaaagcggtgtggctttgagcaagtggctcaccctctctgtgcctctgtcttcatctgcaaactgggaagaataatggtactgcctgatgggcttgcttccacgatttagtaagcacatctgtgtaaagtgctttgaacagtatctgaagcataatcagtagcatataaagatgctatctaccatgattattccgtaatgagactctgagctccctgaggacaggatctggtctcgccttctcatcactgcatctcccactgcccagcacagtctctgcacacacatggccgtgggatcattgcatcaatggctttggaaggacagaggggcagttgtcccctcctctagggagtgacctgagtgtgaaggggctgtggaggggaggggcggccagggctgtaggaggaaggctacccagagtccaccgagggaacaacgtgctcaggggacagagaggagaggtgggcagggcacagcagcccttgggccaggagggcaggttgcggctgagccacggaagatcctcaacatcgaagtatggagactgatctttattttttgagaagcagggagttacaaatttgtcttggcagggacagagcatcttggaggttgagagggtgaggccaattcaatttggggaactcctagtatattaataaaacaaacaactgccaagacagggttctgaaaatctggggcttatttaaatgttaaccctgcctgggtgtggctctattataaacctcaaagagaggcaggcaggcagatagagtgagtgacccgttagtggttgtgagatcattttagacttcaaaccagagtttcttatctgaaccataacatgtagaaaatgatctaagcaaatactttctcaattctcacaaaaatggattataactagtacccctctaggtgcctaggataaaggttgatgattgatatacaatgaatggctgagaacgttcaagcttaattctctctggatcctggttgagaaaaaaagtctagaaaagcaaagctaaggtggaaggatgagtagggaataaggtaagttagaatctgggataggacagggtgaaattgagtagagtaagattggtagaaaggaataggatagaatagaatagagtagagtagagtagagtagagtagagtagagtagagtagagtagagtagagtagagtagaatagaatagaatagaatagaatagaatagaatagaatagaatagaataggctaggctggcatggaacagaattgcccagactgaaataaactagaatgggaaatatcacagggctgatgcatggcacgtgtgtaggttcctgaccctgtgtcactggatgtgtgcagattgtgatagaaagtgaatccctttctctgagaagcagccaaaagtgcttttgaggtaaaatgaaactgacgggtctcgactctcagggccctccattaccaaatacacgtgagatccaaccacacgccccctctccaaccccgactcctcagaagaggagtgatcaacttgtacctccctcaggatgtccttaggacaagacatggcaaacctttacgagaaagcccgacacccagtggccaacgcgtcagctgtcaggcttaggagataaggttggccttttatagtgttaagtctttgtgaattggatcctattccccagcaagattgaacccacccagggagggatgcaacagggtttgcgaggtgggattggagaggtgaaaaacctggagccacagtgaatcaaaagagcgttgccttgcgatttccagggaggagccgtgcagacctgaattaaggcagagaccttgccaatgggaaaggggtgaagttaagacgtgtgtcagcaagactgggattctggaggtgagagaggaaatgtagcagtcaagattcagttacatgaatagaagtcactccagctaccttacacaggaagggattgaatgcaggggattgggtgctcacactcgctggaaggcctggttgcatagggcccctgaatcctgcagaactggcccctcaagagacctctcccacagcagggtctgctcacatgaggaagacactttggctatgacccgagggtcaggaagaatccaccaccgactcacaaacatcagctctaaattcatggtatgtgcaaactcacatgccctggatggatgttcgcacgactccaccacttatgagctgtgtggtctctgaaagcttatgtaacctctctgactctatttgctcgatttaaacatgaagatgaaaataatagtgcttaatttatggttttaagggttttttgtaatgaagtaagttatgttcgtaacgcgtaaatgtcacttagctattattagaaaagcttgcattttgtggaagatttcagagtttttaacagaatagggctcacacatgtgactttgttgttttattcagtgaataggcatgaggatttgtgcctgttgggggcccaaaataataggaagggtgggtgatgaagaacaagggatatcctgaacatggggatggggcccactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttgactttgcccaacctggaacaccagggtttcttcaaaagaagcagtggtgtgctctcaggaaggtctgaagccaacggggctggaaggagagcgatttgctacttatacctcgaagatttaattctgtttgaaggccaccgctccagtgccacttcctagagataatcgtgcggtttataaggaactatgagactcattttagaaagcgcttccaggaggctgaagctgggggtctgggagtttgacgggcccttcctcccacctgcaggggctgcaggcgcaacctcattgagggatgaacaaccttctctggacgtgaagctgggtgggagggtgggggacgagaagaggctgcagaggaggcgggggctctgaatccacccagccaggccagccctgtctctgtgactacaaagaatgttctggaagggttagggtgctgtttgcctcaggggagagggcgtggtgggagggctgctgggctggcagagtaccaggggaattcccaggaactcctctggcatctctgagacccagcagggcagagggtgggcggggctgcatggcgcaggggctcccagacctgagctgtggaggtggggccctgtctgccccctcactttggaaacctagtagggtttgtttgcttgttttttgttgttgttgttgttgttgttgtgtgtgtgtgtgtttttttttaaagaaatttgctgttttccaggtagcttcatagaaagccagggtctctttcctctatagttaggttgtttacattgcaaaagcctaatcctcttgctaggttgatattgtgtctcgtgggctccttaatgaaaagcatttgtccaggattattccttcacagcaaatgagagcctccaagacagctccactctgagaaccggccttgtggctggggcacgagcaccaggggccccaaagagggggtcaggctcgagccacttgtgtacgtgtgctactcctggcctgagcaccccaggctggctctgaaatctagggtgagcagaaagggaggcagattctcactgtaagaagcacgggggagagaccccattcgagtgggctgtttcccttttggttttgagcctgtagtttcccccaaaggatgtccacatcctaatccctggaatctctggacatgtcacctgacatagaaaaagggactttgctgttgtgattaaggactctgggatgaggagatgatcctggataatgtaatcacaggagtccttgaggaggaaggcaggaaggtcagaggaggaagcaagaggccagagtgatcccaggaaggggtcgaaagctgcgttatgcaggcagctccagaaactgcaaaaggctggaaacagactctcctgggagcctttggaaggagtgcagccagccctgatttcagccctgaaagactcattgcagacttccggcctccagagctgtaggaaaatgaagttggttgcttttttgtttttgcttctagaggcagggtctcgctctgtggcccaggctgaagtgcaacaatggtggcaatagtgcaatgacggctcatggcaacctcaacctcctgggctcaagttatcctccctcctcagcctcccgagtagctgggaccacaggtgtgcacctccaagcctggctaatttttctttttttattttttgtagagacggggtcttgctgtgttgtccaggctggacttgaactcctgagctcaaatgatcctccttcctcagcctccccaagtgctgggattacaggcgtgagccactgtaccaggtcaagttgtgttgttttaagccatccagttggtggttatttgttacagcagccacaggagacccacgcggccagagtccctctcctgccctgcccccgatgccagtcagccactaggctgggagggtcctgccctgggagagtccggcatgaacacagggaccaggtgcagcaactggactccagacaggaagcactctgtcctgagagctgcccacacccagattagggtttggatcccccaagaaacccccatccaatctcttccccgcctcctttggcccccagcagacctgcttctcactcacgttccctttctgcccctgcttcagctttttcctagaccgcctgcctccagcagaacgaatcaagaagattacagggcaggcgggtgtgagagcagctcctggggcgaaactagacgaaaatcccctggccctgtttccccaaacttccctttgatttttaatttttttcaaaagtttcttcatcacaaaatttccggatgtgacatccctggcagctcacacagcaagttttggcaaaaaccaatgtcttacttctcgctgggctgcaagaaattagagtaatcgcccccaacacacaaaggcatgaactcccgatgcaattaaggagaggtgaggggatcaaaggaatcatggctgtggatgaactctccttctctcgttttcccttaaaagtcacgagaggcaacttgcagtctagttagcttgggggcacccggggttggggtgtagcaatgtgggcaggagatggtatccttggcctcagcagatggggcccctaaggttgtactttttggcgtggctctgcagagattatatgagctccaagttctggagctcccttccagccccgcttttcactttggcgcaagagggcagttagggcaagttcctagttgtccccaaggctcctctgcccctcaactgtgacgtgggatggtgataccacctagcttgcagggctgggtgcaggtttaaggaggcacgattgaaacctggtgcctggcacagagaaagctcaaaaatgcagggtgccacccttcatgtcatcctcacctccaccccatcggcaccgcctcccacgcagccctcctcagtgacgacggcgggtttggcttcatccccttccatgaagatgagcgcggctccctctcctttgtgttggatctggggccctggggagagctgggcacacggctggtgtgtagtagcggctcactgctgggacactgctgtctgctgagggttgctcacttggctgtggttgctgctctcaggcctctcatggagccaccgtgacacaccccccgtgacacacacaccccgtgacacacaccccccgtgacacatcccccgtgacacacaccccgtgacacacaccccgtgacacaccccccgtgacacacaccctgtgacacacaccccgtgacacacccacccgtgacacacccctccaagccagggtgcaagttacatcccatcgccaggaccagcaccatccacacagcagccgcacacgtggggagcgtcgctgtggttatggccgacttgccgtgtaggctaagattgttcccttacacacacagacatcctctctctcacaccctcacgcaatcccacactcgtattcactcccacatttacacacgtacacgctcacaggcatgcatacagtggggcattcatttacacacacacccatgcacacacacacatcctcacacacacccacatgcatcttcacacactgtgaaacacacacccacacccacacactctacgggggtcacacaggcctctccagctgcgccctccctgcaccgtgcagacccccaggtctggcctcagaggggacacgcaagccccactggcagcagacctccggtgtcccgtcccctgtctgggctggcgaaagtgcaggtagctccttggtcgcctgacccagtgccttggatgctgcccgtgtgctgggccggaggacaccattccctcgcgcacaacaagccctgtgaggcatcacggaggggacgggagctcacacctcaacctagagaccccgtctactcacaaccacttttaaggaatgcagctaaacagggggctcagatccctgttcagggcccttctcacgatcccaccgtaacagcccagccctgcgggtgcctggctgcagtctccttctccccagcacttccagacctggcagcccggcccaataccagcggccgtggggcctgacctggactgaaccccggagcccggacaggctggtcactgcagggcggggcctgaattctgcagctgctcctgaggccaaaagctgttctgagggtggggtgggctgccaggctccaccgacgccctcccgcactgcaggcgcctctctggagcctcacatatgtccaccatcagattccatggtctgcggtctgtggagacggtggggaccgactctctcaacacctctgtgtgaactggatcccctgggggactggggggagtaacagaaaagctcacagagtgcccctgagcccagagctgtttctgatctctccttaaaagcgatctccgtggaaacagcccagatgaccatcagtggacgaatagatacacaactgtggtccatccacacaacagaatatcatccagtcacagaaagggaggaagcgctgatcccatgctacaacatgggtgaaccccaaaaacatgataagagacgccggatacaaaaggccacgtagcatgtgattttacctccactgaatgcccagtagaggccaaatcttgagagacagacagcagcggagccagggggaggagctgagtgttcgggagaggggagtgagcagtgaccgatcacaggttcaggctttcctttggggcgatgacaatgttaggaagtcgagagaggtgtttacacaaccttgtgaagatattaagtgccactgaactgtgtgctttaaagtcgttcattttatgttacatgcatttcaactcaatttttttaagtgacctctgatttttaaaagacgagtcaatattcccagtgactcatttgaccatgggaaaatccactcttttatgggccaaatgtttgcaaggctagagttctgtctgaaatggaaacttcatcaacagctgggcattcggtggccaggcttttacttggaaaattggaccagatttcttggccatcatcttaattatgtgttcgacacagagggacagaaatttctaaatcacaacttcctctgagtggagaaaatcaagccccaaattcttaaagggatataggaaagcaagtctcccggccatgctttttgagagggatgttggtgaagggcgtttagtcctccccatcatagaagaggagaatctggccacccaaaatgtgggaactgggttctgtggactgggaaggttcaaaaagagtatcaaaaacgggggaggttcgcctttcccaactgcagccagatggcacacaaggctctcctgcatgtgcttccagaatgtctccaggcagacagaatgtgtccaaatgctaggaggaaaacagagtacaacagcgtcaatgaccacagcagtaatggaaaccatgctaataatcataataccctctaccaagcccaaccccatgtgtcatcctacacagtagctaggacgacattagtaccccatttcattctcccgtgtctcagtctctgtatctgaacaacaggacaaataacagtgtctacttcattatgctgtcatcattattgaatgaaggttcaactctccatattccattttttaacaaaagcttcaactcacatttattggcaaatgttgatgtcatccaggtccagttccatgctgccaacagaagatccattccttatcttccagcgatgcgctgtacttctgaacagcttcgcctgcatttggtaagcaagagtcgtcagtagcctggagtcaatgagaagtttacaaagttgttgagaggtcaggcttttgtgaatgaattataagaggataatacaaaacaaaaataataataaaatgccctagggaaaaataatttatcccatgccaactaggtcttgagaaggtcatttctaaattactgtctcaaactgaattataaacaactactgaaggcagagaaaggggggtggggaagcaagtgtggacggggcgcagaaggcttcaggaaagacaaaaccagggggagggagtcagactctggaagaggaggctgtaaatctgtgggtctcagcctgttcaggttgctgtaaccagctaccatagaccaggtggtttacaagcaagagaaacttatttcacacagttctgaggctggacatccaagataaaggcagattggtgtctgccaagggtccttcccacatagacgcaggcaccttgctgtgtgttacacggtgggagggacaaaggggctcccttgggcctcttttctaagggcactgaccccatccacgaggctccaccttcatgactgatcacctcccagaggctccacctcctagaaccattagcttggaggcgagaatttcaacataggaattttgtgagggacacaaacatttggaccatggcattctgccctctgcagagctggctgaggttataaactgcccactgtgcagaaaggacccgaagcagaaagcatgcccagtctcagccaggatggaatagttactgcagcatggacaaggaaggcatgtcagaaaaaaaaaaaaaagccattgccatcaccatcgttattatcaccatcatcgctagcgtttcctgagtgcttgctggttccagagatggtgcaaagtgccttgcacgcatcatgtcacttaatcctcccaacagcccggggacgtgtgttccacggttaccccatctgctggatgaggaaactgaggctcagggaggttaacaatttgcccaacgtccaacagcagctggagagcccatggcaaggctgaacggtgaatgcctgtgcaagggaagccaggctgtctccagggctcccgacaggggctgcgtttctgctgggaataattgccggattccatttgcactaggatgtgcgaactcactgttgttcactaattctaagacaccttcttcgtatttaacaccctctaaagctggggtgctgtgtcatggtttagtcttagatggcaacaataatggaatcaatggtatcttagacttaatgaaaagttgggttgccaggcccaagttcctagaactgttaagtttttgttttatggcaggcatttattttcttcttgtggccactagagttttttttaaaaaaaaaaaaaaaaaaaaagaagaagaagaagaagaagaaacttctagagcaggaatgtccaaaattttggcttccctgggccacactgagtgtcttgggccacacataaaatacacaaacactaacgatagctgatgagctaaaaaaaaaaaaaaaaaaatcacaaaaatttctcataatgttttcagaaagtttacaaatttgtgttgggctgcattcaaagctgtcctgggccacatgcaggccatgggccacaggttggacaagcttgttctagataaagaaaaaaaatgtgtgtgtgtgtgtgtgtgtgtgtgtatacatatatatgggctattaataaaccacccagtttatggtgcattgttatataaataacctaatgttcagatttcagattttctattgctctttaacaaatacaaaatttagcagcttaaaaacatggttttcttgcaattccatgggtctggaattcagcagggctgggctgggtgactcttcttttctccttggcctggacagggcccatgtggaggtatctggttctgagaagaggctgttccggagggtccatgtgacttcactcacaccctggcagggagggctggaaggctgggctcagctaggactatgggctatccacatggcctcgcagcatgctggcctcaggtagaagtatttcttctgtggtggctgaaagctctggaagcacgtgttccaggagaccaggcagagccgcagggcctatatggtatagccttggaggacatgcatcctcacctcctgaccctgtgtgggagaggacagcctggatggtgtagccttggaggacattcatcctcacctcctgactctgtgtgggagagaaggatctggatggtgtagccttggagggcgtgcatcctcacctcttgactccatgtgggagaggatggcctggatagtgtaaacttggaaggtgtgcattcttacctcctgactccatgtgggagaggacggccaggggggtgtagtcatggaaggcatgcatccttacctcctggagacgtgccaatgcctagcctggaaagggtcccacctgcctcctgaccccgtttgggagaggatggcctagagtgtgtagtcttggaaagcatgcatcctcacctcctgattccgtgtgggagagaacgacctggatggtgtaaacttggaaggtgtgcattcttatctcctgactccgtgtgggagaggacttcaccagggcgcaggtgccagaggctcccacaccaaggatgaagatggtcaccttcacaacccgttccgactcacccagtggctactgttggacacctactctctgtcaagcattttccttggcaacaagtaaaaaagacactcaaatgatgtcctcaaggccgttacgctgcagtgacataagaggcaagtgacctaagaaaaacaggatccttggaaatagtgataatcactctaaagaatgaaacaggggctggggcctgtgactcatgcctctaatcccagcgccttggaaggcaggtggatcgcttcagctcaagagttggaaaccaggccaggcgcagtggctcacatctttaataccagcactttgggaggccgaggcaggtggatcaggaggtcaggagttcaagaccagcctggccaacatggtgaaatcctgtctctactaaaaatacaaaaaatagccaggtgttgtggtgtgcgcctgtaggccagctactcaggaggctgaggcaggagaattgcttgaacccgggaggcagaggtttcagtgagccaagattgtgccactgcactccagcttggacgacagagcgagactgtctcaaaaaaaaaaaaaaaaaaaaaaaaggagttggaaaccagcctgacagacatggcgaaacccgtctctttaaaaagtacaaaaaaattggacgtcgtgcgcgtgcctgtggttccagctacttggggggctgaggcaggaaaatcgcttgaacctgggaggtcaaggctgcagtgaccaagatggcaccattgcactccagcctgggggacaaagtgagaccctgctcaaaaagaaaaagaatgaaataaataggaaaacatagtggagcctggaatgttagaaagaatgatcacggaggcgtcctgaggaggtgacctgtgacaagcaatctgaatgatggcggggaatggctgtgggactccctgggaaagtgcatttggggatggggaagagcacgtgccaaggctgcagggtggaggagagtgggctggagtcctccaggaacagaggatgggtctgtgagggccggagtcacaggggctgggaaagggaccaggaggagatcctcaggagatgagaagccagaccacaggttctcacaggccatagcacacagtgtggaattttataccacatacattgggacacatactagcgcctccatccagatggaatcactcaacccctccgtcatatatgactcatgagacagaacctatctcacaaaaaaccctatgcaacaccaatcaccttaaaccaccacacacgcacacaagtccgactcaactccacaccaaccatcatccgcataacctccgaatcacataactcctcatctcactatcatacatcacccaatctactccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaatcaggagctgccttttagcaagagccccagtgatttgtgtgcacagtagggtttgagacacctgggactcatttgccacatcaggtgtattttcctaagaggcacagaacacccaacctgcaactctcaggggatccaggcagtgttggctacttggcataacaagaatcctgggggtgcagtcgcttaatgagtgctcacgaggctggctctgtcttgcttacctgccatctcagaattttggctttggtgttgggcgtattgcctcgtggtcacaaaatggttgcaatagctccatatgtgattctcacacaccacattgtgtgcagaagaaaaggacaggtttcctcatcattttttttttttatcatgaagcaaaatcttttattagaaccttccttcactcccacacgcacaccctcattttttttttgtctcactaggaaagctcccctcacatctcactgaccagaccgagtgacatgcacgcccctgacccagagggattattttacctgatttttttttttcttggctcatcccctgggacatgcgtgaagctttttgtcttggaaagaataaagcttttagaaggtagaggtgagttaaaaataaaaatactacatttccaacttcttttgatgcctcctttctattgcatggttttttgctcagaggccctctgtttactcaagagataagattcagctcagaacattgctgtagtattgtgttttttcttttaattgaaaatggttacaatcatgactgccatggaagaatgtcaaatgttataatcggccgtgttctcttgttctcattgcttttgttctgtcttcttagacctgggtcatcatgatagcaaatcagaatcacaacttcttcatggctatctcatgttctctttaccctgtgccatgtgtggaaaagtaaggtggcacttagattcctaatacttaaagtctcttggggaaaaaaaaagttttgctgacctaaaatgcttctgagtttagttcaaatttgagccttctgctgtgatcctggaatccaaagaaaccgaggtgatattgacccaagttcaataagactgtttcagatgagctgcaggaagagaggcagttcgcagatgaatgatcttattcagagccaacaacatccaagtgttttatgagaggcgaaaatagtgcagggagagcatgggaggtaaacaggtgctgctgccctgggggcaggggtggaatggggagggctggggtggggagagagctgcaccaccccatgagcttgtcagttctgatcaaagtcagcacctgcagctcccgatcaccatcgcccccttggaaaatgggtgttgattcatcatgtcaaggtcgatcactttgtagttctgcctaaaatacttaaaacattgttaggataggttttagatgtttttttaagtgcaagtattccctaaaatgccacaaattgcatcctttgaggacatctgttgcaagagaccacctgggaacatcccatcccatctacagaacccctgaagcccccagcatctgggaaggagatgggcgtgtggcaagggttgctgttatgaatcccttcctataaaccaaaggcccctggagggcagcctggtaccaaacaatgtatataaaaacagaaacattcagaaagtcttagaataacaaagcgacaggcactgactttggggaagtccggatgggctgcggacattgtgtgggatccaacagtgtcattttcctaggagtgtccccaattacgacagctcacctcggcagctgaaacttattctttcagatttcaaacgtctccttccctcctccctccagcttggccttcacactcttaataaaacattaaaaaacaccccacactatgctgcctgcacgtgtttcgcgagcttccctgaagtctgaccgtttctctgcatttccatattacagccatctttatccatttgcgtatagaggtgtccgtgcatgaggtctgatttcctgggaagtcagctgtgatgttattgtgttcaaagggaaagacagagaatatttttcactgctgtagaggctctgtgcctgccttttaaacttgaaagatcagtgggttttctgtggaacctgaacacagtattggaaaaagtgtttctgtaagaaaaaaactcattttctttaaagagccctactcattagcttacaggatttaactttctttggggggagggacaaaaaacataaaaatagatcactttattgagcatttgctctgcgccaagcagccttccaagtacttcacacaaatggttttatttaatctcgtaccatctctcctagggctgttgtgaggagtagacgaattaataaacacagagaacttaaagcaatcgagcatgtaatacttgttcaataagcatgagctatttgtgagtgacagtccagtgagataggtaccattatcatgcccattttacagatgaagaaacagaggcaggaaagttctggtatcttgctcaaggtgaagcaatgtgtaagtggttgagtcaaactaaaaaccagctcatagagaaggcaagatatagttcagtcctaaacgatgtttatatctgcacatcctttaagtgtaagatgccagtttgcactccaatctgttatcgttttctgtatttctttctcctccttctgagaaaataatctagaatgtaggataatatctatggcctcaggaatacttcttgatttttctcttctgtttctctgtcttgaaacagcatccccaaagatgctagtggagaatttaaaactatgagctcttggagctgattttaattttgctcgggtagcccaagggttaagttaaagatacagaggctgagttatcacgggcaggagtggatcctcctaagtcactcctgtaagacccttgctgcattcccccttagtgctatccggatcacgtattttgacgttggataaggccatttgcataatctcctctgccaatcctcttatagtaaaaatgggcacccagcgcccaagtggttaaggggctgctcccagtcacagctccccttgcaacctcctctttgttcacctggccctgaggtctgccctcctccctcctctgtccctggagagacccacttgcttcctgaggttaaccacagctccaactctcaccatttcaaacacccgcctgtgaccatgacctcatcccaaattctctacagacacctcgatggcaaataatccacactgcactcatctttgcttcccatcacactgcctgtcctctgttggttttctcctgtcttgatgaatgtcactttgccaccaaagtcagaaatggtgtggtcctccctgaccattccttcttgctccctctctacataaaacctaatcctggttctaccttctaaggacctctccatccacctgcttccccctagccccactgctagcaccctcgcgactgctgcaaaaatgcaggttgccacggcctcctcccttgggctcccccacactggccaagtggcttttgctctttgccatgcaaccttgttccccttttgcttggaataaaggtgcagcagtgctgctgtgaagatgaaatgatttagtcaagtcctgagaaaccagagacgtgggaaagcctcgtggtcagaggtgcaggtctggagtcccacagcccaggtttgcatgccagactctctgcttgctgcctgtgtgaccttgggtaagtgacacaacttctctgtgctccaaattcctcgtctgtaatattatgagcatgagagcagtaccaccaaagtttgtcagaggattgaattaatgcatgtaaagtggtcagctattgttcattcattcattcatttattcaacaattgcttactgaattgggggttccagatctgttatcagaccacccagttcctgttctgggtcttttagttgtcatgtgaccctgggaatttacttaacctctctgtgtcagggtcttcacatgtaaagtggggctgatgacagtacctccctgaatgcgttgaggattcactgagatagtcccagcagcctgttcagcacacagcaagtggtctcaaggctgtgctgctacgattactattatcacagccattgctattattgtagttattcttactacgtccaaagccctctgcaaggtgtgggcttacataggggatcatgagccagacccagtctgggtcccgatggaatgttttgatgctctgttgataacttctcttgccttctatatgaccctgcagcttccccttgctatgacctcacataggctgaatcttctgccttgtatgcatttaggggccctgtggaaatacatctacttttgggcctcctgccctgatgcctcacagaggcgcatataagatgtgccatgcaggtctctcctgtccactgcaaaaccacacacagaccaggtaccagttctgtttctcggccttagcatgtggtgggtggtgattggctggaggctggaggaaggaagggagggatgaatggatgtagatcttggacaatctacttctttgggcttcttctatgactccaccactgccatgcaaaacaggttgccatttttctaaaactaaggccgtggggtacagatgctgagaaatctccaaattaatgctgtcaacaattcctttggaaaccctgtactgagctaaagagaatctaaggactagtgatatgtgtttgcctttctttctttctttttttctttctttttctttctttccttccttccttcgttccttccttcactagtgatgtgtttgcctttctccttccttccttccttcactagtgatgtgtttggctgtctttctttctttctccttctttctttccttccttccttccttctttctttcctcccttccttccttctttccttccttcactagtgatgtgtttgcctgtctttctttctttccttctttccttccttccttcactagtgatgtttgcctgtctttctttctccttgcttctttcctccctccctccctctctccctcccttctttcctttctttttttccccagctttctgacttaaggccttgatgcttctcctaaaactcactgtctgtatgtgagggagggtcagatttcagcttagtagagagagagagagagagagagagaggaagagagagagagagggagaggaagaccttggagcattttgcttggaagctctacagctgctccttgcactgctcactgttaaactcacccagctgcgcccaacccagccacatgtcacaatcccttcacattcgtaaacaagatcagtcatttctgggatggatccacagtgagacacattcagggataactaacaacaaaggctcttaggtatgttgttgaatatgactttccttgggaccacattttcgagcctacacacctgagcatgggcaggtctgaagctgctgtagtccaggaattttagaaccaaatgtctttgtgttatatctagccttgtggctcacagcagcatccggacaatgttacccttctggactttttgaaagttctattccaaatatgttattttcattttccctaagagtgacaaaaaggaaacgctatacccatacatgcacagagacatcaatatttctatgtagtcttttggggactaggcgaaacaatcaacaaagaaattttatttgggggcatttctgaagcttttctgccttcttttttaatgcactgaaagctctttgggatcttgcattcttttactttgcctacctagctggtgtttcctccgtttgtcaaacttgatcccaaaccaccgatctgcctgctcctgtgccctgcaaatattcacggccaagtgcagtagcccctcaaagccaatgtaagcctgtttccagccctagtgttgatgggtgatcttatgtttaccaggctgaagttctgaacaccctcttcagaaaacagactgcactagctccaggctctcctcctcgttggtaagcgtgtcatccatgctccaagttttccagagctccttgtttaacttggagctggacaaaagcatggccccaggggcagcttggcttgctttatattaatagagtcctcaccacagtaggactgcactgtgcccttgcttccttctggctggaacttgagtgtagctgtgcctttgaccagcagacctggggcagttctttacagctacccagttctaacaggaaaccctggagaagaaccaagtaccatgaagttccaaagctgcttaacttcctcttaaggattcgccacccttagcaggtattttatcccgtccaggtctataatctgttttgtaaatgtcttcatagttcagagtcactgcaaagccagcacactttgggctgatgtatacagctctgtctaggtaccatttgagcctagcaggtcaattgaatacagatgatttaattctcctaatcggttggctctactctctgaatatattaaaactggctaatccaggctcatgagtgggtcacgcttagtggtgaggctctccttggtgatgtgtgtctacaactaagccctcatgtccagctaccaacagtcacagaaacgacttccaacttcacacattgcctgactgcagttcctcagaaactcacaagtgaatgattcttccaatcttggaatcctctgatctgcaattttatacagataaccagtactctctggctagaagcacaaccccagaatttgcttaaaaagcaaagggagaaagtgtcctgtagtctctccacacacagagaagggaaacctcaccatgaaccagggactagcagcaaactaaagaacatattttatttttaataaaatagtggagcatgaaaaatatcatatattacaaatatacacacgcagaaaccactctttcctggcactgtgaagagaatacactagacaaagtgtctctgccaacctagtgcttcctgatctgtttgtggaaatcatttgtttaacaatagaaagagtcaataagcctttgggtaacttttgaatgatccttctccctcttcccccctcctttccacaaatcagtccaaacgtctataacattggcttggtttccattaaaaagccacaaaatgtagcactgaagggtttctgagggctgggcctcttagttcttttgttaggagatttcttttgttgtctttatatatagcaaaatacttgtttctctttttattttcaaggaaagagaaaaaaatgtattgcacatcgtttgagttcacaaatgtgaggtttgatggaggtttctgtcttgcagagagactattggtgaaggccggagtctattttaagcaactccaaatccactggggtgtgaggcgggccccgggtcctgtctttcctctgcagggatgccgcccagcactgtggccttcctgggggtgggccctggggatggctcatttgttaacccaggggaggctcttgaatttgcaaagcagttatctgtcctcttatttgtaaatgggtagcaaagccaactcaaatacacagatgtatatttagggagggctctaaacaaaagttttcttctgagggctgaatcaactactttaccacaaattagttacacaagaggctacttcactggaggagcttcccttcgctggaaaaccaaaacaaaacaaaaccctttaagtacatttttcctttcagtgtatcacagcatcctgaatttcagggtaaacacttttttatgtatttctcttttgcttttataaaaaaaaaaaaagaagaagaagaaagaaaaacacaaccaagaaaagcaccacatcttagctccgggcgcccctgtgcccttccctccagccctgttcacacgcaggtgggcgactgggcagggatctcatatttcccgtggtgagttttctggggatgctgggcttttttgtaaatcccaccgctggtgatcacgctggccggttttctccggctcttcttctttaacctacggctgcacacctgctgccaggactgcagagtcttggaggtccaaatccacatcccgctggtgatccccaccaccagcagcataaagatcttcaccatgaagatctccacggcggggatggaggcggccatcaggcagtccagcgttttagtctggttgttcattttgcacttgtgctgcgccgccaggatcttccagtaatccatgttgaggcgttcgtaaaagtagcaggcgatcacacaggtggccggcacggtgtacagcacagagaagagcccgatacgcaccatgagcttctccagcttgtccgtgttctcgccgcccgtcttcatcgacctccggatgtggaacagggccacgaagcccgagaggatgaaggacgtgccgatgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgaggaccaagacctcgtctgtttcactcatgatgatatccctagcacctggccaaatgcctcgcagctgctgagacaggagacacggcacattgggaggggtggaggagtgtctcccaaaaagatatgtccaaggaagcgaccttatttagaaataggactttgcaggtgtaatccaattatagatttggaaataggattatcttgaattgaggatgggccctaaatccagtgattggtgtctttataaaagaaaaggaaggaggacgtgagacccaggggtgcaatggggaggcactgtgaagacagagccgaggcgggagggatgcttgcctcggcccaagaatgccaagcactgtccgcagacaccagaagccggggagaggtgaatgcttttccagagggaaccagggctgccaacacctccatgtctaacttcgggcctcttgaactgtgcaaaaataaattttagctgttttcacccatccagtttgtgaacagttgttgcagcaggcctgggaaactgatacatgtattttctgaatgaagaaacatctaaaaagaacttctgctggcagaaagcctgtagcccaggaagtagatctttgaagagcacctattctgcattcaggaaccacctggtgaagttctttctgaggaatttagattttgtgtagccaggcgtcttccagaagtgtggtgagggagtcattgctgagagacttgtgcagtgaatattccaactcccgggtttgatggcattcctggttgggggtggtggctggcacctgtaatcccagctctttgggaggccaaggcaggaggatggcttgagcacaggagctcgagaccagcctgggcaacatagtgagaccttgtctctacaaaaatgtttaaaaattagcctggtgtggtgatgcatgcctgtagtcccagctacttgggaggctgaagtgggaggatccctagagcttagaagttcaaggctacagtaagccaggatcatgccgctgcactccagcctagatgacagagtaagactccatctcgaaaaataagaactgaaaataaaacctaaaaaaagaaataaaagtaaaggtgtccctctttcctcctgtgaaatgcactaaccctgaccacactgaatgtcagagagtggtggtacactcacgccccttccacctgtttctgagacttggctgtctacattcccaaacctgcttttgccagctgtatctgcaactggcagtgtatggtttaatgaaatataatctcaaccaatgggatatgaatgcaaaaatcatttctaggaaaaatactttcaatgctttggaaagatttaataaaagcaggttgcaaaaacaaaaaaaaaaagccatcaaagtacatgtaggccagacaagtgaaagatttgagtgataaatcacgaaatgcatgcaagaaccctgtgctcatgcttttcttcacagatccctttgcgtcctcaatccacgttacataaatagacgtgaagtcacacagataccttttggacgaggttatgcaagaaagaaaagcgggacatcaatcaggatgtgcacactcaaagaaaagatcttgtttgtctcttgaactattggcaaataaatgcacatttctatgtttttgtgttaaaatagaagccttaaatcttcatggattaactcaccatcacagatgcattgggcttctactgtttccaagtcatggatggccgcctagaatttctaggcagggataatgtaatgctgacatgggcagtgtaaagatattatttctgaaatctgcaaagtctgcacacaagtaaaaaggagtctccttgacggttttctgtcaagcgctccgggggaggatttactggacacacgggtttctctgcccagccgtgcaactcaccgtcctgctcacgatctggtgtttgttgttccatcctcctggcttccccacctacctggttccccttggtgtgtctggcttacaccacctgcctggcctgcccacgtgcagaggccattgggaatacaggtgcagcccagctgtggccaggacgcaggtctcgtttagtgaatgcgtaatgatctgaagacagaaaggtcatcctggaggagacacccgtgccaataccccataaaaacccaccgaatcttcctcttcctttttttttttttttccacagatggagcctcactccatcactcaggctggagaacagtggcacaatcacagatctctgcagactcaacctcctaggcttaagtggtcctcctgtctcagcctccccagtagctgggactacaggtgcacaccatcacgtccagctaatctaaaaaaaaaagtatttttagtagagatgagatctctatgttgcccaggctggtctcaaactccgggcctcatgccatcctcccactccagcctcccaaagtgctgggactgcaggcaagcactgtaagccactgtgcccagccagaatcttcctcttaaaaacacaaaaatggggacagtagattaacattcctcctggatacccttggaggtgaactgtgaaccacccccaagaatattaactaaatccacaaccatctttgaatattagcctgggaacagattacaggcaggtcttctggggcaaaacgtccataccagccctcaaacatcaaaacttttccccttgaaccttgcagtggactcccacaggcacttcagcaatggtgattcagatgtgcagagaaaacaataatattttctaggaaattctgggggaagtctctgctgcgtttccgctgctgtctgtcctgctgataaaagttttgatgatgtggcttttttatctgaacaagctccagatgaacgtagcagaggtgccacatgccaagataatttaaagacgattttaaaagaaatacacagatgaaaaatttgtttctctctgccctggactctatatgaatgcgatttgaggacatccaaagctgagtccagggtgttaccacttaagctgagagagaaaaacattggtgggagattcacagaaagccagcatttccccttgtggtaagactgtagaaagccacgtcccctgaagtggcttgaatagtgtcattcccacaccctagattcatgtccactcaaagcctgtgaatatgaccttatttcaaaatagagtatttgcagatgtgattagttaagggtctctagatgagatcagttggattagggtgatccaatgatgagtgtctttataagggaaaggagaaggagatttggacactgaaagacagagagaaggaagaagccacatgaggacagatggagcgactggagtgaagcggccacaagccaagtatgcctggagccacgaggagctggaagaggcaagaaggattgtgccctagagcctctgcagggagcatggtcctatccacaccttgattttagacttctggccaccagaactgtgaaagaataaatttctgtttttttaagccactcagtctatggtagtctgcaatggccaccctgagaatgagtgcatcctcttggtctaacacgtatgcatttcctctgccaataatcttgcgtttggtcctcatagaactctccacctatccacctcctgtttatcttctttgtgtctacatttttgtctgctccttcttccagagaaaatgtagaatcactcggttccatgaacaggaccattggtgtaagactaggtcaaaccctgacttcaccacttatgagctccttggtgtggggccactgccttcatcacgctgagtcctgattttctcatccataaagtgggcataaaaatagtccccagcatgggattgtttgaaaggttacatgtgacactgtgagccctgagtggatggactgcccagcattgagcaagtgcttgtgagcagtcctgcagatgatggcaggtgtgttggtgggatgttctacccaggcccctcctgccagcacacactgtgccatgatggggcagtctcgtctcatagtccttcttttcctcttcctccagctgtataaggaggagagagtcaggcccatcaccatgcaggggggtgatatgatttggctgtatccccaccacaatctcatcttgaattgtagttcccataatccccatgtgtcatacaaggggactggtgggaggtaattgaatcatggggagcagttactcccatgctgtactcttgatagtgatagagtgatagagtgagttttcatgagatatgatggtcttatgaggggcttttccccctttgcttggcacttctctctcctgctgccatgtgaagaaggacatgtttgcttccccttccaccatgactgtaagtttcctgaggcctccccagccaagtggaactgtgagtcaattaagcctctttcctttataaattacccagtctctggtatttcctcatagcagtgtgagaacagactaatacagtgaattgctaccagtagagtgaggcgttgctgaagagacacctgaaaatgtggaagtgactttggagctggatgacaggcagattggaacagtttagagtgttcagaagaaaataggaaaatgtgggaaagtttggaacttcctagagacttgttgaatggttttcaccaaaatgctgatagtgatatgaacaatgaagtccagactgaggtggtctcagatggagaagaggaacttcttgggaactgaagcaaaggtgactcttgctatgcttcagcaatgagactggcatttttcccctgccctatagatctgtggaactttgaacttgagagagatgatttagggtatgtagtggaaaaaattcctaagctacaaagcattcaagaggaaacagaacacaaaagtttggaaaatttgcagcatgatcatgcaatagaaaagaaaacccactggggggagaaattcaagcccgctacagaaatttgcataagtaatgaggagcctaatgttaatcccaaagacaatggggaaaatgtctccagggcatgtcagagaccttcatggcagcccctcccatcacagacccaaaggcctaggagggaaaaatggtttccttgggctgggctcagggtccccctgctctgtgcagccttgggacatggtgccctacatcccagctgcttcagctcccgtcttggctaaaaggggcaaaggtacagctcaggctattgcttcagagggtaccagccccaagccttggtgacttttacatggtgttgagcctgtgggtgcccaaaagtcaataattgaggtttgggaacctccacttagatttcagaggatgtatggaaatgcctgggcgtccagtccagccaagtttgcttcatgggcagggacctcatggagaacctctgctagggcagtgtggaaggaaaatgtggggtcagagcccccacagagagtccccaccgaggcactgcctaatggagctgtgagaagagggccaccatcctccagattccagaatggtagatccaccaacagtttgcaccatgcacctggaaatgctgcagacactcaaggccagccatgaaagcagccaggagaggggctataccttgcaaagccaaacaggcagagctgcccaaggccatgggagcccacctcttgcatcagcatgacctgaatgtgagacacggaatcaaaggagatcattttggaaccttacagtttaatgactgccctattggattttggacttgcatggggcctgcagcctattgttttggccaatttctctcatttggaatggctgtatttacccaatgcttgtacccccattttatctaggaagtaactaacttgttttttattttacaggcttataggcagaagggatttgccttgcctcagatgagactttggacttagacttttgggttaattctggaatgagctaggactttaagggactgttggaaaggcacgattggttttgaaacgtgaggacatgagatttgggagaggccaggggaggaatgatatggtttggctgtatccccaccgaaatctcatcttgaattgtagctaccataatccccacatgtcatgggagggacctggtgggggtaatttaatcatgggagtggttacccccatactgttctcgtgatagtgcattctcatgagatctgatggtttgataagaggtttttccccctcctgctcagcacttctccttgctgcagccgtgtgaagaaggacgtgtttgcttccccttccgccatgattgtaagtttcctgaggtctccccagccatgcagaactgtgagtcaattaaacctcttctctttataaattaccccgtctcaggtatttcttcatagcagcatgagaatggagtaatataggagggctctgagcagagcaagcagggtgtcctagctgagtgcacccctcaactccgttccactggtctcctcaacggcaaggctccccctgccccggggagccccctcttaactcaggagggcctggctgactctgtctttctcccacatctccagggccactgctagctgggtgcggatctccagggccactgctagctgggtgcggtggctccagctggttgtctggacctgcccagattctcaggcagaatcagaacatgtgccaggcccagataagcatctgtgtttgcaaacagacaagcacggaggcctgctcccacccagctcgccgccccagtgttatcaccaggcctgagatgctcagaagtgctgccagcatctcaggaaagcaagctgtgaattcccggggccaccgggagcaactgctgcctggctctcagcttctggccaccctagcgtccagctcaggtgttgggcagggaccaggggtgtctgggcaggaagctcaatgcaggagcttggcagcctctcccagggctagagcatggacgtgggggccgtgcatcccttcccaccctcctgttgccagtgggagttagaaaacacagctagtgcctggtaaactgtccccacgacatccaggctatggctttagcagcagcgaacctataagtggggcagctgtgatggacacaactccaatattgtccagcttccatcccttgctacccaagattgggagctctgctgggtccagggtgaccacagcctggcatgggagagagatgagggacagagggaacagggaggttctgttctaggatgtgggagggacgatgttattagagcacagagtgaggagatcaatcctgaagggttatgtgggagccacaggaatgagaaataacaataattattatagctcaccaggcactcttccaagtttatcttcattaaattatctcaaccattttatgaagtaggcactattatgaccattgctttacagatgaggaaaccggggcactagaaatcaacataatttgtcccaaattacccagggaataaatgcagaagtggattttgaagtcaggcagcctgtcttcagacgaggcttttaaattttacatcatacagatgtccctgacgccacagccgagagaccatgggggctggaatgttgaccccacaggcaggcagcttccttgggagccaccacaaactcgatacctttctagggttgggagctaagtgccccatctttcctgttcaaatccatagaggcctgtcccctgcaatcagccaaccacacatgcccactgcccaccctacaggactgatgccctctggcctatcctgcctggcttgtcctatgaacaacctccctgctcgacactgtggtgcctcaaggtgtcccacaggaggcgcctgagaccctggatgccaggaaggggttaggtgtggagaggggacccttttccttaaaaatttgattggctgaacagtgaaaacattaaaggaatcaattatgggttcagttcataattttgtttcaatctctgagttactgatcaaaacgaaaacaaatgttttgcacaaaattcatcatgcattgcttaactatgaggagacactttctgagaagtgtgtccttaggcgattttgtggttgtgtgaacgtcatagactggatttacccaaacctagatggtgtcacacaccacacacctgggctgtatagtgtggcctattgctcctgggctacaaacccacaacatgttactgcactgaacacagtaggtgattgtaacacaatggtgagtatttctgtatctaaacacatctaaatagagaaaatgtacagtaaaaataccatataaaagtttaaaaatggtgcatctgtatagggcatgtaccatgaatggagcttgcaggcctggacgttgctgtggtgggtgagtgagtggtgagtgaatgtgaaggcctaggacattcccgtacgtgactgtagactctgtaaacactgtacacttaagatgctctgaatctaagaaaaaataaagtgcgccatgacgttacaactgttgccacgtcactaggtgatagggatttttcagctccattgtaatcttacgggaccaccattgtacatgtggtctgttgttgaccatatcgttgttctgcgtagcgcgtgaccggagtttgggcaatgctgtccttgtgacagacaggacagagagaaaataaactaacatagaagtctcaagggcagcgatttgctcaaaatagctcacactggctcacgagggccaaatgttaaattttcaggaatgtgtgagtctattgtcatcaggttggcaggatgcacttggccatgctgcaagtatttacaccatggaaactggcaggtgctacaaaccagggcatatggttttagggagctagttgttaagcactggccagcacaccactgactcagggacaggataaggatgggggctcggaatacctgggttccagactcagttgtgccactcatccatcatgacggtggcctccatttcctcatctttataaaataggaacagaggctgggtgtggtggctcacacctgtaatcccagcattttgggaggccaggcaggcagatcacctgagtttcagagtttgagaccagccttgccacgctgtgaaaccccatatctactagaattacaaaatttgaccggtgtggcctgtgtgtctgttatccctgccctcgggagcctgagccggcaattgcttaactttaactgtgtaaactccgtcaccttaaatcctgcctagactccgcacttgcactaagtcaggctcgaaataagactgaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactatctgtcctacggttcctggttccaaattctggacttctgacctgctgttcatgtccgttcccctccaaccccacacccccaccccttagctgaaaatggctgaagagggagtttctgtggcttgctaccaagaaacctgtctgatacagcggggtaaggcagtgtgctcagagggaaacgtgaggaatcgagaagatggagcaattcatacacctatggatgaagaggacttttagaaacctcttgacaatgattgtgctcccctggctttggatggtcaaatgttcacctcgactttgctctgtggccagcgtgtcaggcattggcaataaagaggctggactgagggctgaggggactttggagtcaggctgccaagttccagaaaacagctgctgagccttttgaagttagtatttcattacagacccaggtgcagttgtctctgtctgtttgcccctaaatgtctgagtcagctcaagggatgggcagggtggggagggagcggaaggggccgcgtttggtcctggtcctccaccacgaagttcacttcccagatggctgcattggagaaatggctctgccttcaggatgctggtgcgcattctccttgctatcctcatgctctttagcctatgagcagcaggtcacctgtgctgagacaacagggcagggccgagcagctggagccagctcctcaaccgcccttcagcagtctgtgtctctcctgcctctgacgactgcagacagctaagatgggagagtggacggggagagggggggcccatctctggaagatgccaatgtgtgactgatctgagacaaatataggccatcacatggcaggacatgccctgcgtttcatagcctaaatcccaaagccaaagggattctgtgcatggttttgttttgatatcaagggacgagactccctcctcagccccccagaggacctgccatgcgggaggcacagggcgagctgagcgtggcagttctgggagtgtgtcctctacaccctaatacgtcctgcctctgtgcagcctttattgtgtctctgaaggaagctacacccggtggacacagcagaagccccttggcctagagtgacttgctgtctcggggggctgaggaaaaaacagggaaaggtgacccaggaccatcccagatgccacggggcactgcagggaggcttgggaggctgtggctgcccctgatgtgtctctgggccttggtttgaacgaggccccaggacctcgcctaccaattcctgaggctgggggaggcagcgttctttattctttccctgccccatgctactccccagctagataattgtgcccatagattgaacacctcttaaaccagcagaaatgtggtcccacccaccaggggagcacagaccctgtgaatgtgtgaactccactgcgtgtgtcagggctccgggcagaagacctgcagacaagcagacccgtcggagaccagaggccatggctcgggatccagatggtggttgtggggggtctcaaaatcagccagagcccgggagcagtgtgggatagggagccggcgagcgtgccattgcagaccacatggacccctattccctggagacaggagcgaaggagaagtaggcttacagatggcgccaagggtctgcgttgagatgatgaacagacaagaaaatcatggctggaggaggcaggggtggaatcccagctgcaggtggggctgcagccgtgtgcagcaggggctgctctgacagtcacttttatggacctacttggtcctctaggccccatgaccaagatgccatagtgtccttctcttaccaatgagccactcaaatgttacatccttgcccaaggtcacacggctagcaggtggcaggaggcaggatttagactcagtctgtccagcttgagaatctgtgttctaacagcccctctaagcacacttttggagacgtgtgtgagtttcctgccataacaaaccaccacaaactaggtggtttcaaacagcagaaatttattcttgagcagatctggagaccagaagtctgaaaccatggtgtccacagggtcatgccctctccaaatgatctaggggagggtccttgctgcctctttcaggttctggtggctccaggtggccccagctcacggctgcatcactccaatccctgcctccatcttcacacagtcttctccctgcatctccgtgtctcaaatctccttctcctttctccagttatggatttagtgcccaccctaaacccagaatgatcacatcccaagatccttaacgtacttacatccacaaaggccctatttccaaataaggaaggtcacattcacagaaccaaggattaaggacttggatgtacctattgggtggcacgattcattcaactgcttacagggggtttatttattaagtttttttggggaaagaaaacgagctgtggtaaacagaggagggactgggatcgagagaataggtccaagggttcgcgcaggagatatggggccacaggcggaagtgaaaggatggtgagaataagcattaacttggagccatatggagtggagaaggaccatcaggtgaccctccaggtcttcagggaagaatgaggggggctgggtggagcttggcctgggggaggaggacccactgggaaatgggattgtcaatcagatgggactggaatgacccacagaagcagaaaatgctcagctgaggtagaaaagcatgattttctactatggccaatctgttccaaaggaaaaaaaaatctttcccactggtccatgacattttggaaattctccacacagaactgtctattctctacatcaaacaaacctactatccaatggaatgaaaacatcaaccttaaaagagaggaaaacacatgtcccacacagaagaagtacacaaatgctcatagcagtattattcacaatggcccaaaaattgaaataatccaagtgtccatcagagagaggatgaatgggtaaacaaaacacggtcaatccccacgatgaaatattatgcagccatgaaaaggaaagtatggatttatctgctgcatgaatgaatgctgacacattctcttaagtgaaagaagtcagtgatgaaggaccccacactgtatgatttacatgagatgatgtccagaatagaaaaatctatagacagaaattagatttgtgtttgcctaggactgaggaggggagtgtgggggccgactgtgaaagccatggttttctttctagggtgctatgaatgatctaagattgatgatggtgatgattgcataattctgtaaacataccaaaagccatgaaattgcacaccttctatggatgaatgtatggtatgtgaattatagctcaggaaagctattaaaaacatcaacctaaacctttgtacatggctggtaggaatgtaaaaatggtcctgtttctgtggaaaacagtttggtggttcttcaaaaagttaaaaatagaattattatgtaaaccagcaattttattcataggtatataccctgaaaattgaaaacagatgttcaaaccaatacgtgtacacatgccacagtagaacagttcacaacagctggaaggtgaagacagcccaaatgtccatccacggatgcataaaacacaaagtatgatctgtccatatgaaggaatattattcggtcatgaaaaggaatgaagctctgactgactctgcaacatggatgaacctcaagaaacatcatgctgagtgaaagatgccaacacaaaaggccgcacgctgtgtgattccatttctacgagctgtccagaagaggcaaacccggagagacagaaagcagagtgattgccaggggccaggggagggaagaatggcaagtgactcattattgggtggagggtttaccttggagtgacgatgttttagaaccgcagagaagtggtagttgcacgcactgtgaatgttctacgtgtcaccgagtgatacactttcaatgtttaactttatgttgtgtgaatttcacctcaatgaattatttaaagaaaaatcaacctgaagattgataactgttctgctcctgattggtggccttggctatgcaagcatcctttcttttccctactttctctttaaccctcatttctccttcctggaaaactggaataacaatatttttgtggggatggaaggagatcttatgtattaaatgcctgataagctttcatagacttatagtggtaagagttgtttgtttgcttttcccccatgcctagcagtattcaataaatatctgtgggaatgagttaaatagcttaagttgatgtgagaagatggtctattgggtttcctgcaggagacgggtggctctcagagggcagatgggctgtgtccccccagaattcatgtgttgaaggcctggccccccatgtgatggtattagcaggtgagggctttgggggagtgactggggtgagatgaggccaggagagtgggggccccatggtgggatgggaagaggaaagtgcctgacacttcacccacacacgccgaagatagacagtaaggaggctgccgtgtacactccagggatggagccctgatgaggaactgaattggcaccttgatcttgtatgattgatcctgtgctgcctccagaactgggagcaggaaaggtctgttggtgaagtcacctagcccatggtattttactggagcagcatgagctccctaagacagatggtttccctggaaaggacttaagagagggactcttgatcaaggtgtgtgtgatggttaatactgagtgtcaacttgattggattgaaggatacaaagtattgatcctgggtgtgtctgtgaggctgttgcaaaggagattcacatttgagtcagtgggccgggaaaggcagacccaccctcaatctgggggggcacgatctaatctgctgcctgctcagctcaaatataagcaggcagaaaaatgtgaaaagagagaccggcctagcctcccagcctacacctttctccagtgctggatgcttcctggatgatcccttgaactggacttggacttggactggctctccttgctcctcagcctgcagacggcctattgtgggacctcgccatcatacttaataaactcccctttatctatatatctattccattagttctggccctctagagaaccctgtctcatacagtgtgggtagagttaagagaaacataagtgaatggcgaggcccagagagaacagccaagtgggtgtcgctgcaatggaaccagtctgatggggtccaggaggagctgggcagcagaagcctgctccggagagctgcagcctcgatggaggagccacagcccgcagcagctgaagctgcagggaagggacggcccccaccctaggcctggccaggagggacagggcggaacccgtgccctggaagctcactctctccccgtcctccagtctcccttgctggtaccactccgttggccaaactggacccaatccagaggtcagggggccctgagacatgtggtgtgtggggtcagccttctgggggcagagaggaagagaggggattggaagagacaacgggagaaagacctacactgaagctcctctcggacctactcagtgctgaggatgggccgccggtggatgcacgaacctcctcttcctctgtgcttcctccacctccttctacacccacaacaccgaacatggacagaggcatccaggtgatgctaaatcgttgctgccacttgagtgcactcggctgtgctcagagctgacctgtgccctggtcagcaggaactgaaaggtatttctaggaacggtgcactcaccccacacatcttgcaggcctgctcctcggtcaacggtggccagaggacagtttttgctgtttttcatgtcctggtgaccagtctttcttgtctctgctgatcacaggtggagctacaacataattagtaggtggagttgcctcggaaaacattcctgtggtcaattttattttttaaagctgggaaatccaggtctctgggtggcccctgtggtgtcccttgtgctcttcagttggctcagaactcgtcgtcttttttaagtaactcaagaaattatgtgggtcagctgcacaggcgtacacaaaaactccagtcttgacagcatcgctggaccattttttttttttgaggtggagtttcgctctttcgcccaggctggagtgcagtggtgcaatctcggctcacggcaaccttcgtctcccgggttcaagtgattctcctgcctcagtgcctcagcctcccgagtagctgggattacaagcacccgccaccacgcccggctaatttttgtatttttagtagagacggggtttcaccatgttggacaggctggtcttgaactcctgacctcgtgatccgcccacctcggcctcccaaagtgctgggattacaggcatgagccaccgtgcccggctgctggacccatttttaacaagtcttagattcgtgaaggtttcctaaatgaaaatcttaaaaaaaaaaaaagtgtgtttatatctttgcagtcctagatcgtgaaatatttctccagaaatatcctctcaagctgaaatccccacgtctctggttttacttctgtatacctcctaagtatcggagcttcaacttctttgtccatctgctgaagcagagaatctgctccatccatgatgaaatgtaaagcctgcagatgcataaatctcttgaaaacaggtgagagaaaggccaggcagccatcctcggatagaccactgaacttaacgagccctgtgcttcctgggcccttaatctaaataagaaacataccgaaagctataaaagctacgggcctttctttgaaatctcaattaaaaccaacacaaaacaagaatgctgaatgtccccatccaggaccatctctcaggaataaacctttaaaatctcagtaacttgaattagaaccacttccctccacgcgcgtctacaattcttccgacgtttactgaaaaataaataaatcttacaaaccgggaaggatgggctgagagagaacacaattacatctaccatctcaaaaccgtttttcaaatcttttcagtcttggcgaaatgccaaaacatgttttgacatgattcttccccccctaatttataacctatgtgtatctgcaaggaaatttaatccttatgtttctgattcctttacacttaactcatcaaatgttactgtggaagagccatttgatgtgaaggggccttagagccttttttatgaggacttttaaacctgttcccccttagaaacaggaagccaggtttttccaggagtaaacaaactcagcccacaaaaagtgtccctcgtccgcctggagaccagatccggagtcctccagcggctcccaaactgtcagcacatttgacaaaattgcagtacagcagcatctttcaaggagaagttcctctggttaaaaatcagcgtgccgcaaaaggcagggacgggatcactgtggcaggaaggagttaattattctatctagaatcaacttctgttgccattttatgagaaaacaaaagatggggcgtccggggcaggagatgaaaggaggccgtttccgctctttctctttgtggatttaggggcaccctgtcccgggtggtaagaaaggccacagggtcctatccccttctctgattgagaggcagggactcacttccctctccttgaagttaggtgggctacgtgactgctttgtcaaaagagcatggtggtaatcccagcactttgggaggccgaggagggaggatggcttgagcccaggagttcaagaccccatctctacaaaaaattttaaaaatcagttgggtacagtggcacatgcttgtagtcacagctacttgggaggctaagctgggaggatccctgagcctgggaggttggggctgcctggtgcagtggctcatgcctgtaattgcaccacttagggagactgaggcaagggatcgcttgagtccaggagtttgagaccagcctgggcaacatagggaggtcccttctctacaaaaaaaattaaacattagccaggcatggtggcacacacctatggtcccagctactcaggaggatgagttggcaggatcacttgaacccaggagtcagtgagctctgatcacaccacagcactgtaccctggacaactgagcaagaccctgtctcataaagaaagaaagaaaaaaaaaaaaaccagcatggcagagggagtgccctggccagccccattttctttctcttaaagaatgctctctctgggcagagccaattgccgtgtaagaagtttaactgctcttgatgagttaatgggtgcagcacaccaacatggcacatgtatacatatgtaacaaaccttcacgtggtgcacatgtaccctaaaacttaaagtataataataataaaataaaataaaaaataagtttaactactctgagccagccatgctgtgaggaagcccaagctacagccaggtgagggggcccaagaggaggcgacaccatgtggggtttgggggaaaagagagaccaaggtggcagcaagaggccaagttcatgagtgaaatgaaaagcagaagtgtatcctccagccccagccaccccagccattgccaaggtggccagagacaaatgacccagccaatgcctgacaacattcctgacttgccaaattgtgagctgaatatgaataaaagagtcatttgaggaagctgagttttgaggtgtttcactgtggaataacaaagaacccgaacaccctgagtgaatcgactcccctcccctggctggtctcctgcctagtgaggcagctgcttttgtgacaattatattcgtgtctcagttggttgcaagtaagagaaaaccccacggaactgtctctaaaaagtaatttatggactgaaaagcacaggagagattttatccaggcactgtttgattcgaggtgtgtcatgtcaccatggcttagtgtcggagtttctgaaaatagccccactccaagtgttgaccttctcctgggatcgggggcccttgaaatagtaaacatggcagaggccctttgaacccgacgtcctgtgctgcgtgacccagaggaagagagggtgtctgtgcccacccatgcctgagcctcacactgattgggttggtttccgtcaatgcccacctttgtggatatctcaaggaagtgagccagtggagacggggtggggacaacattgcctcagctgcatggatacccaaagagaaaaggggtgaaatgaatattaggatggcaacctgcacatgcccactcatgaaacagacaccattttaacacttgctccggaataagcagatactgcaaagtctgccagccttcctttctttttttttttttttgagatgaagtctcactctgtcgcccaggctggagtacaatggtgtgatctcagctcactgcaacctctgccttctgggttcaagcaattctcttgcctcagcctcctgaataactgggattacaggtgcccaccaccatgcccagctaatttttgtatttttagtggatacggggtttcaccatgttggtcaggctggtctcaaactcctgaccccaagttatctgcccactcagcctcccagagtgctgggattacaggcgaaagccactgcacccggccttcctttgcttccccatccccttcccttccctcccctccccacccctccccttcctttccctcctctcttccttttctttctttttattttttgagacagggtctccctgtgttgcccaggcttgtcttattcaggaattatataacttgctttgtgtagtaacaacagggcaatatttgaaatgttcaacaactgatttggcataggggtgtggacaaattcaaaaacacaccagacaaaacaaactggaagggctgccctggtccgtcctgtctgaagatcagcctgcttagcagtgccgtgtggccattttcccatgttaatgacacggttctacgtaattactttaatgactacatgttactctattttaaggattttccataattggcttgaatagtcagcttaccggtatatatttagactgttcccaattttcaatacaacatttatttggaagtggaattgctgggtcaaaggacatgtatactgcaaacggcactaggtacacatcacacttgttctccagaaagggtgagctactttatggttccactctgtgatacagggagtccatttctccatgcctgagcaaaatccaggtattatccgctttaaaaaaaaaaaaaaaagtaccaagctggccaggcgcggtggctcacacctgtaatcctcgcactttgggaggctgaagcgggcggatcacttgagctcaggagttcaaaagcagcctggccaacatggtgaaaccctgtctctactgaaaatacaaacaaattagacgggcatgatggtggacgcctgtaatcccagctacttgggaggctgaggcgggggaattgcttaaactggggaggcagaggttgcagtgagccgagatcatgccactgcactccagcctgggcaacagagagagactctgtctcaaagaaaaaaaaaacggggaaacctgttaggcacaaataatcatttttttatgcatgcacccttggattattagaagtgagcttaaataactttccacaggtttatgggtcactagcatttcttctaatttgaattgcctactcatagacccagacaagaaacttaagtttttgtcttttaattttgtttatggagattttgcaattttttttaaattaactgatttcttacattacagaattttacatttttatgtagtgaaattatgatttttaaaaaatggctttagctttgatgtcatgctaagaagacattttcctgataagtttataaaaaatgtttacctgtaatttctttctattgaatgaaaactttagataacattttcccctaattactgtattatttttatgtttaaatgttttatcaatccaacatgtattttggtgaaaggcatgaggtggggatggaatattactttccccacatctaaactaagcctcaacagtattgactgcgtaatccattctttcttatttatttgaaatgcacttgagactctttctggatttcctattttgttccattattttgtctgttttaacacttggcccatgctgtctgtttctgcagactcacagtgtacttcactgatagattatgtcctttcttatccctgttccagggttttttccttgactactgctcaaattttatggatttaatatcatcttgtggagttccacagaaatacatattttaaagttgcaattgcattatgtttaggaattaacttggggataattgacatatttacaggcacatgacatgagcttccaattatttgagccaattatttatgctcttcagtaacatcttcacattgtcttccaaaaggcttgcacaccccctatgttaatttctagatagtttgtgcttgttgtaggcattgcataagtgatcttaaattttcttcatattttcaactggttcctgctggtgcatgaggatgctattggtttttgtagctatgttttgtcctggtctccttatgaaaatctcatcaattctatttccagctaagtcacttttcaatgacaacagctgcaaataatgacagtttccaatggttttaccttcctttttctttcctcttctctgacttcagggttaatcatgttccgggtagtgaccagtaatcatagatagccttgttttgtctctggttttagtaaaaatgcttttagtgtcccattatcttgtataacatttgctgggtgtctaatgatcccactccttgttagatgcttcctggagatttgtctttacttgggcacattcttccttgacaagaattgagaccatggtaaacacattcaggggacagccagcaagatgaaaccaagttatctgggcaacagttttaagaataaaaagaaagatccagggagcacatattactctctggatcccctgagagttggcaggttgggtgttctgtgcctcttaggaaaataagcctgatatagcaaattagtcctgggcatcttgaaccctactctgcacacaaatcactggggctcttgctaaaaggcagctcctgagtcagtaggtttgggtgtaccccaaattctgcatttgtgataggctcccatatataagtggctttcccatggaaaaacaagtagacttgctctgtgaagctctatgtggcaaaagtagagataataatagaaaatagttacaaggaagcaaattttaactcaacataagaaattgttttaattgacagctagtccactacaggacacccaggaagtgatgcccaagatgtgttcatataattacagccaggagtaagtggggtcgttctgaacttctggtgggtggccaaatagattcttcactcaaaggggtcaggagcaccagaagcatcgacatcaactgggaacttattacaaatgcagaatttggggtcccacccagacctaaggaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcccacgagttttccgggtctgtggctactggcgccgtcttcccaaaagtctgtttaataccattgaacaggcagccctcctagaagtttttccctacacctgagctggccacaagttctccatcctcttggtggctttgaaaatcccttcaggattctgagtgaatacttcaagagtgtgttataaattcagacacgtctacggggctttaaagtgccgcagcgggaacctcttactgaggcaacctgggggtaaaaggcttttcaccttcccagagtggctccacccacagcattttcctagcctgaagttaaagaggaagaggaggaggaggaagagaaactacctggctgagcctcttaccaccccttcgtctctcacgaggcagctgtttgattgctacactgtcacgtaagttaacacagtcacctgcccgtctcctccgtgggatcagcctcaggtctcactgtgaccacgactttgcccaaaacatagtgaactacagacttaattaaatgcatatagacagagagtggaacgatggcttcagggacgggatgggaggtggggacgaggtgttggcgcatactgggcacagagctttagccgtgcaagcagaaagcgtgcgggggcagcacggcgtgatggttgcacagccacgtgtgtgcgctgaacatgactgagtcgtagactcacagggggtaaggtggtaaagtttgtgttactgcattttgggtattttgccacaattttttaaaaaccttaattttgtagatgtgttgcatacaagcaagagatacaaaacccaaactgtgattttcctgaaagccagaagctgcctgcctgtccctggggtgatctgaaatccaggcacatctcgcgaggccagcagctcccagagtgcggctcacggacctgcggccccaacatcgcctgggctcttgtgacaggtgcacatttccgggtccctcccagacctcctgactggggcactccaagctggggctggcatcctgtgttctagccagcacccccgggatgttcggatgctcaagcttgggaaccactctctcaaagcaagcccgaggcgctcccacggcatcccagcagctcctgcatctcatgctctgcagggaggaggggtgcagagagcagggaacacacttggaagcaaaagaatctgaatggtgtatgagaacccccagcatcttcctccctgcactgggcccagggcacnnttacctgcgtcaagctgtgctgtgattcccctggcatctgctcgagttccaggtctctcctgaaaacgaacacgcctttctccttccaggcctttctgcatctgaggtttacccagcacaggcctaggtgcctcaggtctgaaattacataaggggtgacagaagcgtttcaatgttgggactgtgctctctgtcgatgtatattaaatatatatatatatctgtttatttagacttgcatctgattaggtggtgcaaacatgagtagctcaaatatggtaggggcctccatggaagagtcattttctgttgaaagaggatatttaaacaagcaaagaatgccttctaagagacttgagatacgaacaacccaacctcaaggttatcttgcgtgactctccctccgcctcttgtaatgagatcaatgggttctgtttcaagctctggacagccctgagccctctgcggctgggatctcctgccaggggcggctggggaagacccctcgcaggtgctctttcacatcagaaatcacacagatcacctcaggcccaattgccttcagatatgttagtcttcaccacagatacacacacagactctcacattcacatacacaaacatgctcacacacacttttacacacatccgcactcacatacacgaacccacgcaccgttcacaaaaacacatgcccacacactctcacactcacgcacccacacacacatacatacatagacacaggcacacatatttatactcacatacataaaaacatgcacacattcatatacacacacacctgcatacacactcatatacacacacacacacacccacttcccactctctcacactcacatacacagatgcacacacattcatactggtatacaaaacacacacacactctcatacacacaaacacaggcaaacacattcatactcatatacacacacattcatatatgcaaatacttacccatacacaccctcactctcacacacacagaggcccatacacacatccacaaacaggcacacatgttcatatcacacagcggacgaggtgcacacattcgtatcacatacaaacacacacactcacacagctgcattagttgtcaacgtttaaacactaggaggcagagcctgcagggagaggcgagcaggaatcccaggcgccatgcgtgaggaagggcgcagtgggatctgcagactggggcgaccctcactcccggttcctccccacattctgcatcccaggggccctccatctcccccactctcacccagtgtctggatgtcaagttagagaactcggaagctgcagccacacctggctggccctcccacacgaccacgggctcttcctactcccccaataaagaaactatagatctttgttatttggtcatcttaaaaagttacctattaaatcattgcaaaattaatttttatatatgcatagagtttttgaaagcataatcctatcattttacttatacatacattagtgtgtatttatcacctaagaagactttttgaaacacaccacactaccgttgtcatgttcagaaaagcatcagtaattcagcaatgtcctataagacccagactgcgttcagttttcctcagctgcctcagaaggtttttttttggtaaaatatgattcctgctttcccctcatttataagctgtttatttctgtattacaaaagtcatagataaaagaaaatacagagattaagatgcaaagccacgtccgtcagtcccatgtcgattgatcttcactgtctgtcctggaaaataaccattcacgagacttctaggtgtggcctttcattttggaaaatactcagaatattctgagtatttgtacaagtgaatgagcacatggtttttctgcagaaacacagtcgtgtttatttacattctgctccttgctctttgccccttactgtgtgtcctggagacctttccaccagcatgcacacagcccctcgctattccttttaatggctttaccctaatacaaaacagtgtgcaaaccacttgtgaaaatctggtttatttccgattctttgctattacaaaaaccaatgcagtcagcctcagcctgtttatcctctcatctcggtgcagatacgcaaccgcgtgtgcaggacaggatgcagggacccctgctgtgtggactgtggctctgaggaagaactcccggtgtgacaaggagggtgtccgccacagagcacagggtgacggtccttcccatgatgtgcaaatccaccctggccgtcttctcaccgcagcagcacatctgccaaggtcacgttttcaagagtttccatacctccagtgctggccggaattaatcatttatgatatttaataaaacacacatcaaaagcatcagccttctcattgatgatgattttttaatcataacacgaggtggggaggattccttagatgtctaaagtagctcattgattgaaaaagtttgaggccgggtgcagtggctcatatctgtaatcccgacactttgggaggccaaggcgggaggatcgctggactccaggagttttagactggtcagggcaatatggcaaaatcccatccctacagaaaatataaaaattagccaggcatgcctgtagtcccagctcctcaggaggctgaggtgggaggattggttgagcccgggaagttgaagctgcagtgagccgtggtcatgccactgcattccagcctgggcaacagagcaaaaccctgtctcaaaaaacagagagaaaaagtttgagaaataactaatacgaaggatctggatgcctaataaccatcttacagctggtcaaataacatattaggaaaggtcccttgttaccactgattatgaaaattgaaacaaggtaatatacatttggaagaacttatcaataacgtgggctcaaaaccctggagcacattgaccaagattagctatggagttctgtcttttgagtatttcttgaaagtggcagcatttaaatgttggatacagttttgttcagagacagcagcacgaactatacaacatcctcgggctcctcctgttttccggggtttatactttctatggattcctgaacaatcagatttctatcagaatgttagcttttcctgcatgcataggattcatgctgtatatccactaagattggctgtttagagaagacagcaccacactatttcttacccactctttcttgtcttcctctccttttatttttcttgagatggagtctcgctttgtctcccaggctggagtgcagtggagtgatctcaactcacggcaacctctacctcctgggttcaagtgattctcctgcctcagcctcccacgtagctgggattacaggtacctgccaccacgcctggctcatttgtatttttagtagagatggggtttcaccatgtgggtcagactggtctcgaactcctgacctcaagtgatccacctgtctcggcctcccaaagtgctgggattacaggcgtgagccaccatgcccggccctctcctctttcttaacacctgaactccttgtccacagttattctgtgtcttgctaactgaaatgaatattgcattgaaggagttaagctgacgataacgacgtagatggggaaacatgatttggaggtgacaggagtgtgagcctgcagaagccgacagatggacacggcattcaggtgtggagaatatctgcaacatgtcccgaaatgcaaatgcaaaaatccaggcagcctctccccccagacagtcgcagggaagtggggaagcaagctggatgctaacagaaaatccttcccaacgctctcttcaggctgtgagcacacttgcgagaaggaagtgggtcaggacaaagctgctgcctcccgcggattcattgtgacaaaaatagccctaaggatcccgttgcattgtgtgcacctcactattcttcccacaggaccccgggagccacagcccccagaaagctcctacatgtgagatgctggtcagtccacacaatacatcaaaatgggagtcacctcagcccccaaggatttcaaatgggactctctagggtttggagggggtattttttgtcttgtattgttcggggttttgcttggcttggctttcaaaatggcatgcggtgttggttgactgcaccagaatccacattttacctacatcaggtcaaaggtcccagagaccaaataaggagaccaaaacgaatccaaacaaagcagaccaaataggaatcctttgtccattgagaaacttctagaagatgcttattgaacagccagatttatctagctactcctgataaagtcatctaaagaggaagactgccaaggaaattagttgtctctccaaagacagagcgcccatatcctgtcacccttgcctgctccagggctagttgccatggactcagggtagaaaggatgaagacgggccaggcgcggtggctcacacctgtaatcccagtgctttgggaggccgaggtgggtggatcgcctgaggtcaggagctcgagaccagcctggccaacatggtgaaactccgcctctactaaaaatacaaaaattagccaggtgtggtggcaggtgcctgtaaccccagctactcgcgaggctgaggcaggagactcgcttgaacccaggcggcggaggctgcagtgagccgaaattgcaccactgcactccagcctgggcgacaaagtgagacttggtctcaaaaaaaaaaaaaagacaaagctcatggaataactaagatgcagagagtcccaagatgagccagagactttcccagaattggtcattcccttctttatggaaacagagcctcctgggttgtaagaggaacacctggctagtgcctgcagccacaatctcgcttgcagcctggtgcggggacacacagggaggcgagcagctccctggaatcctcctttaaggaggagctggtccgccctgcaccctctatttcccttcccccttcctgctggtgtaatgcccatgggtgctggtgaacagctaccacaggagggcgagagcggcacactagggaatggaggggcaacaacacggcgggaacctggttccctggacagcctcgtagagcagaagcacctgccagccctggccgacatacctctgtatgttacaggcggggaaaacaataaagtcagatgtttctgtccttgtcctgtggtgtctccttcagcagctttgcctgtatcctcactgaaatacaggaaaatgcaagaacagccctggatcccgctgctcactcccaggagagtggaaagagttgtgggcctgtctgtgctggctggctgcatgtgactcggggtctccgccgggtctcgcttcatttctgagccatcagcatgcgtgtgactcccccacccaggcccagctgcatggccgcaatgcctcagcccctcatgtttatgaaaatctgtcagattgttggctgctcctacaacgacaccagtattatgtcaaaataattctgaaaagaatttaaatataaaaaataaaagaggttctcaaagggtgagctgggacccctggagtccccaagaccattttgtgggatgttagacgtttttttcactctccttcttccaggagtgcagcagagttttctagagcccacgtgacctgagataacaccacagacacagagatgaaatccagttgtctttgatgatgccagacatgaaggaggcatgcacacatcagaaacaacgccactcttctaatacttttgctttggaaagtataattagttttcatgagaaagatgttatttgtgataacatgcaaaggtatcattatcgttatttttaaacaaatatttttaaaactgtcagcgttaaattctaacaaggtaggtgatatgttctccatgaactaaagctctttgggatctccaataatttctacaactgtaaaagggtcccaggacccaaagtttgagaagtgccagtctacatacacctagggatccagaaaccctttgattcgatgtactctgcttataataccaccactaccaacctccatatacacatatgcacataaacacacgcatacacacacacacacacaccatatacatgcacacaaacacacacgcatatacatacgcaccatatacacacatgaacacatacacacataaatatacacgcatacacacacattcacacacatatttacaccttatacatacagacacacatgcatgtatatacatatgtaccataaacacataaatacatataaacacacacatacacacacattcacaccttatacacgtgcacatacacatatgcatgcattacacatgcaccatatacatatacataaacacacatataaatacatgtaagcacatacatacacatatatacacatacatatacacagcactagaacagcacatacacccatgcgtgtatacatcacacacatacatgtacatacacaccacccacataaacacacacatacacccatgcatgcatacacatatacacatacatactcatgaatacatgtctacacacacacacacacacacaatcagtcatttctgactcttctttatcacaggtgcagatcttggtccagaggatccccatgagatgccccagggacaggcactgtcagcctcatcacatggtcatcccctggaaggacagcatggcatgggtgcaggtatttaaatggtggtagctgctctgatgagaatggtaggtgactattctagtgctttcattcatactcccttgctcctgcctccccgttttctcattaaggcactgacgggatgcacagacccatgccaggggcaaagccatttctgcttccttctgctaagccttttgttcagaatggtatctggcacagcccccagggacttttccagacttccctgtggagcactaggagacaggggaaaggagaaaacacccagtgcttaaaactcggcctgaccacagcccattgtcatagctttgtaccctccagcaaatagatcctttattaagccacctggggaccaactacaaaaacgatagattagacacaaagacaaccctaatacctttcttttttttattattattatactttaagttctagggtacatatgcacaacgtgcaggtttgttacacatgtatacatgtgccatgttggtgtgctgcacccattaactcatcatttacattaggtatatctcctaaagctatccctcccctctgcccccgccccacgacagtccctggtgtgtgacgttccacaccctgtgtccaagtgttctcaatgttcagttctcacctatgagtgagaacatgtgatgtttggttttttgtccttgccatagtttgctgagaatgctggtttccagcttcatccatgtccctacgaaggacatgaactcatcctttttatggctgcatagtattccatgttgtatatgtgcaacattttcttaatcccgtctatcattgatgaacatttgggttgattccaagtctttgctattgtgaatagtgccacaataaacatacgtgtgcatgtgtctttatagcagcatgatttataatcctttgggtgtatacccagtaatgggatggctgggtcaaatggtatttctagttctagatccctgaggaatcaccacactgtcttccacaatggttgtaaactacttaaaccctaatacctttcaataggcttccggccgggtccttgctttctgaccacggcagaagcacactatgaaagtttaaatgagaaactcagttttctaacattaaaaactcaccttctaaaagatctcctaagtaaacaggaaatagacatttcaattgcagatgtaagaaaaacaattacagaatactaaaacttataggatatgctgttgctcataaacatttgtatcaccctaaatgagtttaatatttaaaaaaagaaagctcagagaaaaatgaaagacatatttaagtcaagaattgacttaatatatcaaaatcatatcatataccaaaatcgtatacacacctacatatctctaaggaatatactactataaaatgaggtatacatgcaaataagaaaaataattgaagtaaaaaggagaaagacattgaaataaacaaatcaatgagtaaagaaaccaaaagaatttataaatatatttaagaaatacacgatgttcaactttcaaataatgtattaaagcaggaagagaaccaaacgcttctctgcagcacacgtgaagcccgctgtaggtttccacgttctttaggaagactgaataaggttctcagtattatccaaatgaatagagagaacaccctttagtattcaaaagtcccatgagattatctgacaaaagaagttttaagtttcaccttaaaaatacatgcacgagggtaataaaaatatgtaaagagaagagtaatgaggaggggtcacttcccctcattttcccctagggtctcgtatagagcttagcacattgtagatgccaaataaaggttgttgaatgaataaaagaggtactcgaattaccaaaataagtagctattataaaattaaagcaatgtattattgatgtagtggtaaaaaaatattggaattgagtcgaaaattcagaaactaagtatggaaatatatttacatgtgtcaccatttgaaattgagataatacttttgaaataatagaacaacaatttgggaaaaattcaaattatatttcctgtaactacaacaacattacaccaaatttttttttagtattttaaacataaagaataaaattgttaaaacattagaaaaagatatagttactagaagactttatattcaggacactggaggcagaactaatatgggaaaaaatggattgacttaactccatgcaaaataaaatatattctgtaacaaaaagaccttaaacaaaataaagtgacaaagaaaactgggaaaatgacttatgatgcatagtagctttgttaaatcagtaagaaaaaataaacgcttcagtagaaaaatgggcaaaagtcaagcaaatgattcaaaagtagaaaagccaataatttataaacaaatgaaaagatgttcatcctctttactgagcaaagccttgcaaattaaaagatgccataagcactgggaaaaatggaaaaaatacagttaagaaccaatgttaagaggctgtgaggcaggtggagttcatatacacggccagtgagggttcagattgattcatccttctcgagggcatctgacaattcgaacatgaagctttagtaatgctctaactctttgaccccagcaattctgctcgggaataatcccacaagctcataacagctgcgtgtacagtaataccctttatatttagagaagaaaaaagaaagaaagcaacctgaacacctactagtgagagattcatttgataaactacagaaattgtattatggaatacattaaagccatctaaaataatggcatatagttgtctgttaattggcatggaataaggtttataatatataatatcaagtggaaatattataaaagagaatggtgacatgaacccatgttggtaaaaatgataaatctatgtagacatgcacaatagaaatctagaaatgttatcagatgacagctgtattctctatgctgcaattttccatgcaaatacatattaccttaggaatgagaaaaaaaatcaccaaaataaacacctttacttttcattctttgtcttttggacatgaagtttggaagatggtggttatatctacgggggactgtggctgaaattctgatgggcacgtggtttccaggccgtatatctgaggaaaccaggtgccggggcacacttcccgcatgcaggggaacccaaagaggatggggaaggacaggtgccggggaggaaagggctacacatggtccagggtgcacaggcccagttcaggctgctggggcctgtcctgtgtctggagattacaaggacagcagaaggaacgtgccttcggaagaacatattctaaggaccatgggaagattcttagataactacgacagtactgaggtggcctaatgagaattttcattaaaatatttacaagctaggccaggcgtggtgttcacacctataatctagcactttggtatgccgaggcaggaggatcacctgaggtcaggagtttgagaccagcctggccaacatggcaaaaccccattgctactaaaatacaaaaattagccaggtgtggtggcaggtgcctgtaatcccagctactctggaggctgaggcagaagaatcacttgaacccgggaggtagaggctgcagtgaactgagatcgcaccagtgcactccagtctgggcgacagagtgagactctgtctcaaaaacaaaaacaaaaacaaaatatttacgagcaccaagactttcatattctctgcaaaaatctcctctgctattagtggaaagcgtaaaagtagctcatccattctggagggcaatcagatgagactgtttctataccaagcatcgcctttatagaaaaaacagtccacagcattgaacctaggaattctacttagaggaattggtcccaaggaaatcctccaagatgagagcacagatttcactcaaaaggataaaaaatacattgtcattttaaaaaattatgtgcaacgtaaacagacacacagcaatgttaatgttatctctgggtgaaggaattttgagtgatttttactttctccttttgtcttatttatatttaaacagtttttttaattttataaagtagtcgctttctaccgaaaaacaacccctgtagtgtaagtaatttaaaatcttctgtcaaataattccatcttttaacgtggtttagttggttttcctttctgttacctttatttcccattggttcttttctcttttttttcccctccagttagaaaagcaggagcaggaagtgggtgagaagagccgtctggctttagatttacagagcgtatccatcaatgactaaggcgagggcttggctgactcacccttttcctgcctcgcctgctgaggggtccactaagctcccaggaatccatggatggtgcacctgcgaaggagacacgtcctccttgggggacacgtctgtctcatctcttgctttttttctaatcaaatccattggttctcaaactgtaacgtgccttggaaccctcccgagagtttgttaaagcagatcttgggggcctgctccagggcttctgactcagcaggtctgaggtggggctgagtccgtgctcctaaccaggtcccaggtggcggtgatgtggctggccaatcacacacacccatccactttgagtggatctgaagctctcgcactttgagagcacaggtgtaaatcagtggaaggtattggctgcagagaaaccagtcattgttggaagctcacccaaatgaattttaacctttcaggccaacaacaaaaacagtaaggataattttaaaactttcgcctcaatgaggagagcaaaacagaaaaacattgctacagcagcaagtgtgccagtatcacgtctcactggcctttatcttggcgaggcaggttggatagagactttcaaagagatttgacacagaaaaacatacactagctcccatccccgcaaataattcaaaaccaaagcaattctaacatgtggggtaagcctaaggaagtccggcaaaccgccagcacctgccatgttgacttctcttcaatgctccttttgaaataccaacttcataaaaataaattcctggcatccctgcttttccgtcatgcatcccaggcgtgttactaggtggcctattgggtaacacagccccggtcagagaggaaatctccgctgtgacttacacagctccggagagaaatgcgcaaagtgtgttcgcctggcctgaagtcagagtcaggtttctggtgtctcgcgtcccggagttgtgaaggctgcctcaaggtcaaagccctcaacttaatctcttgctcagttgcaatctaggctggcacagatagtggcccctccttgccccgcagccctccacacagcgagaggctgccttcctgaggggactggcttgcctgttgtctggtataaagccggacggtgttcatgtcccatggagaatctcctaccagatttggccagcagaactcgctccccacccaagctccagccagctgccggttccggctgcttgaacttgggctgccctctgtagagagccatgaaggcagcctaggcagggaggcgtgatgtcggggagaggtgcctacaagatgcatgggccatacaaagccttctgcagggaggcatggagccggggagagtgcctacaagatgcatggaccatacagaggcttctgcagggaaacctgggatcacaaagaggagggaaacagcaccccggccggtagtgtggccagtgtgtactgacttcacaccctgcagggcgttcccgggaccttcagtgttatcattgcattgtcgatgccagccattttgcagggaaggaggtacgcatcatctagacctctcttcccaaaaaagtccgacttttgggaagagtcatacttttgggaatccatcctcacgattaccttgggaaggagaccctacttcccgctacagaagtccgaaagcttctctcctttcccacccagcttaaccgaggaatggcagccggtttagcctagccagtgggacagtctcaactagagttcttggggatcagggtaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtgcccctcctggcctgtctcgtccacacccatgactcagcctccacttggctcttaacgatgcccagccctgcgtcctgtgaccttctgctgtgcatttctcctggagggccctggctccttgggctaggggtgctggcaccagacctgccatcttccctcccgtggaggttggagttctctggctcctgcctaacggcaccccctgacttcccactgtctggaaagggcacttgtcatacaccttttgcacactcttactacatttgagagcctgccagccttgggagtcccctctccccaagagagtgcctccaacgctggaatacccagcttctcctgccgctggggcatggggcttacgaccgagcacccacctatcccatacgtccatgactctgatttggaagcgagagcaatcggagacaggaggcgtgggctgggggcagtttgctggccaggtggctgcagaggcagccggcttccaggggccatgacatttgccaggcagacttcctggcagctgatggttttctttagtgctctttggggcagcacagaggtagcgccttctcatccggccaggtcagctgtgtggcttcgggcattgttctgggaagctcagtctgaggcctgggtttccagctctaccaatatcattttaatgagtaactctgacgcttagtcagagccggcctctgctgcttgcagctaggaaacccagtcaatggatggactcgctgtcaccctagaccactccagctgttctcctgcctcccagtagaatctactcccctgtcctatactcagcgttctcaggtcttcagcctttcttctgtcaatctgtctttcacatggcacagagtcatctttctaaatgcacgtctgtcgattctttcttcaaaatcctccccatctccgcgtccctgcaccgcgcacccataactccccatctccccatcaagacccagcccccagcattctcagaccttctcaggttcagaaaatccaagcacaggcctccctgggcacacctctggggtactgaacagaaggggttgtttctgggtcagagtgtgggcgatttacacctggaaatacaccgtgcgtttgctgggacccatccccgtgcctgcgcggcaggagttcccacgtactctctcacaccgggggctgttcttagacgttcacatcctccccaatctgaaaagtggaatactgactgggcgcctgtactttctcctcagcgttttgcctgtttatactcttgcctattttggtttggggttgcttttctttttcttcctggttcactggagcacattagacatctgtgtccgaagcctttgccagtgacacaccctgcaagcactttcttcctgttctaacttgccttttgttcgttgtcactagagttttacagagttttacactgggttgtatgaatgctatgtcttccatatttggtttctggtttggagtgctctctcgtgacagttttactcattttgaaagtttcagctcaaacattattggttcagtgaataaatggttaccactactattgtctacttgaccttggtatatgtgtgtgtgttatacacacacgtgcacacatgaaggtacacacacatccattatacattcatgcacacatacacattcacaggccagccgtttctctgattttcccacaagttttcaaaaagatcttgtgtctctgtgttagagtgtcatgcatatacacacatgtgcacacatgtaggtacatgcacacacaaatattatacacccatgcacacatacacatgcacccatacatacacatataaacacacatatatacacacatagataatacatgtaaaaatattttacagaggagaaaactgattacatataatatataatcatatatgcataatgagtatcatatataatcagttttctcctctgtaaagagaaaatacagaaaagatacccgttctaccatcctcatagggttgtcatgagcgatgaataaaataattatgaaatttcttatgcatgtgtaaacagcaatactatagaaagctggttaatctgtatttcttttctgtcagactttaccaggccaaccatagacacttctctacaagcaaagggagttagttaactaagttctcatacgaaatgcagcggaatgctgtttaaacatccttgttataatgaggatggcagctcacagtgataagcccacagtcaatgtgccagaagcatcacagtgtctgtgaattactgtctgcattttacaggctggaaacttgaggctctgtggccgccggtgcccagcccagggcagggctgccatggagccagaatgccctgtttccaaagcacggcttttctgtatgatcagtttgcccctagctcagcacagtcgctaaacttggggccactgttttttttattaatctgggtttctaaagaggattgttttaaatataatttttgactttataatctgttggctagtattatttatgaaaaggaagaaagaaagaaaactcagccaccttttgattctgaatgacattgttagcgacacttcatgccgtaacgccggtaactcccgatccccttccttatcatttcagaagctccctttgagttcttatcacacaagacacctaccctgtgtggggctggactgttcattttcgggcattttaaatacacagactccaacttctgtcaaaaaaggtaagtgagaggctcattcctttcagtttatctggtcatttcttaccgatgcgcagagtcggcaatgacaaaactttggaaaagtaggtagaatttgggttgtcttcacagcatggttttcacggccccctgcctccatcactgcggtatttgggggggggggggattgtgtctttggcagggaagattaagtggactgcatcccccccacagagggtttaattggcaacagagtcagaacccactgatgtgtgcaaaattcattatagtatttgggcttggaatgctcgcacgggccagccgtttctctttctgattttcccacaagctttcaaaaaggtcttgtgtctctgtgtcagagtgtcagctccccagtggggccaagtttcctgagttatgtttttttagtaacctcaagggcaagggaaaaggtgtgtaaatcctttagcttctgttatcactggattaggcaaaatcatgtgcccagaggagaatcagaatgcttagccgagataacagccccgttagtcaggattcactagaattcacagaccagctggggaggtggggaggatgtggaagagagaacccagtgatatccgtagttagcgccttttaggttcatctacctgggttacatgtgacctgctacagatgacacctgagaagctgggtcttccagctccccaaatcggacaaattcttcctaacacaatgaactacacgaagcatggtactttgatgcaagtgagtttaaaggttcccttcctccctccctccctccctccctccctcccttcctcctttccttccttcctctctctctctctctttctctctttcttccaacagagtttgctctggcgcccagcctggagggcagtgcatggatgtcaactcactgcaagctctgcctccctgggttcaagcaattctcgtgcctcagcctcccgagtagctgggattacaggtgtgcgccaccatgcctggctaattgttatattttgagtagagacaaggtttcaccatgttggccaggctgatcttgaacgcccaacctcaagtcatccacctgcctcggcctcccaaactgctgggattacaggcatgagccaccacgcccggcctaaaggttcactttcgtttcttttctgtgagtatagtggatacttgctgttttctggccactgagccactgctcacacgtattttagtaacagcatttattgcttaaggtagatcaagctgctataacgaatgggccacagaatcaatagctcaactccaaggagtttgtgtctcattcatgcaatagacaaggcatgaggaggcggaacgttctgctccacgtggtcttgtggggccccaggctaagtgagtctcctccatctttaacatgtgcttccaagatcaccttgggcatccaccactccagtcagctgaaaggtgcagagtgcagggggaaagtgcaaaggagatgttgcaacttgccctgcctcctctaaccaaggcacaggcacatgatacgaacttggccaacttttcctcccatgacttttgaatctgagtggtgttgtccaggacaaattaaaaaactggatttggccaggcgtggtggtggctcacacctgtaatcccagcactttgaggggcagaggcgggtggacccgaggtcaggagttcaagatcagcctggccaacatggcaaaaccccgtatctactaaaaatacaaaaaaattagccagttgtggtgggaggcgcctgtaatcccagctactctggaggctgagacaggagaaatcacttgaacccaggaggcggaggttgcagcgagccgagatcgcgccactgcactcactgctcactgcactccagcctgggtgacagagcaagactccgtctcaaaaaaacaaaaacaaaaacaaaaaaaactgcctgggctgtgatgatgaaggctgacttgataagggtcatccagggtaaacatcagggagggataccaatttttcatgctgatccaacgaggcattattagaagcaaggggatgaaaggaaaggaaactttaggctgaatgtcaggataattttcccaagagtgaaatcaattagcctctgaagacttgcttctcggcagcaatctacttcaaacccgactcagagggacatctgagagaaggaaacaggcattcgccccacgcagaagaccgaaagcagactcctggggcctttttgccccatcactctaatttctttaaatgaatttctgaagcacaatgtgctttttctctagatctgttgcaaccaatctgacctgagtttgttcctgactcatgagtcataaaaatatttactgtttctgcgtttgtactttcttggcatttcagagctgggcacttaagggtgccccagcctcccttccaacctcatctcactcttcttaattgcctgaccttcgagtcccgactgccacgagccttggtatggatttaactgacaaaatgcagcaaatatttattgagcatgtactatgtctcaggcactgttcaggtccctagaaagcagagaaggaagcacaggattcctgcttccatggagtttaattctgatgggataaactagtaaaataatgttaaaggacaaatcaacaatattcagtctttttttcctcctcccaacagaagctcaactggtttgggagcacaatgttacttaagtattcaatttcccataactccttgcagcttaaggaagtcatgtgactcaaatctgaccagcgagatacaagcagatgttttggggtggggctttcagggaaactcttctcaggggtgtaggctgatcgggttgtctgtttgaccttggactttcaccttctgaaacatgattgcaatgcccagtcaccttgcgaccatgaagacaaagtcaaatataagtacagctgtgcaaggggagcagaggagcttggttcagagcagctggaatagttctgcctccagaattcttgtaacgtgagaaaagtaaactcattaggagttaagtcacaataattagttccaatggcgccaactctgactgtgagaacagattttgtggaaatatatatgtgtatatatgtacttatatgtgtatgtgtgtgcgtgtgcgtgtgtacacatttttttgttttgagacctgttcacagactcctgggctcaagtgatcctcctgcctcagcctccctataaatacatttttaaatgatcatcttgcttttttcattgcgtcttgctcaggtggttattaatatgctgctgaactgaaaacgttcttgctctgaaacctttcactggaaggctgggctcagctgggactgtctatcagagcatcttcatgtgaaagctccagttatgaggcagttgaatatcttacacagcagccaaggctccgaccatgaatgttccagcaaatgaggtgggagctacaccagctttgtggacccaatcacaagctggctcagattcaagggtaggagaggaagactccatctctcagtggaagaatatcaaaggatttccttctggtcctaagacctctccattccccaaagctagattcatggccacctcctctaataggtctttcttctgtaccccaaaccatattgatctctccctcctggtaactttagtaactcattcatttggcattttttcaccttctgcccaagtttactgtgtaactacctggtgtgtgggggtgactcttgtgcattgagaccatcagcttttgtgcacagatacatctcttgtcttctatggtcatctaacccaagaggcatcctatgcctgtgtctgtgttgccatctctctctctttttgaatcgatctctgtcgtttttctctatttgtctctttttctctttatctcattggaggcaatatttatataagtgattaggagcttgggtttgagaattgcagagactagttactggatttatggctcttcccaactatgtggccttaggcaaagggctcatgtctcagtttcctcatttgagaaaaaggaaatcgtgatgactcttaaataaccaaatgcatgccaaactctgaacactgcatgatgttttggctgtgtccccatccaaatttcatcttgagttgtagctcccacaatccccacatgtcatgggaggatctggtgggaggtaattgaatcatgggggcagttgccctcatgctgttctcatgatagtgagtgagttcttaagagagttgatggttttataaggagcttttcccccctttgctcagcacttctctctcctgccgccttgtaaagaaggacatgtttgcttcctcttttgccgtgattgtaagtttcctgaggtctttccagccatacagaactgtgagtcaattaaaccacttttctttataaattatccagtcttggatatttcttcatagcagcgtgagaatggactagtgcattgcacctggcatagacttgtgtttgaaactggcatctaccatgaccaccaccatccttatcactatcactttcattttgtgtatttttattttgctttatatagatctagctccacattaaataaagcccaatggtggacgggggagtgttcctaaagagtgggtgtttcctggacccatttactcaaggagaaggacagatggataagcgtttacaaaacaaacagcctacaggaagtctggaaactgtttcaaaaacagtctataacagcaaccaaaaaaaaaaaatgtgtagatggtgatgtaatctctctggtaaaagaggaaaagcaaacggatattgtctgcgtgtagagccgtggggccactagggcaggatttccattcttagagggctcctgggactgcctttgtctggcactggccagggctctcacacctcatcagggtttgcaaagacaacttctcacttccttgagacgtgcttttcatgggacacacactataatgtgtattaagttacacgtgcaaaaacaagcacttatgcatgctttaggggaaaaaagactagaaggaaatacaccaaactgtgagtggtgattatttctaggatgaatacatattacttttataatcgggaacaaaacacaataaagtacttttaaagcagatctactttaccagagatggaaagtattacaaaagaaaatgcaggacattcacagaaaggtcctagggaaccttccaataggttctcgttcttcactttgctgactgatgatcttaggaactgttttaaaattatgaaaatgtgacttcatcctgcatttactccacagcatctggagaaggaatattgtagtctcattttgttaaattttgttagtaaataggatgacagtgtatcctttaaatttttttttaaagcttgggtgtccttccctgagatacctgcatgtgagccctggctctgccacctcctgctctgtgaccatgagcaagtcacttaacctctctaggactcagtgtcctcatctgggaaatgggtgcaatggcagggccgagctcataggatcatggggaggaatggatgagctactgcacactataactcttctttcctgtgacatcccttaaaccgtctcagttctgtcttccagaagttgctcctactaccctgtggccctggatgatcccagcagagtctgcaccccctgtcttttgtcttttggatcgatcaggaactcctgtcatcttttcctgtaaacagatccccgttgaaccgaagtctccctccacctctgtctccccacctcagactcatcctcctctctagaccatacccccttgctggtctccctgctctcattcttgccctgaaagccagttctctgctgggagcaattcctctaaaacttagaacaggtcctgctccctctgctcctccaccattcccaaccacgtttacaacacaattgaagtcccagcgggggcctgtgaggtcctcatctgcccctgggaggcacctagctgctccagcgctaaccccctacccaccaggcttttgcttgtaggcctcctctgtggcaaggcttgccgtggccatcccacctgaaacacattctgtcactttctgtccctttactcaacgcccttccttcacaggatccactgcgattatagctccacgtgggtgtttctgtcccagatctcctggttactgtctcttattactgtgttcttatttcattgctcataggagttgcatggtgcggttttgtgtgtgaatgaaagacatacattgacttgtaagcaactgttccagagcaacagactctggacgtcccagcccatctgcaactattcgacttggcccacaagctttctgaggccaggctgcacacgtcatctgacccctccttcggaggagcaagcaaggatgcaggagaatttgtggcccctaggaatatctctgacggtgtcttcattcacatgcacactaaagggagcacaccagctcctccagactagcaggccctggtgacctagtttctgtcttgaggctcccagacttcaggaatatttatgctgctgtgattgcattgcttcccccagtcttgagtgccctctgagcatgtgagtccactgggaggtttgtgttcacattactaagtgttcatagcaatgtgaggatgacaaggaaatgactagaaactgctaaaagcacagggaggagggaaaacactatggcccctgatctccatggtgtctcatgtcaagtggagatgtgcacatcgtgtgacctcgctgagtttccgcaggtgcctcccgcctcgggggtggagggggagcccttcaccagctcactagccccacaggccaatgtggagccccattttctaaagagatctctggtggctttaaaatataatgcattatttgatgttccacccttcaagaggtgaaaactaattcctcccccttgagtgtgggccagactcagtgactcactcctaagaaataaagcatggcagaagcaatggtgtgtgacttctgtgactaggtcatggaagtcagggtagtctccttcttgctctctctggggatcactcnctctnggagaagtcaggggccatgtcacgaggacatgcaagcgttcagagcccagtgagcacaccatcttggaagcagatcccccttctcctccttcagtggcggtagcacatccttggccaacctcagagagaccctaaaccagaacccctgagctacctgctcccaaactcctgacccacagaaataagcagtgaatgtttgttgtttaagatgctcagtttgggaggtaatttgtgacccagcagtagacaacccgtaccagatctctgcttcctgggacccccgtgttcatgactgcttgacagtttcctttgctgcactcaccacctctctgcccttttgggattccgttgccataaaatggagacaataacatctatagggtcgtggtgagaaacagctttagaataaaatatttaaagccatcagtgcaacggtcagcacatagaaagtagccgaaattggagttgttttcattcctgtgtagatccccatgcctgtcggacaacatcattcgtgccggttatgacaggcctgacgggcatgcaccccacagccgccttcttaactggcaaaaggagagccactttgcacccctcagcagtgcccatagggctctcacactgcctccatcctctagtgcccagacacaggcccctacagccacctctgggaagggcatcctgttgctttcgccaaaccttctgggcaccaatgcaaaactctcatcttcattgcttaagtttctcctaaaactccttaaggaaatgaattcattctgggctctgatgctttctcaggcctgccaggacacacctacattcaaatgcaggctcttgcttacagctgatgatgcatgcgttgatgacaagtgtgcacacccgtgccaatgtgtactggcaagatggccagagctcttacaggaacataaatcattgagtaaaatattgatttggtactttctttcagttacttttttttttttttgagaaagaccctactctgtcacccaggctggagtgcagtggcatgatctaggctcactgcaacccccgcctcccaggttcaagcaattcccctgcctgggcctcctgagtagctgggattacaggcacctgccaccatacctagctaatttttgcatttttagtagagatgaggtttcccatgttggccaggctggtcttgaactcctgacctcaggtgatccacccgaaaatccaagttatccctttcccttgcctgcaacatttgctctcacttgggactgcaacgcttaacagattaagactgtcttctttaagggtgtgtgtcgagggtgtttggttttcactcatttcccaacactaagctgaggttctatcatttggaagtttctgtactttcggctcattcacgagcatgtacctgggacagagccgatgtgtggtgtctgttaaaagtaggacggtgtctgttaaaagtaggacagtgtttgccactgtcatgcctctccccgggaaagctggccccatcttcacagtgcgtgcacgcgcgtgaccacatttgatcctcagggctacactctgagatcactgggccacgtgtcaggtttacactctttttagagataagaaaaatacagatacagagggcttaagtggctttctacagtcaccaagccagtggttgcaaatctgggtttgaactcagtttctgacttcaatttggggccttttgtgccaactgggtttagaccaatgcctacgtgatgtttgctctgtgatgctgtcattctgattgagagtggaaccgcttaaaataacactgaatatgctaacacgaggcactggggcacagtgtagacagctgggccctggagccaagcccctcggcttcaaaacccggctctgtcgtggaccagcaggaccacctgagcaaggtgctgcactcactttgcctcggtttccacatctgtgaaatgcaggagctgatagcatctgcctcacagggttgttgtgtggagtcagtgagctcacccacgtgccgtgtatacagtacctgctcaaggataaacactcagttcatattaactctttattaaggtctcatttttgaaagccttgagaccactggctgcattttccagcttttctctagtacctggtgtatgtaagtaccaagggttgtctgcctagacttgtaggcaacatgattgtaaaaaagagggttgtttaccatctggaaatagcatcgcttggattgcaatcatatgccttgaggaagccaccttcttgtagtagaaaagtcaaaagccctattattttctttatattcaaatttcgctcttaaaaatcatttagcttcgtaataaaaaagcaattaagagaaaaacaaacaaccatgttccttattgttaacaatcctgtatcacgctcttaaaaatgtgttaagagggcagatcttatggtcagtgttctttctatgaaacaaaacaaaaaccaaattactaaggtcttcttctccatcagaaaccttagatttcagctgtggttatagtcttggctaactaaatatggacgatcctttggaaacatcttttctcccatgcttgttttatgttgctacggtttggctgtgtccccacccaaatctcatcttgaattttagctctcattattcccatgtgttgtgggagggacctggtgggagataattggataatgggggtggtctcccccaaactattctcgaggtagtggataaatctcatgagatctgatggtttcataagggaaagccccttttgcttgattctcattctctctcttgctgccaccatgtaagacatggctttcgccttccgccatgattgtgaggcctccccagccacatggaactgtgagttgattaaacctttttctttataaattacccagtctcgggtatgtctttccaggcagcatgaaaacagattaatacaacttgtatttgtaaggcccattttccacaactgcagtttagtggtcccagaacataatcttgtgattgggaactggggttcatttcacttgttgggcttatctgcctgcagggcaggaataagggagaagctactaagtggacttactgctcagctgcagccctccgcaaacaatctccctcctattttctcccgtgtacttcctgcggggggtattcaatggttcaagagaagaaactgcagtcctcatttatcagcgtcctatttcctgtgacttagcccaaatgtctttatggcccaagtgaaaacataattctcaagtataaagagaaaaatgtaagggagaaaagctgacggtttactgtggatggctacctgcatgacaggtggaatagctgtagctgcacccagaagacaactgactttcaccctcaacagcccctgctgcctttcagaaccctctctgtgtgtgatgtaataatggggccctgccaggtgtggtggctcatgcctgtaatcccagcactttgggatgccaaggtgggtggattatttgagatcaggagttcaagaccagcctggccaacatggtgaaaccccatcgctattaaaaaatacaaaaattaaccaggtgtggtgtctcacacctgtaatcccagcactttgggaggccgaggcaggcagatcatgaggtcaggagatcgagaccatcctggttaacatggcgcctgtaatcccagctactcgggaggctgaggcaggagaatcgcttgaacacgggaggcagaggttgcagggaaccgagattacgccactgcactccagcctgggcgacagagcgagcctccgtctcaaaaaaataaacaaataatggagtccacatgactttcagaagtgacagggcagtgaccagcaagtgaggctcagggaaatccaacttttatttagttagcctgatatttttccagttcatcaaatatgcattcccatggaacttgtgggagttttcattctcatgcccagttggctggaggaacggccagggtaggtggcaggaggtgaggcatgtttgtggcagggcgggcttgagcaaagctgaggtctgccctgagctcactgcgaagactgatctgcgtgggtctgcaggtgagttaggggcctgtgacccggctgcccagcaggctcatcctgattctactgatacccgagtctggggcgccgagtccgcgggacacgaggcagggcgtctggatggtgagctgcatttttgcttcctgcttcctgaccatggcatcacgtggagcatgagggagcccgggaagtcggactgcagtcagattagctcgncgtgaagctgctgacgggcagaatcagacgctgttgccaggctctcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgactctagaggatccccgagcaagtcacgtcttatgtggatggtggcaggcaaagagagagcttgtgcagggaaactcctgtttttaaaaccatcagatctcatgagactcattcactatcatgagaagagcacaggaaagacccatcccaatattccatcacctcccactgggttcctaccatgacatgtggaaattgtgggagttacaattcaagatgagatttgggaggagacacagccaaaccataacactcaccagctctccgaaatgacccctggcatgcaggcattcactcactcactagttcactcaggtaggtgcctattgtgtgcctactgagtgtctactgcattcctactgcgtgcctacagtgtgcctactgtctactgagtgcctactgtgtgtctactgcatgtctactgcatgcctactgagtgtctgcttagtgcttactgcatgcctactgagtgcctactgtgtacctactgtgtgtctactgagtgcctatgctgtgcctactgtgtgtctgctgcatgcctactgagcacctactgagtgtctactgcatgcctactgagtgtctgcttagtgcttactgcatgcctactgagtgcctactgtgtgtctactgagtgcctatgctgtgcctactgtgtgtctactgcatgccgactgagcacctactgagtgtctactgcatgcctactgtctactgagtgcctgctggttgcccactgtctactgtttctgagtgcctactgagtgtctaccgtctactgtctactgtgtgtctactgcattcctactgagtgcctactgtgtgcctattgtgtgtctactgcatgcctactgagtgcctcctgtgtgcctactgtctactacgtgtctagtgagtgtctaccgcatgcctactgcgtgcctactgcctactgcatgcctactgagtgtctactgcatgtctactgcgtacctactgagcacctactgagtgtctactgcatgcctactgtctactgagtgcctgctggttgcccactgactgtctactgtttcctgagtgcctactgagtgtctaccgtctactgtctactgtgtgtctactgcatgcctactgagtgcctcctgtgtgcctactgtctactacgtgtctagtgagtgtctactgcatgcctactgcgtgcctactgcctactgcatgcctactgggtgtctaccgagcatttactgcgtgcctactgagtgtctactgcttgtctactgagtacctactgagtacctactgagtgcctactgcattctactgagtgtctactgtctactgagtgtctactgtctactgagtgtctactgcatgcctactgcatgcctactgagtgcctactgagtgtctgctgcaggcctactgtctactgagtgtctactgtctactgagtgtctactgcatgcctactgagtgtctactgcatgcctactgagcacctactgagtgtctactgcatgcctactgtctactgagtgcctgctgattgcccactgtctactgtttactgagtgcctactgagtgtctactgtctactgtctactgcgtatctactgagtgcctactgcgtgcctattgagtgtctactttgtgtctcctgagtgtctattgcatgcctactgagtgtctactgcatgtctactctctactgagtgcttactgattgcctactgagtgtctactgcatggctactgagtgcctattgcaggcctactgcctaccgagtgcctactgcgtgcctattgagtgtctactgtgtgcctactgtctactgagtgcctactgtaagcctactgcatgcctactgcatacctactgagtgcatactgcatgtctactgagtctctactgagtgtctactgagtcccttgcctgctgcatgcccggtgggctctaggcaccttaactgcaggagaggagggcagcccaggtcctgactcccacaccaccggcattccagggggatgacgaccagcacacaaggaagcagataagaccgcccgacgtgatgggtgctatggaagagggagccaggggtggcccagcagggcttctcacagggggagggaggaaatttcgtccccaaagggcatttggtgatgactggagatgtttcagttgtcacacctgggagcagagatcctggtatccagggttggaggccggggatgctgatgaattctctgcagtgcacgggatggctcccaccagagaaccacccagccccaaatgctgacggcatggaggccgagacacggtgagagcgatgcagggaagggggctggcagggagggccagggtagtcacagaggccgctctgaggagctgggctttgagctgagtccaaggcgtggagaggcagcatcctttccctgaggggccagagaaggagcattccaggaggaagggcaactgcctgcctcaggtaggagagctctggaccctgtgatcagaaaggggacgacaggcagagagacaccaggttccttgctttatatgaatttagcgaagtgcttggcatataggtaaatgttcaatattgttccatccagttcagtttcagatatctcagtggccagtgcaaatctagcctcacaatctcaatgtccctggatctattcagaagcagcgcgcctaggaccgacctgaagacggctgtttgaaaaccagcagggttattctattccaggattgtcataaaccagttaacctgctacctccaagtgtcccgtatttatatgtattttctaagggaggggaatccgctctcagattgccaattccgaatctcaagatgtcctttgtactcagaatgaaaacacgttcttccgttaaagagatgaaacagaatgaagacctgggtgctcccaaggtccccgattgtgtgtgtagtaacagccgtctaggagggaatccaaatgtgggggatgacaactatcaaaaggcacacactgtaaaaggtgccataatttaaattgccattgatatactcattatgaagccacggatcaatttctctgtagtgggcgatagacttcaatgtagttttgtaatttaaatgagaacttgggccctctcatccgggtccttgaaagatttccctttgaaatccgagccccttgtaataccagtttcatttacttttattgttccaatgtgcatcgctggtgacaagacccagaatgctgcctggttataacactggctttcaggtgcaagcagataaatcacctccctggactgtggggcacaagctcaaagctcaacaaccgtgttgatgaacacgtggaagtgtggccactttgtttgctaagaaaggctggattgttaaaacgtttggggttgtgttgagaatagacaccttcttccctcaatgacagacctgaagtctacctgtgtatcacctgcctgcttcctgggccgcctcctgtctttcactgtctccatgctgtctgtgttgtgactcagtttcaatgcctcctcctccatgcagccttccttgaattccgctgttgcagctgcatcacatcattttgttattgcgggtcacacaggcagcccaggagcatttctagctcacagacatgtccctttagctcacacattattttatttttaacctgaactaagttgtcaacattttcaagttggagatgtcatattttaaaaacccagatttccagtttgtctttaataatatggaagatttggcaagatgggatcacacttcactgaacgaagtcttgatatggatcttactgtgcaccaggagctgtttcagggctggggcttatgacctgcacaacaaatcgataagcaggtgctgttaaaacccccatttcccggctggggacgcaaaggccaggagaggtgaaatgactggtccaagtcctcagagtttgggtgtgagtagcaaagcagggaggagagcccaggtaaccatctccaggcccgtagtcttcaatgaactgggccactgtgctccctccccgcagggctacattcgctggagtggatagtctacaatttcatgtctccagcaaaagcgagatgataggaaaatggtgtagccactgcagaaaacagagtggtagttcctcaaaaaaatgaaaactggaagtaccctatgaacctgcaaccaaccccacttctcaataaaaccctgaagaagtgaaagcagggacttgaacaggtgtttggacacccgtgttcacagcagtgtgagtcacaaaagccgaaagggagaagcagcccagtgtccacccctaagtctccatgcagaaccaaactgtgatccatcctcacagtggaatattattcagccttcaaaaggacagaaattctgacatgctctgtgacatgggtgaaccctgaggccattaggctgggtgaaagaaatcagacacagaaggacaaatactgtctgattccacttacaggaggtctctagggtatcagactcatagagacagagagtaggaggtgggtgcgagggattagtggggagagaatggggagatagtgattaatggggtagagtttcagtttgggaagatgggtaggttttgagatgaatagtgatagttatacaacaatgtgactatccgtactgccaatgaactgtacacttaaaaatggttaaaatgataaattttattttaattttttgctgttttaagttttccttttagttaaattttaaattgttgtgggctgggtgcggtggctcatgcctgtaatcccagcattttgggaggccaaggcgggtggatcacctgaggtcaggagttcgagaccagcctgaccaatatggtgaaaccccatctctactaaaaatacaaaatgagccgagcatggtaggcaggcgcctgtagtctcagctactcgggaggcggagacaggagaattgcttgaacccaggtggcagaggttgtggtgagctgagattgcaccactgcattccagcctgggcgacagagcaagactctatctcaaaaaaaaaaaaaaattgtgggtacatagtaggtgtatatctttatggggtacatgagatatttcgatacaggcatgcaatgtgtaatcatcataccatggagaatggggtgtccacccactcaagcatttgtcctttgtgttacaaacaatccaattctactcttctagttgttttaaaatgtacataattttacagaatgcatattttaccacaataaaacattttttaaagtggggcagtgcaaaagtagttcaaggaggtcacatgttttaataaaaatagtgtgtctatgttgaataaataccatctgacccattccactcagctttcacttcccctgacccttcaggtctctgcatttcagctcctgatgtagctgggaggaggagagtgggtatagcagtgctcatgcatgtgagtgagagagagatcccggaaaggaaaatcgcacagaacaaaacccgtaaccttcaacaataagcctaaggtatcccagcctccagtctacgtgaaaggctgatcttaggccggagctatggcacgcaaatctgtaggggcttatcaggtaggacccccacattgtgagtgataaaacactatgcacctaatttaacccagccacttatgggaggcaggtctgcccgggaaggattatgggaatctgtggaagtgtctttgtttggtgcagtgattggcagtggctacctgcacttgcaggcaggggcggagatgttggaggtctctcgatgcctgaggacagccctccccaataaataactgtcccatcttccacaaggagaaaggcctgtttgtaatcatctgactctacaaccaaaccccattttgtagataaacacacagcatgtttgcacgatttcaatgtacatggagtttccggcgttgtagttacaatgggaaaggagggaagcttgcactgtgtttagtttggagtggtgtcaaccatcagccactgtcttgaaaaacatcgtcatccacggcaatgccctgtgtggtactggagttcccagcaccgtacacggacaccatctgcagcttgcagctgtcagacatgctgtgattacagatatgtacatcctcaaaaggacatatttagcctttactgcaaaatgtcaaagacagatgaaaatgtctattttagctgaatatggtcctacttcccttatagccaggtttacttttttctttttgttaactttatttttgtttaattgatacataggagatctccctagtttcccacgcatgtgtaatttagtacgcctatcatttgtaaaggccaaatcagatagttgggatatccgtcactttatatatttgtctttttttaggctagaaacattcaaataattctctccgagctatttggaaatatacaaaagatgattgtaaactagagtcagcctactgatctagcaaacactaggttttatttcttctgtcacactgtatatttgtattcattattatttttattactcttgagatggagactcactatgttacctggactggacccaaactcttgggctccagtgatcctcccgcctcagtctgctgagtagctgggactacaggcaagccccaccacgcctggctaattttaacatctttttgtagacagagagtctcactatgttgcccaggctgatcttgaactccaagcctcaagcaatcctcctgcctcagcctcccaaagcactgggatacaggcgtgagccactgcatccggccttatcctatgtttttaaataaaaataactaaatagaaacagtaataaataaatacacatggtaacattttcttcccacatcctagtgttcttccctggcgtgtgggggactatttataaacacttcagaaaccgtcgctcgtgggggaaaatgtgcaggaaacctccttgtcccatttccacttacaagcctgtgtctgatgtctgggcttcactgaagctcgtggagggaatgaacacaggcactcctatccccaaacaacagcagtgcctacctagcccatcatgggtgggctgggatctaggctcatgccacaacgcttactcagaacattcatcacttcttcatggttaccttttcagatgaccaagtctggaagggccgtttcattcattagacaacaatgggtcaccaagaacctgcagatgtaccaggaactgtgctaggccctgggggtgtcagggcggcatcaaagcgacggtggccctggagaaattcaatccttgagctgcctggctgtcccttggcaaatgacgggagcaccttggccctctcgtctccagacaggggaagagagagggctgtttcaggaatttcaaaggcatcttcctgagctctcatctgggaatctctttaggctcaattaagaagaaagtgaaaagttacatgtgttcagctgagggtgtggaaagaatgtgttctaagaaccaaatgctctgaggtgtgttggattacgcattccttgggtctgtgagtgacagtgaaacgcaggacacaggagagatgaagtcactgggcttatcagtccgcagtcgctgctgaggaggaaaaggtcctcggtgctagataacagcattgctgggtgactgcattgctgggcatgacttgcctgactgcaccggcacatttaatatttgccaggctgccagggaagcaggagctccagggaggacaggtgtgccttctgagaaatctgattcatcgtctgcccttgtgcctgctgcagtgcctggggcatggtaggtgctcagaaatggaacaggaaatgccagagagatggtcagggcatgatcgtggctttcaggtaaacaaggaggaggagatttgttattccttgagccattcgctgttatttaaggaacacgcactgctggtgcttccagagtctgtagatttgacacaaggactcttacttatggttctcttgaaaaacaaccaccatgctgccctgggccaacctctgcatgtgagagctgttaggcagagccagcttgccaatggtgccttggtaggcgacagtcctcaccacccctagatgctagccaccctgcccgcggcgggcccctttgtgtcacctgtctggacccaaaagcatttgagttcgcaacccttgccctaaaagaggaatgaagaattctgtcaaactgacaacaatgccccagaggaggctatttcattttatttaagatccatttcataaacaggaagggcaccaatttgtttgttctgggaaaatgacttttcagagctgagctcacagcagggtggctacccccagcatgccctggaacagcagccaagccaaggtgtgaagagggcctggaatcccatctgccatcactcactgtcctaggtgtgctggtctccacaaggcctgtcccacctcctgggatgctgtgaggctgagtgagcacgtatctgagagactagaactctaaggggcttctgaacaatcagcctgcgctcagcaaaactacacactgctgcacaagccatggtgttgatcgcagtggctgaaaatagggaaagcatcaacgacgctgacctacaggatccacaaatgaagccacagagaatgctaactttatgtcatcaaaccacaaatggtggcctggcgcggtggctcacgcctgtaatcccagcactttgggaggccgaggtgggcagatcacaaggtcaggagatcgagaccatcttggctaacatggtgaaaacccatctctactaaaaataaaaaaaaaattagccgggcgtggtggtgggcacctgtaggcccagctactcgggagactgaggcaggagaatggcgtgaacccgggaggtggagctttcagtgagccaagatcacgccgctgcactccagcctgggggacagagcgagactccgtctcagaaaaaaaaaaagaaacaaaaataaacaaaccacgaatggattggatacttagtgactgacacagtcgagactccagcaagcatttccgcttgtcagattgagtaaaacatccataatttgctctaattggccccaaactttggtagtgcctgccttggactatacgtggtctctgagcaccctccttgccactccaaaaaatacccaaatgtttttttgcaactggaattggccaagaccctcctgaaggtactcgactgaaggaggtctggggctttctggcacaggatgggaccatctcacttgcagctggaggttcttctgccatctggctctgtggcctctgatagggcgtgcacattcctgagcctgcctccctgtattaagtgttcctggtgggtagtgggaattaagtgttcctggtgggtagtgggaattaagtgttcccagtgggtagtgggaattaagtgagacaatgtattcagagtgaccagtgcagagttcacccactctctggagttaataatcactccctcccaataaacaggaagctggaggtccccagccatcagtccatgagtgctgagccttgtgggggtgagaggcagtgggaaccaggaaggacctgctgacgagaaggagaattcctaattcctgagcacctaccgtgtgcctgccctgagccaagcactgagtccactttctcctgccatcctcactggggcctctgaaatgcagctgatcttatgcctccaaggaagctgagccacaggtggtcttggtcaggcttttcagttcgttgtgatagaaccagaattcaaaccagacgcaatgtgtgtgtcctccaaaattcatatggtgaaactctaacctccaatgggaaggtgctaggaggtgggggtttggggaaggtgattatctcatgagggtggaggcctatgaagcaatcaagtgcccttataaaacggaccccagagagctgcctcgccccttccaccacgtgaggacacaaggagaaattgacagtccagaacccagaagacagctctcactagaatccagcctagccagctccctgatctcagactttcatcccccagacccgtgaggaataaatgtctgtggctcctaagccaggtagtctgtggagctttgccttaagggccagaaaggactgatgagatatgtcgactcccagagctgcaccgttaaaagacaacatcaaaatctgaagtcccagagcagcctgatgagacctcagcccagcccagaggacaaagtagaagctgtccttatggcatttggtaaataaagacatcagtgcaaaccgaagcacttcagaaagatttcctagaaaaggcaggaactaggctaagcctagactatgttgcttttggattattcactgagccttgctccccaggaatctatcttgccagcctgaataataaactagctctttcctcaaaactatttgtgtctgggcactgctgttgcaatagacaaagaagcaaagtccattttctaaggaaatgttgactatgagaataattccatttaggagcaatcagagccatcaacctctggctagaattctactcggaacatgaagatcttttaaaaatttgcctctaggcaaaaataattcaagtcaaaggaaccatttggatgcattcatctgttctcttcctccctacctccagtctgcccctctcaaaccacacattcttaaaaacaccttcccaaatcattttcaactgcctccatctatccccaccggcctttatgatctttagacatgcaaccaaatgctgctcccatggcaacagcctgaagaaagtaaacttttaattatgccacatgaaaatggagagctccgtgagtcctctctgccttttcttttagtgcaaatacagttccggattccatgggcggtcttgctttctaaaatctccagacgttcaaaggaggatgatcatcacgctttatctctaagtgtcttcatggaaagtttgcatctagtgtgtttcaaagtcccccaaagagaagctttcatattcaagagcaaagtaactgaatttgaaacttttattaataatgtaaaaggcttgcgtgacacgcagaagctggaaaaatatggggaaatcagaggagactttgctttatcaaagagcagccaaataaaggttgggcttgcttctgcggtgggaggaggggagaaacgcctccagggaggaggtcaatgtctttttctccacttgagtgctaggactttgggactgaggaccaccaattcagtcctagggaatgcctaggcgttttacaaaaatacacgtgggtatcaattttcaatccagccctgctgataccccctaggggagcagagagcctctctaaatgttttcccgcaattcccaggcatgacctccaggttgtacctagagggttaaaggctcattagcttcttgttcttctagaggcggcttgctctcattcgcagcagctggtcacgctgtgaaagccccttgcagaggttggtgccggcttcttccatatctggatgggtggtcgtagaatcgtggtggcatctgttgattgtaccttgtgttttctcgtagaaaagttcggttaacaggtgggtacaataactccattaacttacatcacgtttctctttttcccaacctaatctgtaattctctaagttctaggaatttttttaagtctttgcaaatgagaaggaagaaaaagaatctcaattgttatgccatttaataatggtgagcctacttgtggaaatttaggtaaaggtatgatttggtattttttttaacctaataagtatcacatcgtattaagaaattattagattgagtcacagatttttggaagaatatttatatatatacataatagaatttatatgggtaccaggaatataattcagccagggagaggaccatgtctggagaccaccagtcttttatttccatgtatttctcaaaaaggaaggccagggggcctgctcaaatctagacacctttattcttaacttttggttaaagtataacatacagagaagttataagtcatgaatgtgtcatccaaagattaatctcaaagtaaacacacctacgtacccaacaccactctcaaaaagagaaggtcaccggccaagcaccttctaaataggtatgcatgttgtcaaaatcactcccaaagcattttcacccattgaccctccttcaaacagtgggaatgagagtttgtttctccacgtcttcaccagactggtgacaatcaaacttctcaatctttaccaatccgagagatcaaaaatggtttgtcagtatcatctttttatttttgctctttgaggcggagtctccctctgtcgcccaggctggagtgcagtgacgcgacctcggctcactgcaacctctgcctcctgggttcaagcgattctcctgcctcagcctcccaagcagttgggatcacaggcgcccaccaccacgcctggctgattttttttgtatttttagtagagatggggtttcactatgttggccaggctggtctcgaactcctgacctcaggtgatttgcctgccttggcctcccaaagtgctgggattacaggcatgagccaccacacctggtatcctctttatctagacttttaaaatgttgagtgaagctgattttgagtgaagaaatttcttgtgtttattgacttctgtgatacacctgattcgttgttttgttataacaacaagtaaacaaagccagcctgatctacccatcaggatctgtttaaataaattatgggaacatagtaaccatagatgacctcaaatcacttagaaagaatgaagtacaactatattctccacaaaagtacctcccagatatagattcaatgaagaaggcaagaaaccaaaaacatacagtggaggattcaatcttgtttgtttgtttgtttgtttgttttttgagatggagtcttgcgctgtcacccaggctggagtgcagtgatgcgatctcggctcactgcaacctaagcctcccaagtgattctcctgcctcagcctcccaagttgctgggatcacaggtgtgcgccaccacgcctggctaatttttgtatttttagtagagacggggtttcaccacgttggtcaggctggtttcgaactcctgacctcgtgatctgcccacctcggcctcccaaagtgctgggattataggtgtgagccaccatgcccggccttaatcttggttttaaaaagaaaaaaggatgtgtatatgcatcacagaattctggaagaatattctagaaatcgttccagtagttatctctgtcaaatagggcaggggaaggggtgggggaaaattttcacctttaaatttaaaacaaatgtatttgcaatagttttagatttacagaaaaattgtaaagatagtaccgaggctgtaaacctataaaaccactcttaaaaataaagtttattagtttaaatttgttaaaaagttaataccgagaactcccgtgtaccctttagccagttttatttccccaaatgttatcctctcatcttcccatgtccatttgtcaaagctgagacaccagccttggcactcactactgtctgaacctcagacctcattccaacgtccccagttcccccttaggctcctgttcctgttccagggtcccgtcggagctcatgctgcagagggtcatcctggctccttcgggtcctcctgactgtggccacttctcagtctttgtttttcaagtttgtcaggcatgttatagaacatccttcaggtggggtttgtcaggtgcttttcgtcacaattagactgggtttgagggaagaacgccggaagcaacgtgcccttgtcttcacatcatatggggcagtcacgaggtgtaaaccttggcgaccaggtggcatctgccaggtgtctccacttttccctttccctgagctgtgcagaagtgagtccctaagtgctgggggagggggcgtaggaagggttagttaagctcctcctcccccgggaacatccactcattttatttgtcattcttcttttacatttaaacccttctgcgaggtttccctttcaacctatgcacgtattattccataatttaaacatatagttccccaaacaaacaaacaactagaaacaaatgtaagtcgctggacaaaactcaggggtcggattccctggcccttagccaaaagcaaagctttccgttctccgggaaagaaaataaacccagtcccctttgagatccagggcaggggagaggaaaatgactcggaaaccctgttgtgagaagcacgttgctatcccggatgaagggccatttcagccctaagctcaaagccggagctccgaccagcactctcaggacgcctgggtgctggccacgtggttgagccaggcaggaggaggcgttgtcaggggcacagaagaaaccagaaactcattagctgggaccccagccgggacctttgccccactggtgaccttgggaaagcctcttagcttccttggccacttccgtggtggtcgagtgaggattccgagttctgcctgcctgcgtgaaaaatatcttttgatgattgattagctaatgcttggaaacagctccggcactggaagccagttccccagaaagtgctaagcagtgttattaagggatcaaacaggaaggcctttgtgtgtgatgccaagatgattttgttaaattatgaaacttgctttgataaactgcctggaggtgccatctgtgacatgcttaatgtttttttccccacttccctgagcttattgaattatttgtacacaatttattttactttcatagggcattaaattactctgagaccttgaaatattttacagccaattcaaggcatctggaggctgtcaggagggtttttgatggattttgtctttaggagatgaaacagggggagtattctacaaatgagggagggcgggacctgttgcatgtaaaagttgctttcaactctgtttaacatgggtgctttaaattttcagctgctgcggaaatgcttttataaaatacatgaaggaatcgaggtacatttaatcatctctgtatcttaatcaggaacatttatcaaagccctttattaggggaaatttgaaatgtataccaacggagagaaaatacgatggctcctggtggatttattacactgctgcagcgatcctcaaactgaggccggcctctgtggtctctatgcctactccttccatgaaccccacggggaagtctgaagcagcttccagataccacagcggcatttcatgagtaaataagaatgctatttttgagtagcccaagagttgtgctgttctcaccggggatgcttaactatgaccttggaaaagctcctcctcgccctggcaggggtcaaagtcgctaggaggtgggtcactggctggaacaagccaggtgtgaaaagtcagcgctcgcaggggaccccagtcttgaatgttcaccttccaggacagcgtcttctgacgggtcctgggcatgagcgccgcgctcctcgggaagcacacagaagtgtttttattggatcatctgtgatgtcgcagagtggggagtcaagtcgccggcactccctgacaggctgtgctattccaggcaccctcctttaacctctagctgcaaagcttcctcctctaactttccttctgctgtgctttcccgaagctgacagcagcaccttgaccgcagtgttatggttctcaaagttttctgtccattggaatctgccgggcagctggctaaaaatcttgactgctctcatacatcactgatggacgtgcgggttgatacaacttaacggggaatgcaatggggtcaaaactatccaacatttcaaatgcatataccatttgaccctgaaataggaaactgtcttagacagacttgcccacgtggattttttattacaccaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagaggatccctaagctgaaaagtttaagaaaatgtgaagtttaaaactggttacatgatttgagatgtttaacagaatttaagatttattcaacttttaagagttaagtatgttaagtagtaagaaaaacggaagtgtttttgaaagatgagattattccattaacatatgctgttgaaaacatttgatgaaagttaattaacaaagttgctaatgttttcttcaagcataatgtgaaagttggctagattcacatgtagactaatgaggtttgtaaaatgaacatggaagattaaaggagaagttgctttttgtgtgtttttggttttgtttttaatttacaatttaaaaaattcaaaagctggtctcaaagacaccaccttgagaccaggttcagagctttatcataaccttaatcccctacccacctacttcccgagaagtaaaaaccaactccagaaagattaacacggaaatggtgttttaagggcaatttgagggagaaataagaaagggatttgcatcgtatggcagggtaatagtttaatatttcatcttaggcctctcactgcttcccctcactgtgtctctcctttcaacgccctctcctcaccctgtttactcttccttggtcatctgtggacgtgtattcttccatgcatttttgtttttgtttttgagacagggtcttgctctgttgcccaagctggagtgcagtggtggggtcatggctcactgcagcctcggactcccaggctcaggcgaccctcctgcctcagcctcctgagcagctgggactacatgcacgtggcaccacacctgtctaatttttttgttttttgtttttttgtagaagtagggtttcctgatgttgcccaggttggtctcaaactcctgggctcaagccacacaacttttaaagtaagcttatccatttcctcaatggattttcactaggattctattgaacccatagaataacttgagggggcgatggcgtgtactttctgttacttgcaaaccacagcttccaatcaagatgcttctcatctcctttgtaaaagtaaagatttctggctgcacttttagcccttcaggtgcaatgcatctttggaggttaagcatttagttcagtcccccgggtataattggtgctgggtaaatatttgtcatataagttaatttcatatctaaactcatcctacaagaagttgaggtttcagagcaactcgtctcatcctcgtataacttacctggagcagcttagcctctaggtggcactgcagagccggagacctgagtatccagccttcattaaataaaccatctcaaagaaaaatgaatagggagtaatttggggagattagatggcttgggctgggactcctaccattgctctcgcaatgctccatctctggagctggggggaacgtctcagttcagaaattccagaaccattcatcaacccttggcgttgacatgaaatgaaataaagtcgttagcttgtaaaatacaggatttcgttctccctatatctgtcaatctgttttatggttggttcagccctgccataaaatgtgaaggaattagaataaatgctggatttaccgctccttgaatacgctttctgaaatgatacagccacgcgatacggacactcggagccagacaagaacttctctgtgcagattgtatactctagtcctccggagttcatgagcttggccaaggggagctgcctgtagcatgtctgcagggaaaattaacataaaaccgaataagtgacatcttcaagtgacttcatcaatgggagctaagtcatgccaaagttgtctacttggggcagcgtaaacaaagaaagaagtgacatacaccaacatcgatggagccccaaacattattctgagcaaaagataccagaccaagaagtgggtgtgtattctatgatgtcatgtatttaaaattctggcaaaggcaaatctaatctataatggcagaaaagagatagggagttatctacagttgggaacgggggtgatggaggggcacagagaactttaagggtgatgctaatgttcttctatgtctttattaggatggttacctgagttgtatatgttaatcaaaactcatgaaatcattgcaattaatgagttcaggtgagactcacctgaagtaggtgagatttattgtatataagctatacatcaataaagttcatttaaaaaaatcaggatgtctgacttggcacagaaactccagagccatgttgccgtgtgtggacagtaactaatagtgaatatactcagaaactttttaaaaagttgttcacttccttatttgataaagtattaattatcagcaaatgtcagcaatgcaggccaaggggctttgggcaacagccagcagtgttcattagccttaaccatctctgaaatattttcaataaatgcatagtttattcttcctctacatccctaggctgtgtttctatgaaaggctccttgtcctcttggagatggcttcattagtcttggtaacaactaactggtcatctggaagtcagcatgagctggacaggaagtcaaggacggtcaccattcatttattcatttatctgtttgttaattcactatttcctgagtacctatgaggccagctctgtgttcagcaattttatgacagaaaatgagttcggatctatcctaagaagttcacatggattaatttagtatttattaaatactagctgtctaattgttgtatgtagaaaaaagtttgtgcttcaatggaaaactattatttgtcacagaggacacccatctgattatagtctttcattgtctttgagctatattacaaatctttaagttgaagataaccggcagaaatgcaaaaatcattcatatagaaatgcaaatcctataaaggctagagatcctataagaggaggacggtcggtagacgtccagttgacctccttcctctgaaagaatcaagcttgccttcatttgagcagacatttcagcattcctgatctataaatgtgtctgttcttaggattctctttagaactggtggtaacatctgtcgggtttcatcatttactagtgagcagaatagaatgtaatcattaacatgcattcatttgtaaatctgcatgacagtcacgattttaccttttttgagaattatcttttaacacacgatatacagggaacactaacaattagcgcagttggggaggttactgacatcccagatcactgggaatggggcgctggctccatttggtaccatctcaaattctggaacaaggattctctcccccaccatccccacacatccagtcctcgaatctggctctctggggcttatgtttttctctcatgatattgaaggatacaggctagggtggcctgcactggctaaaactcctagaggctggggtgtcactcctggtagatgctccacaagcaaaatcctggctgctgtcatcaggggaccctcagtggaccccaggggaggtggcttgcacggcgtctctgtgcagggctcagtgggggcacagcagagtgtgggcacgtgggctgctggctgaagggcccacgctcatgggtgttagggatgacaagggtcacacaggaggcagaggtcccatagccccacggttcctagacctgactcaggaagcgagccccatgtgaggccggcctgcgtttcaaaggcggaggtgctaataatcccaaaggaggaccactttctccccaaatcagagatcgtggaaaatgacaaggcagcccacccaccgtccactcacccgcaggcatctccacacctgtcgtggcccctgcagccaaggcaggcctgtgtccatctggctgtctggacacaaaggaggaagggcctgcccgtggtcaattttccacccggcccctcccctcctcactctttccaacagcgctccctttgttgggaagggtgtggtggggaactgaccatgggggaggccctttcaaagaggaaataaggtgtgccggcacaccagcacacgacgcttgaccccacaccactctgagtctgcaaatgcccgtccaaaggcttaggttgcaaatcactcgctcttcaacacctgtctatcgcaagcctccgatgcactgtgcactttcttatggttgctggagatggatacacaaaccatcaaacaacaatcttttgacttctgctccttcgttgcagaatttgggaacctgtcatgacctttcaccaccagaaaagaccaccctgactgatgaatctgggcaagttaccactgtacggattgtgaggtcggtgaccgaaactgccgttgatcacatgaatatataaatgaagaaataaatgacagaacccatgagaagatgcttgctcgtggattttaaatttcctattggctagtctggaatcacttgggggtagaacaagataaagttggctgtatcacctatgcaaacatggtaacaacagcacattgacattagaaagtaaaacactcagtattctatgcaacaagttggcagattacaacccatgggccagctgcgtgcttttgtaaataaagttttattggaaagcggccatgccccttcatctaatgtgttatagtggcggaattaacttgctgtgacagagactgtaagtccccaaaagcctaaagtatttactgtctggctgtatacagaaaaagtttgccaacccctgatctatgctaaatacctattactgtcattgtttaacagctggaaacggaagccaccttagttattttagggagaaagggaatttaataaagggaattggcagtttataaaagcagtggaaggactgtagttgaggacagcacccaagacctccagaaatagctcctagaacaaccccacagaaccaggcaaggcagggagtgccctcccttaggggtgagggaaacagtacatactacactctgggaccaggaagccacgcctatggtccccataactgcctctgggcacctgtggatttagaaactgtgcactggcctcaaatgcaaaaacaatttccatcccctctctaatgatgttgcctgtaggaacattacagtgggtagctagtcgggcatgagcaggcaggagagggctccccgccacacagacacacatacaccaggagtgttgggggccatcaggtggtggtcaggaggttgttaactgtctctcgaaagtaataactgatcacagccaacaccagggaaaggcaggctcctaatagatagaaaacaggtgaaactcatcagcagtttcccaataagatcctgggagtgggggaagagacaccagaccccgggagtagccaacgaataaaacccaagtcaaacagtcaagctgcacactggtcttttgagtcacctgcttggccctcttccaagtgtactttcctttccttcttgcactaaagtgttttgatcaacttccactcctgctctaaaacttgcctctctctctcccatcttgtgcccctcctcagattcttttttctggggaggcaagacttgaggttgctgcagactcagatcccttccacggcgaacagaagcatcacaaggacggctttctcctatgtgaaggctgcagaaggagatttcagctgttgctcaggacggctccctggcatcaccgggagtcctgagagctcatcggaataccgatcacaatgctggtgaagccaagcgtcgcgcaggggctctggggagaagacgcccaggttaacataggaggtcgttaggcagcaccctcccttcccgcatctccccccaaaaaagcctccgaaaattgctccgtgcccactttgcaatagaaagttcagtgccaaaaccaaaaaataatggatcatagtgtcttctcagagtggtgttggcaacaccaaaggttgcggcagaggggcaagttttgcatccttttcctatttttgttaacaaaactgacaaactatagaccccacagcaagcagaggtggggatgaggttacactcctgatgttttgggtttaaatttattaccatcataatgcatggctctcaagcaacagagtgctatactaataagtgtaataatagatttgagcttagcgtcataggctgtgagagaacagggtagcagaaccacacctctgtccacctccaggctgaacaccaggggcttttcccatcagggtctctgggtccacctgcaggtcaactttgagaaacagccgctgctgctgccctctagtggcgattctcggaacgggcactcggagagcgaatgctgtttcttacctcactgctggtgggaaaattagatgatcaaaaacgccacaaatatctttggcttaaccttgattcaaattaaggtcaaaactcctggccacagttactaatcacttgagggagtaaaaagcaatcgatgtagcttttttgtcagttggcacaggctttgaaaacgcaaagccctatttgtaagattagaaggttagtaaatgtttgcatatcagttagcgtaacatttaaggtcaatatatactttttctgggttttggcatcaaatgttacttaggagacgaagaactttctccttctcttgaaagatttatttattccatgaagcatgcacttacaaccttcagtctcactgtcatgaatttgcctgaaggggaaagaaaaaatgagcttcctaaacataattttatatgtttttaatttttttccagaacattaaagtagttaaaaatattgaaaacttgaaaagcagatatatgaacacttacagaaaaaacgtaaatatagttttataccaagatagaattcattatcattttacttcacttagattaatttaaaaccatttaagatcacccccagtcaagagaaactgtcaaacatgactgctgtccccatcgaaagtgagacaagcagagaagtcgtctctgaagatatttgtggtgagtttgcttccctgtctttcttgctgcctgaggttccggcctggcacagctctcaatcagcccttattcaaaatgttagattttgagcatcttaggttttttcattcattttaaattttgcccctgaggcaagtgcgttactcactttccccgtggtctccaaactcggaatcttctcacagaagattatgctgcatggaagattgttgtagaacactaatcaatcactaggtgtgataacacgtttttcagaagagatcaattttccccaaccttgtgatcattaacttatgagctatgcctcattgatctaacactgttaaaatcaatcaacctaaaaacgatgttgatatggttagaattatggacatagccaaggcattcttcctgaaaaataactttattttcaaggaaaaattgacaagggactctaataaaatgcttggcaacacaataagccatttggatttttccatgacagcatttccatgcttcattggtataataacaataaagaaatgagtcaataaaacaggccacacagatgatgaaagatcgattcagtattattttgctgacattttagatttaatcttcacataatctggctttagcagaagtcgctgaaatcaatatgtttctttttagctatgtggttttattaccttttcttgattagtatattaactagcagattagagcatacaagatttcctacaatatattcaattcacaaaaataatgtttcccaattcatccacttcaaaatgaccttaaactcctgtataggaaagatgaattgcttttttctggcagacctgggagctgtctaaggggctcttggatggactttgcagccatatcacactcctaagaggtgtgggtttagacatcaacctctctgccctgaaccacattctctgttgaacttcctcaccattgatttttttcttaaatctgagggtcaaagctttctattattttcattatatttttatctcactagttctaacctaatgctccaggcagttgggaaaatattatctaaatatctgctttcatggctcatctctaaatcggatcagtaggctgagcctttgctaaaatgattgaaaagaacaagaacaaggtgagatctgggtgtccctgcagcaaaggctgcctccaggtgaatcttcatttagaaacagagcagccaagaacacacgggagccatcgctgttgcttgtcctaaatgcattctctcgcttgctaaaattcagatacaggggactgaggcattctctcacttgctaaaatttagatacagggaactgaggcattctctgatcaagagactcatctctgaaagaaaatgagattggcttcattttcaggctttctctcaggaagtgagagcaaacgcatgcttcctttgcatgaatgccatcttccttctgaggctctcaaatggggtaactctgcttccctgttagtgaaggacgtttccgtggtcagcggcagaaaccatacaaaatgcacttaagaacaaacagaagtgacaggattgcatgactgaaaagtttacaagtagttctggcttcaggcatcgctggatcaaggggttcagaaattctcaccaggactcagtctctctcaagctcttgtttctgctttcacaggtggtgacttcattttcatttctaggcaggtttgccctgtctaaaagccagatacgcagtatatctaggcttcatcatattagctataattccagtggaaaaaagagattaaaaaataccaagaatcaatccccttggcctgagcacccagttaggatcaatgatcaactcctagatcaatcaccattgctgcctgtggcaatgctgcgaatggcccagccccgggtcccatgccactgctacaggagagaggtggggttggacccacacaggtcaaataggatgctgcctccaggaaaggggcactaggttccaggaggacaaaaacacagatgttccctccacagtgcagtcagagccctgccatgacctgacagcaagcactcagatctgtaggtttccgagacccacgtcatctccctgttgagagtggagttcacattcactcgcctgctgtttcctggtcccatgctgatcctcctggtcccatgctgatcctcctggtcccatgctgatcctcctggtcccatgctgatcctcctgacggtcactcaaacatccatcatccagttctcagcgaccacagtcactggcatggctagcactgctcttggtcctcagcttcctcaagtcattccctgtgtgtttttggctttgacgcccttctgcaactgtattcacatcctctttctatatgcatgtatatattataactcatggctcggtcatgctcctttatggaagagttccttttaaaagaaatggagaaaatgcttagaaaaagtgtatttaaaataatgtttcccctacttttatccctttcggtggcatttccaaagaaaatctaggagtccacttacttctcaatcccttcagcagaaagaatttcaaaacagtgggctcacacttctgtggcattttcagtcttcttcacattggaactatttactcatggtatgtttgtgggcgtccctgccttctgtggaccaggagcccctggggagtcttgttccttgctcctggtggagcctggtcagcacctcactccgtggcttcgcgcttcgcagacacagcgcacctgtcatcggatgaattgattgggcatcttgtcgaacaccagcacgggttgtgctaatgattcttagctccattgcagcatagctgcaaatcaatcactgtcttccagaattcctggatatttctttttttctaatcagaaagacagtagcaacacctggtgccgaagaagtgtagagatgctgatttgtgtttagagcatgctcagagttgaccttctcaaatcaagaggaaaataaagagaaaaagagagaattcctcggccctggccagaaatggagggtggacttacagccaggtgctcaggtaccagattggtggttactcttctggcctcgagggcatcagcgttgctgacatgaacacagcagcccctttcagtcaggttttgctttcagttacccacgatcaaccaccgtctgaaaatatgcagtggatcactccagaaataaatcatttataagttctaaactgtgtgccattctgagtagtgtgatgaagcctggcacagtccttctccaccctatccctgacatgcattattcctttgcccggcatgttcacgctgcagacacgacactccgcgcccaccagcggctcagcagccatcttggtggtgagctggactttctctgtatcacagtgcttgcatccaggtcacccttatttgacttaaggatggtcccaaaagaccatgtgcacgtggcaaaggcagccgtaaagcactttttttttttagtgaaaaggtgaaagttctccacttaatcaggaaataaaaggaatgataagctaaggttgctaagatctttggtaagaacgaaccttcaatctatgaagttgtaaagagggaaaaataaatttgtgcacaacatccatagaggtaagcactacccgagctttcaggcattccctgggggtcttggaactcgtccccggtggataagtgtatgactggggctctgcttccactggagatcaggatgtcttcaatgtctaaaagaatgcacgagaccctgagaatgcaccgggaacatgctccccaaacatatccttgcttgtaaaatcacccactattctctgaatatcctctctcaacaattaaagtgacagttctaagttatcactcagaggatgtggggccaagtgcagatattaattctaagaaattcttaggctgggtgtggtggctcacgcctgtaatcccagcactttggaggccgaggcaggtggatcacgagctcagaagatcgagaccagcctggccaacatggtaaaaccctgtcttttctaaaaatacaaaaattagctgagcgttgtggtgtgtgcccgtaatcccagctactcgggaggctgaggcaggagaattgcttgaacccaggaggccgaggttgcagtgagccgaggtcatgccactgcactccagcctgggcaacagagagagactctgtctcaaaaaaaaaagaaaaaagaaaatagaaaaagaaaaagaaaacgataaaaaaagaaattctttgcaaacaaagagtgagaaacgccatggaaattctcctgcggggacctgtgtgatgacaatcagatgggtcatgcggccttgaagttgtcgctcttctcctaggtgaagttactggcactgtgagcagaacctgcccaaaatggcagatctccatggggcctcaaggtccagtgtgaagcgcaagtcctgctggaaaggaaggcgatcagggctggcagagagcagcacgtcacatggctcggcaggtgctctgcgtatgacagcgcctgggagaaatgggagatgacgtgcattgcaagctggacacagtccatgcaggccccacctcaagatgggccccactttaggggagaccctacttgcttgctaagaatgtcaattaatgccccgtttctttctgcggcccagagagcacccggcacggctcccaatgctgatggcatcttcatcgggcagctcctgggagggcactgggatgaggagtttggccagggaaaggtagccaactgttcaaactgtccaaatcatgcaaacacagagctgtaactaatctcttatcatgcctatttttatggttatttcttgacgaattgttaaacaaggggtggattattcctgcctcccctttctagagcatatagggtaacttcctgatgttgccatggcattcctaaactgtcatggcgctggcgggagtgtagcagtgaggacagccagaggtcactctcatcgccatcttggttttggtgggttttagccgcttctttactgcaacctgttttatcagcaaggtctttatgactgctatcttgtgctgacttcccatctcatcctgtgacttagaatgcttaacctcctgggaatgcagcccaccaggtctcagcctcattttacccagcccctattcaaaagggagttgctctggttcaaatgcctctgacaaatctggctgtttctgtcccttacttctgttttctgtacttcactttcctttctctgttgataaatcttcttccgccccatggctgtgctggagtttctgggcctagcctggctcaggagactgcctgatttgtgaatcgttctttgctcaattaatctcctttaaatttaatttggctaaagtttttctattaacaacagcaagggctgactgatgtatcttagagcaaaatcgtgtctcttcaacaaggccctgcgtgatgtgggccctgtctacctcttcaactcactgtgtatgacaacacagacctgctgtctgcagcctcaatcatcaaacctgttcctgcttcaggatctgtgaactggctcttccatcctcccaggaatccctctcccgcataccaccattctcccgcatctcaccattctcctgcatcccaccgtggctggcctcctgggttgattttggtgccagctctcacatctcctcctccaggagccctccccaatgtctccgtctaattgttcccctccatgttcccctgtcaccggccctgttccatgtttcctggtagcactcatcactaccactttttacagatgtcctcatgtgtttgctctgtatcccgtgtctcctccctccagatcataagctttctgagaacacaagccatgtctgacttatcactgttgctggctccagagcctgatcatagcagctgttcaataatattttttaaactgaaccttaactagtttccatctcaaatatatatgcagagaagatggttattacacccataagtttacctatgaaatcaacaaactagtatatatgccttgttaaagtccaaaaagagaaggttgtcaggagaatcaaaacaaagccagcccgaatgaggagtggttgtgaggtctccataaagagcccgccctaggaggtgggttgatctggggccccgagagcaggcaggagctgggctcccagcagctgagggcctccaggtctgttttcatgtaaactagtgaacgatcccagcttctcaggtcggttttcatgtaaactggtgagtgaccccagcttctcagacctcctcaatcctgctagggagctttgatggtttggatcaggaaaaaaaaaaaaagtctttctagatgagaactgaagagacaaatcagccttcaaattgggcatctctctatacctgtcccacctgcatggaagaaaatgaggaagtgtcctccctcgggaagtaataatccagataataacatgcttgcctgacaccattcctttcatcttagcatctcggagctcttagaaatattaaggatttaatgggtgtcactgggacgcaaagccattccaaagcagccggtatctcaggttcccatctgggaatgggcttactctggtccattataatgacagccctgtaagcaaggtgctattagcctgtttcccagatgtgggggagtgagagccaggcagggctgataacattgccacctactccctgcctcaggagtgccatagaggccagtgacatcgtgggtgcttcaggttggcagggactcaggaggttggagtcacaactgaatgaagaggaatcagagcctgggagttcacatgcagaccagcaggacaaaggcagtccattcactccacgagaatgcactgcacaaaaagacaatccagtgggaaaaaaaagtggtcaaatgacttgagcagacatttctccaaagaagatatacaaatggccaataatcacaggcaaagatgcttgtattagtctgttctcacactgctaataaagacataccggatactggataatttataaaggaaagaggtttaattgactcacagttccccagggctggggaggcctcaggaaacttacgatcatggtggaagcagaagcaaacacatccttcttcacatggcagcagcaaggagaagtgccgaacaaaagaggggaaagccccttataaaaccatcagatcttgtgagaactcactcactatcacaagaaaagcagcatgggggtaactgcccccgtgattaaattacctcccactgggtccctcccacaacacatgggtattatgggattgcaattcaagacaagatttgggtggggacacggacaaaccatttcagtgctcaacaccattaagtcacgagagaaatgcaaatcaaaaccacaatgagataccacttcacatctcctaggatgacgctactcaaaaaggcggagaacaacaagtatcaagaaggatgtggagaaagtggggccctcctgcacgaccggtgggagtggacaatagtgcagccactgtgaacagcagtttggtggttcctcaaaaagttcaatgtagaattaccacatgacccagcagttccaatcctaggcttagatcaaacagaatggaaaacagatactcaaacacaacatattcacaacgcattcatagcaacactattcacaatagtaaaatgatggattagtgggtacgaatatggagtttgatagaganatgggacctagtgtttggtagatcagtagcgtgactacagtttccaataatctctggcatatttcaaaatcgctagaagagaagaaatagaatggtaccagcatgaagacaatatttaagatgatggagatcccaagtacatagatttgatctatacaaattatttgaatgtatcagattaccacatatgtctcaaaactatgtacacctattatgcatcaattaaaaagcttttaaaaaagtagaaacaatggatgaatggataaacaattgtgatatatccgtaaagtagaagattattcagctgtataaaggaatgaggctctgatatgtactacaagatgtaggggccttgaaaacaccacgctaagtgaaagaagccagtcacaaaaggccacatggagtataatgccattgatatgaaatgtcctgaattaaataaagccacagcggcaggaagtggattcattgttgccagggacagagaacagggagaaatggagaaggaccactagcgggtacagagtctcctttcggggtaatgagaatgttttggaaataggtagaggagggggctgtacaacattgtaaatgcactaaatgccactgagctgttcgctttaaaatgattaactatgttctatgaatgtcaatttaacttttttaaatgcagagtttctttacaataaaatgacaatcgctgacatttactgagcacttctatatgccagcctccattatcatcactggtctcagatcaactcagttaatcctcccagcaaccctgccagatagggactattagtctcacttgcagatgagaaaattgagacacagaaagttaataaattgcccaagtttcccaatataataagaggcagagccagcacagacccaggcatctaaacaaccaggggtcctgcaccagtaacctttggcactagaaattcacactgatcactgggtgcctgctcttgaggtgcttctattctgaagggtgggcacagatgatgaactaattgccaaaaaaagcctccttgcaggctgtgaaaagccctctgatcaaatgcaaatactaactatagttcaatttggaacaacacttttgcaccgattgcaactgagattggctaaagattcacgagtttggcaaacataaccagaagcattccatgaagattaactgtctctcatggaatgtatactaaatatgattgtatactttttactgtttgtaatttgtgtactacacagtttttatattagtaaaatttattatatatgtgtatatagatgtaggtatgcaacacacagatgtatatatcatatgcacatcccacccccagcctgggaactttgttataaacattttctagcaaaactattccctactcatgaaatttcattctcctgtcagtctccagggtgagcaatgtaggatcacagaacaaattcaacctaaagaagaaaactgtctgaatataagcccaaagaaggaagttaaagagaccatcctttgagaaaaaagcatttagtgttgggaccaacctaggctttcatttacccaatagcgtgagtttaggcgatctattatctagatctattatctattatctctattatatttaatctcaggaagactcagtttgtttatctgtaaagtaggggacacaagaggaatgagagttgtcatgaagattaatagtcgctaaaatatgttggttctaagggctgaccctgagctaggcattctacatgcattctctctgaatcctcaaaatacccctaatatctacccatccctctggaatggggaagcagcggcagagggaggcgagcacagcctgaccccagggcgcagagctgcacagaacgcgtccacgctccgaccgcagagtctgctcccagctgctgggcacacccctggctcagaggcgcacagagtcaagcctgataagcggtattatcctggaggcaaggctgcttactggctctggcttggtcgcctgcgtccggaacctgaaatccacaaaggtgcacacagatgtgggtcgctgccttcccaacaggctcctgcccggttcacctggggaagcgcagggctgcgggcacaggattctcccatcagacaccgggagagcatctccgcggcagcttgcagggcccgctgtctccactagggggcggcgtacgcgcgtctctcgaagccgggacccgcgcggggaggctgcactggctggaaacagcgcctgggctcccgcggctcccacctcagagatgtccccaggtgccccacgccccccgcgcgagccccgacacgcgagccccaccgcactcctcaagggcttgtgtggatccttttgtccccacccccaaggagctcctctgacccaaattcctgctgagctcactccaggccaacaccccgagccacgcgcttccccagggaggattccagccccctccagtacggcctcagccgaggagctccgctgggccgaatgaggcccagaaaacacgacctgccaggagcggatatcatccacacacaaacacactggtgcaaatgcatacacacatgcatacacacactcatacacatgttcatgcaagcccatgtgcaaacatgcatgtggcatatgcacgcacacacaggggatcctctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctcactgaccagctttctgcacgccgtgcaggagggggccacttcctcggagagtattggcttttaattaaaacaagccctaccatctttacatcggtaagaaacttggggaaatctcacctttccactcattcattcatccgttcaacagacatttgagcgcccagaatcccagaattaataggcaggttcaggcacccacccctgggtcgctgtccctgggtgtcctgggtctcactaggaggtgctggaggaagtcggggtgagggagaaagtgaaaaagaaggtagaaactccgggcagttagaacaccaccttcaactgtgttatttcccaagtgaaaagttgcatgattttatttttgaaagactgccatttttattatagtgtttttttttttgttgttgttgttttttgtctagtgagtaatttttcaggacctttaaattaaaattaattcagcggaaatcacttggcttttctagaattttcctggcaaaggtccttcctgggccctattttccttcttttcctttttgtgtctctccctcagcaactattagaaatatttagtgcaagagtgagagccaaacgccgggagctgggtgtgagctatttgagaaagtgcctcctaattgatcttttctgtgctgttttaattcagccacgttcaggcccattattttagctataaccacttcagattgcctttttctctcgttttttataaaaatgtctgcagaagtgcttcgccctgtccagctgagatggaaaccaacaaatagactttattatagagaaatgagggttctgagaaatcagcaactggaagataagtctgtaactaataaatgaaaaggctcttttgatggccccagctgaaaagatattttattttattttttttcctgtgtgtgggatttgagatgtgtgagtctaaggagcagccggggtcccccgctgctcagccctggctggcaaccgacccccctctggcaaatgttatggagaattgggaggaattttatggctgtctttccctcagctcttttttcttttgtcttctttgaagaatgactttagacattttatttacatatttaaccatggatgaaagacggaaaagaaagctttggagccgtcgtgggaatagtgatatgtttaaattaatggaaatcttattaggcttctaaaattttgagcaaagatttttaatgaaactttataattaaacatgatttcacataacgtgcagagacaaggaatatgtttttacccccaaccacctaaaaatgtctgtctatcggaaagctatcagtaaacattatccgccttcaggttcttgcaaacgttcaccagggaaagtatgaggtttttgagagagaatatttcaggagtcaggcagtgttttgaacaagaactaaatattttttggaggtggaggggaattgaaagagaggcccagtttcattccatttaaactcacaaagtcaaaagtataaaagtactttgacacggatattgctaaaaatcaaagttgtatcttttcttattatgtaatagtcaatggaaattataagcactgtgcgaggttttctgaaatgggattagagaaaacccaaataatctctttaagataaaaaagtactgagtctttcagcaacagaaagaaattaaaccataagcttagcatgttacaagctaattgcaagagtaaactggtggcataggaagaaagctcataaacagaagtaaaatcgtgctggtgaatgttgagataaaaagtggttcaggctgtcgcaacgcctttcagtagctgctgcttgaatcacctctcttggtacattcaagtgtgaggatccacgtaagtgattcttgtgtttcttctcttgtcttctcgtgtcgtcaatgtttgtatttagtccgggacatttccaattctaccttcaagtatgagaatgaaaactgatctatttaccaataattgcttcacatgcagggaagtctgatgtgaatagaccttgttttctctgacctcatctagtatcaagtttctgcagaaacttatcagatataaaacatgcacaaaaaattatgttttctgatcaagtaggcatgctccccgtggcgtgcccccatctttttctccagggaaaatacctttagtgatctgaagtgatacttagcaaagaaaacacagtttgtaccaccagaaaggccatgcaagtcgcagcgaattcaacaggcgcaaaagttttaattctgcctaaaaacactggctgtgagatgtggaggtttgggggaaggtgagaaatgaaccccgaagcacccccatcctaaagtggatgagtggggtgtccagtgtggctccagcacaatttaggcagctattttaaggccacttcccttgaaatgtggtttgaaatattaccaaaggttccacggggtgcactagtgtgaattgcaaatcagagcattgatttaatcctctttcaaggccgggctttggatcgctggcgtcgactggctccccactgctcctggctcaggagggaccattcaagggggcagcttcccgcctctattcccacactccaaaaaacaacaccgcagacagacaccctccaactaaattagattaaactccttctcttccacagcgtattagcctttttgctgcccaagcctccttacgcagcccctcctcatttaaagacacagatttctttttcatctctgcaactgcaacaacaacaaacacaatcatatatatatatatagtgtgtgtatatatgtgtgtgtgtgtgtatatatatgtgtgtgtatatatgtgtgtgtatatatgtgtgtgtatatatgtgtgtgtatgtgtgtgtatatgtgtgtgtatatatatgtgtgtgtatatatgtgtgtatatatgtgtgtatatatgtgtgtgtatatatgtgtgtgtatatgtgtgtgtatatatgtgtgtgtgtatgtgtgtgtgtatatatgtgtgtgtatatatatgtgtgtgtgtatatatgtgtgtgtgtgtgtgtgtatatatatatatatattttttttttaaagagataaagccagccttctaagtgctcttacatggcaaggacgttatctgtttaaaatccaggagggcgtcgcctacctgttctgaaactcaacaaattaacccttaacctggggcaaacctagagcctattcacagtgcttcaacctgcaattctgtactggactgtttttggaggaatatatgagaaaagaaacatcacagaattccagaaacacgacacaaaagagtgtgtgcgtgtgttgttttggttggtgtttgtattccaaacagcttgagcggacagcttatcggaagcgcgtgcccattctgtgagttcagacttcatacctggtcttcattgctttgctccttgtcccctcccttagctgtttgggatgtgctgatttaattactccccttcccatctgttttctttcggcttccctcctgcaccctgggacccttttgcctgttctgggagctgagtgggtcagctcatcacaggcctgcgccctgcatgggtgacagaggaggcaaagatgacacagagaaactatcccttcagggacagagtggggacacccacgagcttggctctgccttacaaagaaatgagaaggaaccccgttcctgcttttcaccttaggtgagctctgaatctgcagccactcaccaaacgcctgagcagccccgcaccacagtgatgatctggggaggaaacgacccggatgcctgggtctgaatccccctcttccactttctagccccatgacctcagatatgccacttctaattgctctgcctcggttttctcatctgcaaaatgggaccagcagagttcccgcttcccaaggcacgatgaggatgatgtcataacacacttggaagcgttgatggcaataccaagcaccaaataagtgctcagtgatgagtagcggttattattgttgaaatgcaatataaatggagggagagagcacaataaggagaggcactggaatgtgacatttgtggggaggagtttggggacatgtcagtgtcaggcacacagtaatacaagctgataatcaaggcaagcaaataatcaaaaggctaacaagagccgaggctgactaagcatttgacaggtgctgccttaagccttgataggaagcagctcactgcctcctcataggtaccccaggaagctggtccagagaagatttccatttcagagaggagcaactggggctggggagtccgagtcactagacccaggccacggggctactgggggtagagccgacaccattccactcccccaggggctcagctgcctacgcctgcctcctgcctctccacggagatgcaagcacagtgggtacttgtgatggagcctgactttcagaatgggaccccgttctgctgtcctgtctggagccaggcaaagatcaagtcttggtttatggctttgttcaggggctcctggcctggggcgaggctgccactttcctgtcatgttgatattccccgtgatggtgtctgaagggattctttggagccacaaacagggaggaaatggcggaagaagcaatgtgggaggtattaatgtgtgttggtttacccatgtcctcagctgtgtgaccccaggcaagttacttaacctctctgagattctttctgtttcctctgctgtaaaatgggaacaatgacacttacttgatcaggttcggggtaggaatgaagtgagataactcagtaagctctgagaaccgagttggcacataatgctagccctgtgggattcactggtctgtaaactttctggttagttgacttttctttgttaaattcatttgtcttcactggccggaagccaagatggcttactaatagcatcacttacgagtctttctcttttctatagggctgccacacttgtgtatcccttcttccttgaatttaaccaggagtgagcagtggacagcttcttccctatgagaaggaggtgaagcaggacctgaaatcccgtgctcagctcccacatgccccgtgtccaggacaagtcctttgctgaatcagcggcagacaccacccggagccctgcggagcctttccctgttcttccagcatggatctgaaactcccttcccactttctgcagcctcccagagatagttcaggctccagcctcatgtgatagcatgaagagaaactggttccaacagctgtgtgctctgctgccctcatcccaaacaacagtttaaatgcacaattacgcttttctctaaggcccaaaataggataggaaagatcgttttgctatccctgaatgcctgtcacccttgtttcgtaaggtaagattgggaagggcttggccattgcccttgcagctgagaaaccaactttaggaataaagacactctctccatgtctgacaaatgtctgcccatctgctggcaggtcggtctgtctctctgagatatagattatatatgtatacatatatatgtgtgtgtgtatatataatacacatatatacatatatacacacacattcacatatataatatatatgtgtgtatatactatacacatatataatctatatagagagatatataggttatatatatgtacacgtgtgtatgcatattattatacagacatatacatacacacatatatatacacacagacatatatatacacgcacacacatatataatctaattatggagctgcccttacagctcacgcatgtcatgcgcacacacgcaggcacagtcattagctttcagagctgacacatcaggaggctgcatcccccgcctcctcatggctgaacgatgtctgctcctgggtgacgcgtccactaggctgcctcctactcaggttccccctccccagccccttgtctcggagcagtcttactcttattttgtttgtggtactttttctgcccgtcgatgatcttactcatctgcttatgtatttattttctgttcctcctccagcaggaagtcagtcccagaatagttgttctgctccctcccttctaataagtgctgcgctgagtgtgcttgctttgccagatggttaaaacagagcaggggatagaaggacagatgtcttcaccctcatggagttcaccttccagtaggaggaggcgataggccggggtctgcacatgtgcgtgctacagcctgttccacggtgcgtggcgtgcggggcaggtgagcggctcatgccatccagagagctaggaaaggggggctgcagttttagcaagatgggcagggaaggcctggatgagaaggagaccactgagcaaagacaccaggagtgggtgcagagagctgagggcacttctagaagtgcctgctgggataatggggtgtctgccagtgccacggccctgaagtgccactatacctggggtttttgaggaagaacaatggggccaatggctggaagtcaggacataggggccagcgtcagaaggtagctgacagaagaggtgtgtggagaggaagtgggagggaaagaaatcgggccatgatggcgtctatgggccttttgattttgactctgagtgaaatggggagccacggagggttctggagagacgagagccatgctctgacttcagtcttcccaggacccttctggctagtgcatcaaggacacatagtggcagggaaagagtgaagcagagaaacagttaggagacagccacagtggttcagaggagataggctggtggcttggaccccggaggcagaagaggccacggtcagcagggattggattctgcttagagggccacaggcaagcctgggccggctgtccattttgaccatggaccaaggctgtccattttgatggaaaactcattcttcttcttcttcttttttttttttttttttttttttttttgagacagagtcttgccctgtcaccaggctggagtgcagtggtgcggtctcagctcactgcaacctctgcctcccaggttcaagtgatttccctgcctcccgagtagcctggactacagatgtgtgccatcaagcccagctaatttttttttttttttttttgtatttcagtagagacaggatttcaccatgttggctaggatggtctcgatctcctgaccttgtgatccgcccctccctcagcctcccaaagtgctgggattacaggcgtgagccactgcaccctgccagaaaactcattcttctactccatcctacagttttccctaagagagaaacaataaaacgccaccacgaccaatggcaaaaagctggcacccactccacgacttttcatatctacacgtttgtacagctttatttttaagcattctgaaattctatgcaggagagaccccagctaggtttagggagtcctagggtttgtggagtaaatgaagtttctccctagaattagggagggtagagacaggcagagaactgacaatcctaacagctgctgtcctcagagccactgtttctgagagctgctcgctgagtgcttctagcgagttaaatggtgttcgcccaaaagacctgttcacgtcctgatcctgggaacctgtggctgtgatcttatttggaaaaagctctacattacgtctttgcagaagtaatcatgttaaggatcttgagaggacgtgaccctgaattatccggctgtgcttgacatccaatgactggtgatgttgtaagagaaagacggagggagatgtaagatatgagagaaggccacgccgagactggagtgatgtggccgtgagccgaggaatgcctggagccaccagaagctggcaaaggcagaaggagcctcctctggaccctgtggtgggtacgcagcctggcagatatattcattttggacttctggcctccagggctgtgagagaatacatttctgcagttttaagccacgcaatctgtgtccctgggaagcccaaatagggcgagaccttttgccaagtggtctccaagtgtcacgtcatcgaatccttctcccgggcttgtgccatagtctttccactttagagaggaggaaacggaggctctggggcacaaagccagtcagtggcggggcctgactttcaacccagcctgcatggggtcagagaacccactttccccgtgcggcggcctatgctaaggatgcttgttcatctctcctgggcccgggagtggttcttctggcctagaaggcaagagaagccagtctttcggtttcaaggtttcccattagtggagtcaagcaaaaatggtgtgttgcgcttcttcctgagctcagcctgggagcacggccttaacatgctcagtggatcccaagacggcagcatggcggtgcagcctggcagccttagctccttgcagctgtgcttgtgaagggagcagtgagtggcttccctctgtgaccaccttgggtcctaagtttcactggggctgggatccatgcgtcttgcaattggctaggaatttcccgggctttccctcccttccctgttcagggcactgggtgtgaggcattgcatccgttcttctgctcacctgcttccccctaagagtgtgagctgtataaaggcaggaaccaaacaggagcctccacgtgttcccagttcaagggcagtgtcccttgtgtgtttcttcaataattcagtggatgacttattctgcacggacactgcacacactcggccctgccgtctccggagctgggaggtgtggagctggctcctgacctatttacacactgaggagggatgtggaaaacaggaggagtcccagggctccaatgcaaagaggagcctcttcattccctctgccgtggccgtgcaagggacagcgccttgtgggattgtgtcctccacccaattatccttagcattagtttgctaaggataatggcctccagctccacccatgtccctgcaaaggacatgatctcattcctttctgtgtctgcatagtattccatggtgtatatgtaccgcgttttctttatcgagtctatcattgatgggcgcttcagttgattccatgtctttgctactgtgactcgtgctgcaatgagcattcgcgtgcatgcctttatggtggaattatttctattcctttgggtgcatacccagtcatgggattgctgggtcaaatggcatttctgcctctaggtctttaaggaattgccacgctgtcttccacaatgcaagcaagacgttattgaaagtgtaaagggggctgctaattacgctggggcaggcggggcaaaccaggaccctgccaggcgagtctaggccatggccccacaccagaagatgagggctggagactcctggagaggaatctgagtggcgagaccacctgcattcattatgtgtcaactctgccaggtgacagtccccagtgagcccatcaaacatgaacctaggtgctgttgggaaggtctttggatgccattaacatctacaatcagttggttttcagtagaggagattatcctcaagaatgtgggcgggcctcatccagtgagctgaaaggccttgagagcagaactaggattttggaggaggatgaagtgttgcctccggaccgcagcgtcacctcttgcctgggaatttccagcttccttttcagacttcggacttgcctccaagctccctgaatcttttcatatatttatgtcctattgcagattgtgtttctctggctggactgtaactgatgaggaggactgaaattccaggcttggttgtatagcatataagtgaggtcatttgggtctggggagctggggggggggtccttcagctgcatgagtgtgacctgcaccaaggtgcctggctacctggggcgagggggctgccatctagcccacaccccactcctaggccgtgcaccctggcatgggtctatgtctggctcaaggaagggttccctcctccctccaatgtgcacagagaccttgagatcccatccacctaaccctgtgccctcagaagcctcctctgagagggggcaccttttcctaattctcacaaaggctagtggctaccttgtagatagccttggatgtgttaggacacttttctgaacatcagttccttatctgtaagatgggagttgtgtcctcaatgggtaattagagattattcatgggaaatcctatcacggtatctaccacggggagactcacaagtgctgatctttgctggtgttgctgcatttgttattgaatgcattcgttaggagtcttgttagtaagtgacaaaaatccaactcaaattggcttacactaaacaagtttcctgcatctgggagtataaagggtgacgctttggcagaggctggctctggaaaacgaggacgcacatttgtgcccccactttcctctgtgcggcgtccttctcttcaaggcttcccccagtttggcaaacacggccccagcaatgtcaagctgagagcaccttttaagaaagacccttccttccatgtgttttggcaaaagtcccatgaagcagtatgagtggcccggtttgggtcatgggctcacccctaaaccagccgctctggatggattagttccaattggacaggccatggtcttggactctttgggtgagtgtgggagggtgtgggagggaagattcattgaacctcatctctactacatggtacagctccctggaagaaagaggggctccattaccagaaggaaacaaggaattttatggggaaccacattatcactaccacaatctaccatgctatacataagaaatgcaccttggtcttaatgcacggtcttgagggggtgcaagctgaatccaattcccagcgtctgggtcagtgtccctcatgggggagctgcctcacttaagattcctttggataggtaaggtagaacaccaagctgcgcgggattatgaaaagaaagggagaaattcactggctcgcagaattgaaaagctgagatccagctgtacttttaagcctgagccattctccagctcctggccctgcctctcgctgtcttggcttcacccttcacagactgccctgcaaggaccgaggtggagtctcattggactggctcaggtcgtgtgcctagttctgaaccatccactgtttccagagggatggggtatcctgattagccaggaagaagtcagacgtctctgagctaactttactgagaattgggtagaggaggtccccaaaagtaaagttgggcactgcagttcaggagaagggtgatcactggttgctaagcaaccataaagtagccagcatctcctgtgggttggggtttgcgcctgtgaatggacaagtggcactcggaaattaaatgcagtgcatccagtgctcaagctcctgggcttcgtctgctccacactttttcctctgccctttgggctaaagccgttgggtttgggacaagagaaggggagagctggtacctcttcctttttttgcccaggaaaagttgtttctccatcatttcatggctcaaagtcattaaatctgagtaattcttacaaaccagatccaggaagaatctaggagtgggctctctgtagattagaatgcttcaggctgcaggtaacagaagacttgactggaaatgccttcaacagagaagggatgtatcattttctagaaggagaaattctgcagctgggacggttccagggttggtttctttggaaactcagaacttcatcgaggctctggattcatttcttctttctgctgtgccatttccagcctgttgacttggcctgggccagctgtcctctcacgctcatgattgctgcctctgctcctgccatcacatacacaagcagtgcctgttcagtggaacaaaaggaaatcaaaaagaggaatcacattgtcctgtgtctctacaatgtttttttttttttaaatcatgaaaaccgttcccagaaaccccacaacagactttctgtttcatctcattggccagaacagtatcacaggagactactgggattggcatagactagctaggatgcacccttagagcccgtggaggacggcagacatctgagcagagctgggcctcagcgggcaggggatgacagggactggcaggcatccttttggtcactcagaggacttccttcaatccacccagggctggttggcatcataaactcaggatggcagcacttggatggctgtggttgctttgtctccagtgagtgccccaggaaaccatctcttctggtcgccacacggctatttggtgagctgcttgctggggtgagctgctgctgaatgggtgtggttgaaactggaagggtgaggtcccaaagccactgtctgcccctgggtgactgcaacaggtagcccccccaccaacttccaggcaaatccgtgggaaatggaacaaggtatcaaggggaacaggggagtcaggccaccagggccccactgaggaaggcacctgttgcaccatattttgacgtcttgaatgtgtatccactggcccagggagtggcttaattaccagtgtaatagcaggtccacttacagcttcaggtttcgtagaggaaaaagcatcattgcaaaatgcttttgatgtggttaagcggtgaggccacagtgaattttaagtgcttggtaaagcgcatggaaaaagaaaagcacaagtcatacttggtaaaggacatttcccttcctagatgccaggtgtgaaaggatgccaggaatattctctgctctttcctcctgcttcctgaaggactgagtccacactaactattatcaaacaaacaaacttccaggggaaaagactgcagaacctatacattctttataattggaatcacagctatacattctttataatcagaataacagctctacattctttatcatcgcagctatacgttctttataatcagaaagtgctttctggccaggcacggtggctcatgcctgtaatcccagaactttgggaggccaagccaggtggatcaccagagtttaggagttcgagaccctctggccaacatggcaaaaccccgtctctactaaaaatacaaaaaaaaaaaaaaaaagcccagtgtggtagcaggcgccggtaatcccagctactcaggaggctgaggcaggagaatcgcttgaactcaggaggcggaggttgccgtgagccaagatcacatcactgcattctaacctgggcaacaacagtgagactccatctcaaaaaaagagaaaagtgctttctgctgtcttactgaggtccctgctgctctgctaactccttctcaagctgagaggtaaagcaggtgctttacttctgtgtggtcatgtgttgggtgcctgctacatcaaaacgctcttccatatgcagagaaaatcagaaggaagggagcactgagtggctagtgggcaaaggggagagacagcgagaccaacacatgccacagagctgccttttatatgaattcaaattctgggatttcggactagggcaatatgacaaatattcatggactttcactagaccaaaattggaataaatgctacacacaccccaatttttaaaattagtaaaaacatgtgactttaaagcaggctgcctacgttgataataaaccacattttccctaacgtgaaaagtcagtgccattcgagcttgtcgacagaaatacagaacaattcctcagtgatgtgtgcttctttgcaaaaatcagccttgaattatgcaggtttgaaataggcaaaatcttcctaaacaaatactttgcatacaatacctccaacctctattccagtataatgtttaaactctgtgctagatgtccacttagttctttcattgatgtgaagctatttcattaggagtcagcaactatgccctgtgatctgacccaatgcctgtttttgtaaataaagttttattggcacacagccacacccattcatttacaattcgcagatggtcactttctcactccaatggagtggtggccacagaaaccgtctggcccagatgtctaaaacatttattatctggatctttataggaaatgtttgctggctttagagcgaggagtttcatcactaggataagcgactccattttcttttacctatggagatttctcagccttgctgcaccttattgctataactctgtgacatattggtggcctctacgccacctctcagctgtctggcctgagagctctgtccagacggattgacagaggccagtacctggtgaagaaggcagcatctgagaggagccagggatgcattcattcaccctttcattcagtcattcagcgagggtgcagcacgcatcagctctgtgcaggcactgtgttaggaactgcagatacagccacggccagtagaaagggcacctgttctccttttgtttgtttttgtttttgtttttgagacagagcctcactctgtctcccaggctggagtgcagtggcacaatctaggctcactgcaacctccgcctcccaggttcaagcagttctcccaccccaacctcccaaaggctgggattacaggcatgaatcatcgcgctcagctggcacctgttctcactaggatagatatcatagcgggggagacgttggatggacaaattggcaagggggataagttcaggcactgccgtgtgctgtggagataataaaaggaaagtgggacagacagtggggcgtggggaggctgcctgcttagctgaggcggtcagggctggctctgaggaggtgacgcatccctgagagctgaaggaggagagcaaggcagccaggcaaaggtctggccgtgaggctctgactgtgccttcgtgctgttgttctttgtcgatgcactcacccaggaagcacttgtaccccgtcatggcgctagaatattaacaaatcatggtccctgtcaccatgcaggaattcagagttggcctaacagaatgcttagatttcttgggtttgaatcctggcttcactgctcaggagctgtgtgactgtagacaagttgatgagcctctctgagtcttggtttccttaacagcaaaagggggataataattgtagctgcgttataaggttgttatgaggactctgtgaacaacagcacgtaaaggctataataccccaccacatacacaggttttgcaccacagcccacagggggcagttcacgtagacctcagaggtacagtgacagtgcagagcacgcgctcagataaccctgactcagaggcgtagagggagtgcatgtgagccaagcccaggactgcacagcaggtgttccagtggaaggtctagaacgcaaggggggattcgttttgctgtgtggggcaggaaaaggttatttgggaagaactcccagaagaggcaacatttaacagtctgtagataggtggttaggaattcctcagcctgagcaaaggtggtgggggtgccaggtgagggaacggtatgcacaaaggcgcggtgtcttgaagcttcgtggcacccctagggagggaagaggatctgcaggggtgccattggtgtgtggcaagatcagatgcgggtcccaaagattacactggtagctttgggaggagaggaggtgaaggtggagagaaggccgagaagccacgtgggtatcactgaaacagttctggccaacaagggtgatggcaacgactttggaaatgaagaaagaaaagaatgatgaagaaaaaaagatgcatcaatccagtcgggccagccctgctcagagcctgctgcaaacagccctgtttgtgttggctggtctgtgcctctattggtcagggtaactcacctgcatttagcttgaagcaagaacctaaggccaagtccttttttctgacctctaatgcaaatgccccatatagatgtagcattttctgactttccttagaagctagaatgatgctgggcccaaatctgtacccttggatgtttcgaactctcagccatgggcccttcaccaaaactgtaatgttaatcaacttcgcacttccaacatccctctcctttaagacccccactaatcagcgagttctcccagcatggccagaagtcccaggcattcaagggacatttgaaaatgttctccacctggtaggtgagattcaggtttggtgaatggagttctggtgtgagccgggtgccccgcctgctggatctgatggtatctctggctggcctgtgtgatggccccggcagtcgctcagcacctgaaatgtggccggcccaaatggagatgcgaggcggggagaaacagtaatcttcatatggatcctgcattgaaatgagcatcgtttggatcatcgagttaaataaaatgttatcacaattcattttacatgcttctctttactttttttttttttttttttttgaaacagagtctcactctgtcgcccaggctggagtgcagtggcaccatctcggctcactgcaagctccgcctcccgggttcatgccatcctcctgcctcagactcccgagtacctgggactacaggcgcccgccaccatgcccggctaatttttttgtatttttagtagagacggggtttcactgtgttagccaggatggtctcgatctcctgacctcatgatccgcccgcctcagcctcccaaagtgctgggattataggcgtgagccaccgcttccggccgcttctctttactttttaaaagtagctaccagaaaatttaaaatcacatttgtggttcacattatatttctagtagactgtgctgatctagataaatggtccatattctttttttctttttctttgagatggagtctcactctgtagcccaagctagagtgcagtggcgcaatctcggctcactgcaacctctgcctcccgggctcaagtgattctcatgcctcatcctcccgagtagctggtattacaggcgcacaccaccatgcgcacccaattttttgtattttagtagagacggggtttcaccgtgttacccagagtggactcgaactcctgagctcaggccatcagcctcccaaagtgctgggattacagacatgagccactgtgcccggccccatattcatttctttaggactgaatctactccacacctgctgcatttggactgtgcagtgttttaaagacatttgaatctgtcagtgaactttaaaacatcgtcatatttcacatgaaaaccagagctttcagcttctcaaaaaatatccttctgggcataggtctggctcaggcgagtagccaccgtgtgctgtagacaggacatctgctgggatccagttcttcatgagccccgttctactgtcccgaccgtccttctgtggctggcacggctgcctggtagagagcaggtgatgtctgatccagacaccagacttgggaggaaacttcccggttcatccagaataacccctgcttctgggttagacaacgagacaagagagtctggatgctagcccaattacagaactgagaaagtgaagtctcttggcctcagtttccctgtgtgcaaggagcataattatatgtacagtcaggagttgttcagcctaatgactgcttgcgaacgcccgtgagatgactcgattaggacctctggaaagggttctcaccgggacttggcctttggttctcgctccaagctaaatgcaggtgagtcaccctggctgatggaggcacggatcggccaacacaaacaggcctgtttgcagcaggctccgagcagggttggccccactggattgacacagggctgtgtggctcgtctatgtctctaaaccatgaaagcgttttccctgcaggtgccccggcccagggtagctgagggtgctgcagagaagggcgccgcctctagcttctgatgtctaacgcaaatgctccatatacatgtggtgttttctgactttccttagaagcaatgatgatgccgggcccaaatctccacccttggatgtttaaaactcactcagccatgggcacttcaccaaaacagtagtagtaatgataataaacttcccacttccaacatccctctcctttgaaatcccactaagcagcgaggtctcccagcatggccagatgaccagacaaggcttatcacacccagaaccacttagcaccttccagagggaacggagccctagctggattgaagctgcaggggaaagggcgggagatcccacgctgatgttcccaggcccaggcaggcagctccgatttgctggtcttgcccccagatcctgttccatttgaaagatgacgcaggaaggagacaagatcactcccttctccagggcgctgcttgggtgaagcctgggctgtcctgtgggtgttctttgtttctgtctggagaagacaggaccgtgtaccacgggtgagggtgctttccaactctgcagagactggcattctaacacaaagcatgcccctcttaccacagcactgcaaggctggcaccacctgcagcagacagcgccttgacaggggaccgaggggccctttcttaccgtggaggacattacagtagtcgcgggatttgcacggatagagggagggaggtgtctgggtaagccgtggaggtcctccttcctcactgccgtgcccccgaggacacacaggaaatggctctgctgacccctgggccaatattaaagctgggaacaagaaggcaggactctagggctcaggtgagctcacctagaacagcttatacaacaggtccctgctcaggtccttccaaagccacctgtggcaaagcagtggatgatggctgtaaccatgggtggagggtggcgtgagttagtgccgccactatatgtcatgaaaagcctgtcctaggacaccaggatagaggagattctgcttccagcccggtgaagctccccactgagctcccagccctgccctctctctggaaccagccttggctgcatctgccctgacccccatcttcccttgaacttctgtgatctgcatcccagggtcaggcggtggagtgtggcctgacttttctgttccgtttgacttggacatcggaagacattgcctctttaaagacacaaaatatctctcttctttttttggtggggagagggagtggtctgcatctctctgtggagtctagagcagggttgggtagagatgcagcccagggatgaaagacagatggcctgggcgtgcaggcactggctgcctctcttgtcatttatgttagttatggtgacaccaattatgacccagcacttaccggtgttctcattatataaccctacccgcgcttcccaggggttgatcctgtcattaatgctcccatttcacagttcggaaaactgaggccagagaggtcaagcagcctgcccagggtcccagaggcagggcggagccggtcagcagcctgtgcccactgcttcagggccgggttccttgctatgtctctggctcttagtgtgaaggaaaaaacccttgacgagagcagtttgaagtttggcttctgagctgttgtaagttaaaaaaagaacaagggcggtttgccgtggggtagctgaggaagctgatgacctagtcccttttataatgctgccttgagacacacacacacaaaacacaaaaacactgacttccttctgatcacagaattaatacactcattatataaaatgtataacacacaaaatacgcatacatagagagagtgaaaatctcataggggcccgccacccagactctgtgccctgtgactctgtgtgcctcttctggttttttttctgaaagcctgagcaccccgattatatataatttcctaagtgtgatcttactgtacatacctttccatggcctactttatttttcaagtaagatttcatgagcatctttgcccagcagggaacattctttaaaaaggtcattgtggtggctcgtcgacgttccattgggtcagaatttttaatgaatcccccaatgttactggacatttagatttttccagttatttccaatttatttttacttctcaatgtcattttcaatctttaatacaatataacatgttagaaaagccatctagctttgatttggttttccaaaaatgcttggtgattggagttcctggccctagagccggaggttggatgtggtgtctggtttgtggcacgcacaaagcgaagcttaatcctcgtttcagttctgggttcagagtgcaagctgactgcttatccagttttggggttgggctcggaaggtgggaggaggtaggccgcacgccaccccagtcccctggcctgatggacaggtttccagagtgaagggaggtgccagagaggcggagacactctcccaaggacacacagcagtgatgcccagaagggagctggagccccacggcctacaccctggtctggggctgtggctgtggcgtgcacgtccttgtccctttgaaagttcgaagtcaggcttgtgccatattttttgcaatccatgacctgtgagtcagcccttctctgacttgcgtatttggagagacgtcagcaagccacggcccccagcacaggcctcaggagctgtgcatattggtttgcacagtgtctctttccatcttcagcaaacgcctttcactgtttatccttgccacagagggaaaaacgtttctgcaggcagctgcttcatgtttcccattcactctaccaccgggaaaatgccgcttgaaacacctgtgatgacaatttctctcctaagactctttccatcttttacaacgacagaggcgtgttatggcctgagtttaccataaacacaactggaaacaatatgacagcctgtggggacgtgggggaggcgagggggggtgtctgcggaaaatacagggacagatgtgtttcctctcgcatggactctgagaccacagtgccgctgcgaaacccctttttccagggccccttggattacaagacagtgtgctgctggaaacatctcttcccacagtcatcagttaacctgggctgggttaagtgaggcaggagggctttggaaaaggggccggaagaaccttctgggtggtccgccttgcgagggtggggctggggcaccagggaggtgtcaagagtccggttcccatccctcccacccacgagaaacttctcaggaaggaggacgtcgctcctggcaggagggcgtgctcggcggtcctgatggtggaggccctgccggggccacagggtcagtggaagccgaggcattccacactctgctagtttagaaccacaggcaatgagacccaaagacctgaccactcaagcccttccattgctctacaaccctggcaaaggaagtggcctctctgagtctcccatctctcaccggagaacgtcagtgtgtggcagtcagttttatgtgggcaggcttagcgtacctggagacgaacccaagcagtcatctcagggttgctgggcaggtgttttggggatgtggccgatgcctacagccaataaaggagcttgcccctgagcatgtgggagcacatcacgcagcccacagaaggccttccgaggggaagcaggtttcccgaaggaggagaaattctgcctcgtagaaatcctgcctgaggctccagccgccagcctgccttatagattttggatttgccagcagccacaatcgtgtgagcgaaggccttcaaacaaacccttctgtatcgaccaactggccatacccgtatttacaccgatatccccagcgtcatctatgtttgccttctgccggccgcatctccgcacagccttcatggacgcactgagttagccactagagcttaacgagtcatctacgtaacgcaccccgccccatgtccagtcacagaggacaccttgggtcatgacagtgacaaggtcgactgtgctcagccaggttcgttctcggagttcacgtgaccacacatggagccccccccctccccagatgccaatgtaacgttcagacgctgagcatggaccctcgctgccccctctgcccgcgggcgcttgccgccgctctgccctgcgcctggccggctgcacaccagcggaatttattttatcttgatgagcctgaaataaactctccattaggaaaattgtacatttctggcaatttaagacagagaaaaagagaaagagagagagtgtgtgtgcaaaagcttgacttgcacttcagacaactgtaaaaaaaatcgattcccggagcgtgtgtggggagcttggggaaggagccccattgaactaggtctttggatgaaaattgtcctggtgacatgctccaggtaaaatagaaaaagcccgtttattttcttctttaacaatcacgctggattctgaaattaagctctggggcaagaagatctcaaaagatatcccttggccagatgcagtggctcacacctgtaatcccccagcactttgggaggctgaggcaggcagatcacttaaacccaggagttcgagaccagcctgggcaacatggcaaaaaaacccgtctctacaaaaaatactaaaaatagccaggtatggtggtgcacccctgtagtcccagctactctggaggctgagatgggtggatcactggaacccgggaggttgaggctgcagtgagccatgattgtgccactgcactccagctttggtgacagagcaagaccctgtcttaaaaaaaaaaaaaaaaagaaaagcaagcaaagagatcccgtgttcacgtgtcattagctactgttatcgatgggtacctaagcctctctgttcacctccccctccttttttacctccccatctctgttttcacttctcatctttatgctcaaactaggtatgattcacagccaagctgactctccactgtctggctttcagacaaatctttggttatattctcaccctcttctccaagacccaggagccacctccccctttccacctggctatcatcccattcccggatctgcaccccagcatccaagcactggggctgcccctggcctccaagcagcttcacccctgaagctgcacgcggccaagtccgagcccgagcctacttattctccatttcatgcaacaaatttctggagacctggagcctttgaatcacccacagaaaacacctttctgactcaattcttctgaaatgccccaggactggcaaccgagccagtgtaagctggtttctgtagcgggtgtgcccatacgctttcagaagtggctcactgtgcacccagggaaggccaggctcagaaagtaaacacaccgtgtttcttttaggtttaaatgcgcattttgaaacacggagactgtcctgttttgtttaattgttattcagtcgtttgtgctgccaggaggtcaaatacagttcttaccacccgggaagctgtctgggcgcagctgctctctggttcaggagctgtttaactgcacaatgacatgcaagacgtgggcattgcatggacctgcctccaggcgttttgctgcaggtgagccgctgggcttgtagctgcttgcagatctctgccagcgagagatttagtgcttccaacaacatacgaaaactggcccaaaggctttcgccgaaataaaagacggctgtttaccacggtttggacagtatttgtttgcagatgtctgcgaactgtcnctgcagagcccgccatcatttcagttcatgcagagaaaccgctctcattttatttactagatgtattagtttcctgggactgttgtaactgagacccacaagctgggtggctcaaaacaagcaacatttattcttgcacaattctggaggttaaaagaagtccgaaatcacggtattggcagggccaggctctctctggaggcgcaggggagctcctgcctcgcctcctcctagtttctgctggttgtggcaaccctgggtttgtggccacattgctcccatctccgcctctgtctccacgtggagtctctgtgtctcttctcttatgatgacatcggtcgtactggagtgggcccagcctgctccagtatgatttcatcttaacaattacatctgcaatgaccttgtcttcagacacagtcacattctgaagtcctgtgtttctaggacctccactgatctttttgggggatgcagttcaacccacaatagtaatccatgttttattccatgacttaaaaacataagctccttggtcaaactagaaaagcagacaaagaatatggaaagtcagacactgagagtgggggggtcacaggcaccaatgcccgtcggggcccagctgggagcatgaaggagggttgagtcctgggttaaaaacacccacccagcacatccagcttgggttgtgcctgggatagagttgtacgtgcaagaaacgccccagtcttccctaactccactatgaggagacatttcagagaaagtgcaagtgtgtgggaaaagttggcagacttcggctctcaggaacggagtatgagggagcggtgaggtctgtggcaaactggactgtccaggcctcctctaaggggcagccccagggaatcccagccagttactcccatggaagagggtggccagcagagccttgaggccttgactcctcaagggaagctggacaactgggcgtgggagtgaaatgacctgatttgtacgtcttggtaacaaaacaggatttgttaagaacttagggtagacagaggcatctgtaggcagagctgaacctctgagtgtcattttgttttttctgactcgtagaaaggggaaactgaggatgacctggcggggggattgtggaatgccttctgtggcaggcttagccgtggactccaagacatccaggccctaatctctgaaacctgtgaccatgtcaccttctacagcaaaagagactttgctgatgtgattcacacagcttcacgtacctctatgtacatgtcaggcacacagatacacatgaacataaacagatacagaagcgcacatacacatgcccacacatacacacatatcacccaaatacagatatacacatgtgcacacacacatgcacacatgtacacacacatcacccaaatacagacatgtaaacacgcacacacatatgcacacacacataggcacatacacacatgcatgcacatacacacatcacccaaatacagacatacaagcatgtacacacacatacaggcatgcacatggatacacatcacacaatgcacatacatgttcatgcatatacaaccacacatgtatacaccacacacatatgacaatctgcatacccatctgcacacatgcacacagattcacacatgtataatacatcatacacatatacactgcacatacacatatcacaaatatacacacactacacataaacacacacgcacatatatgtacacagatacacatgcacatatgcacctacacatatcatacacatacatacacatgcatgtgcacaatcacagggttaagctccacacatgtacacacatatacacgtgcacacatacacacctgtgcacacaggcacacacaatttacctacatataatacacagcacacacacttgcactgcccatacatatatcacaaatatacacacatacacaggatgcgcatacacacacagatacacacatatgtgcatgcacacatcacacacatgcaaatgcatacccatgcatgcataaccatacatgtgtgcaccacacgtgtacacacataaacacggacatctgtacacacatgcacacacactgaataacaaacatataatacacagcacacacacacacgcacacatgcacacatcacacacacacaccacaccccccgggccccaggcctgcatcagcagggatatgctggggagtgctgtcggtgtgcctggtcccaggcttggggggtgcatgctgcagaactccgcctgccctgaccgccctgtgcttctgcagcagggatagctgggtagtggcggggcaccccatcggccttggcaccaagagggagttctctgcatgaggagtgggctggggaccgttgcttgcagaaacaggaggacctggtggctctcacctgggcagagggcgcagaaccggagaactttgccagtacctcacccaggcagagggagcagaacccgataactttgccaggacccagctgcagctaggtcttctcctccgaatgttcctcctacttgttcttctgcgtctttcaggtcccaggggaacgcttatcttgttcatctgcttattttttttaacctttgcaggatcccttttaatgtgttttaaagagcaagcctgcatttcctgcctggcccgggtcaagagcccaattctccggggcgcctcgtggtgctggggagggaggagctggccccacgggaagagtgtgtgtcctggggctgccggcctcacgcaacaggagcctctcctctcaccgctctgaaggcttcaagtccaaagtcaaggtgtgggcagagaggcttcttgtgcaggctccatgggagcatctgtcccaggcctctgtgcagctgtggtgtgtggtgtaccggcagcccttggcgctcctagctgtggtgtgccggcagccgtcggtgttcctcggcttgtggaagcatgattccactgcagtctccgcctgtgcctccgtgtcgccctcctgtgtgtctctgtgtctgctctcctccttcccagaaggactctctccctggatttcatgcccagcctactccagtgcgcgctcttttccgtccttaccttcatgacatctgcagtgtccccatttccagatgaggttacattcggaggagggcatgacttttgggtgaacactattcaatgctccacaaagagcattccaggaagtgtggcaggggctcgatggttcaggggtgctgtggtctaaggtccatgctcttccctggtcttggcttctgtaaatgcctggcttccatctcacccctccccgtggggtccagagcacagactccggcgagaagttgcctgagttcaaatcctggctctgacgtttcctaacacggggacctcggagatgagctgtgcctcggtttccccatctgtaagcatgaggagaatggcgaccgcctggacctcacgggcttgctgtgagcctgggatcagcctgtacacatgaagggctcccagcagagcctggcagagtctcactcaggtgcccacttccttttcctctgactctgggcaagttgcttgtctgcagtaagcctcagcttctctgcggtaaaatgagcctaacaataccctttcacaggggcactgtaagatcaaagggatcatttctaagtggctggctcccagtcgaggcgctcagtaaaggtcagccattattacccgtatataatgagttcctatttctgctgtaacaaatcaccaagccaagggttaaaacaacacagatgactcaccttacagtcccggaggtcaggagtctgaaacaggtctcacggagctaaactcaggtgtcaccagggctttgtccccagggaggctccagggtgcggggggaaatccatttcctttcctcttccagcttccagaggtgcccacgttcctgactcccgccctccatccctccgacctccgcttccctggtcgcctctcctcctctgcctccagccctcctgcctccctcttctaagggccctggggatgacattggtcccacacagaatacccaggaaaatctctccagctcatttgcgagtccctgtaaccctgtaaggtgacacagtcgcaggtttcagggatgagggtgtggacatctttggggagacccttaatccacctctcacgatccccaacagagtcttcaaagagcactgtccctctgctgtgtcaaacagaatgaataggcccaccaagagctgctctctgcctgcacagacggcagccgcagatcgtgcctgcctcctgttcaaagccacccatgttctgggaaggaggaaggagcactcactcgctcatttggccggtcctgctgagacagccctggctctgcccagggtgctcgctctgccttgcccagtggcttcaggggtccctggtcagcagctggacccctccccgctggctggcctcagtacccacacacagcaccatctgtgctccaatcccactagtctgtgggttacacccatgcaccccgtaagcactttttgtgtaaactattaataaactctttaaaagctcccagatggcatcacatagacgcattatgggtgctcagccagtcgggctgaatatatgaatgaataaaaataaaggacaatggaagaagtcacctggctctatgtttcctcttcctggcagaggaaacgtaactcacacaggactaggggaggtctgtggattctaagcactcctgctgcttctaagtggaagtctggagtccagggaagacatcaaaagtcactctaaggaagctgaaacacagggtatccagtccaggggcttggagacacggtgatggacagtgagaaaacaggcaggcttggttcagcgcctggagacaggcagaagcagggagctccacctcccatgggctggagggacatcgggaggagctatgtcacctgacttgggcccatccgagctagagccaagcacggccacctggacaggagcaggaaccctggaagacgcctgtcccatgaggaaaagctgcctccgcagagcagagagagaaggagagacaccggcttctccctgctcctggcctccagatttctgctgccagggcctcctttgtttgaccccacctagcagccagacagtgagggaggcaagaagggtggtttcctttcatgcccagcaggcccagagagtgtggagtggactcgagaatgaacaaaccgctccaattttgctggggaggatccaaaaaacctttagaatgccctccacccccaccccctcacagatgggtggggttgtgggtgtgggcacagatggtgccagggagatggcatctgtctagagtacaggaagaaggtgccaagggttttcaggatttgggggcactcctgttcttttgctaactttatctggatttctctctgaggaacctaaagttctttgcacgtatccctcatttaatccatggaacagccaaatgatgcccattttacagactgagaaactgac

SEQ ID NO: 706 - DNA, 190849 bp, Homo sapiens
  misc_feature (1)...(190849): n = A,T,C or G
cgacatagttcatcaaagttgcagtgagcaagatcatgccactgcgctccagcccgcggtgacagaataagaccctgtctcaaaaacagaacaaagactaaaacgttttggaactagacagaggtgatgattgcacaacattatgaatgtactaaatgccacagaattgtccagtttaaaatggttaattttatgttatgtgaatttcatctcaatttctctaaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagattgcggcattgcactccagcctgagcaacaggagcaagactccatctcaaaaaaaaaaaaaacctgagagaagccccttggtcccagcctttctctgacagcagtggtgacaggctcagctctcctccgagtgcagccctgtcactggccttgctcctgtctcagggctgggaagactgttgatgttgtcattccaaagatcccacctggatcaggggaacatcccccacagaagggttagccatacagtgccagattctccaggagaaattcaccaaagaaatggagtccccttggggacagattcaacttgtattgtcagccaggagctgacgtggcacttctgagaagaggccggcgcacctgctggcgggtgctttgtgcacttttcagacaggtcaggatccagcctgtaggcaaatttacttttgctttgacctgtaaaaccggatctgcccagccttcattctttccctggagaacgcctgcggccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcgtgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggcggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaatatatatatatatatatacacacacacacacacagacacacacacacaatacatatatatatgtgtgtgtatatatatatataacatggttatgtgagtatttgtatgtattttattaacagtaatgttatcattgtttttcagacctgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgctggcatctcggtgtcctggggcagatgtaagcgagtcccacaaacagtggcttgcaactacaggacttgattctctcacagttctcacagttctagaggccacaacctaaaatccaggcatcagcagggctgtgctcgctctgaaggctctggagagagtccttacttgtctctcctggcttctggtagcccacggtgttccttggcttgtggatgcatcactccagtctctgcctctcctgtcatgaggccttctgccttgtacgtgtctctgtgtcttttcttcttgtaaggatatcagtcactgaatttagggcccaccctactctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccatctctactaaaaaaaatacaaaaattagctgggcatggcggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgtaattgtgggatctgctgtccttttgaaccctctggctcactgagtaaagcagatatttgaatttttcttttctagcagttagatttgtgttattccatctctactgtcacacacttcttgtggaaacctcaagcttaggtcagagccctaaaacggaaagacctcaggacgcctatcccccaacctcgggcagcaccaggccctgcctgtgtctcccaggcctggcccatggcgtggaagttgtgggccagatagagcatggagctagggtgcgggccgaggctcctgatggatccctggagaacatggggcagcagatggtatgtcttgacggttcttcaccaaccatccatcccctgctcatgcgtgtgtgctctctcgcgtgctcgctctctctctctctcatatatgtatatgtatatatgtgtatatatatatatatatagccattatatatatagccattatatatatatatatttttttttcttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattgtccagggtggtctcgagctcctcacctcaagtgatccacctgcctcggcctcccaaagtgccggaattacaggtgtgagccaccgcacccagccatatatttttaaatggtcttactgagatgcaattcacatgccataccgttcacgcatttgaagtgcagaattcatagttttcactatattcacagataagtgcaggcttcaccacagtcgattttagcaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccgtcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgaacgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaatccctgtctgttgtctcatagcatgtgctagaactttccttcctacccttttacgacaaccagtaaatccactattccggctcactgtgctcagaaaaggtccatgggatggtctgtttctggcacttatgcacattttcccctacttctttatttatttattttatttttgaggcagagtctcactctgtcgcccaggctggagcgcagtggtgcaatctcggctcattgcaacctctgcctcccgggttcaagcgattctcctgcctcagcctcccgagtagctgggattacaggtgcatgccaccatgcccggctaatttttgtatttttagtagagacagggtttcaccacattggccagccaggctggtctcgaactcctgacctcaaatgatccacctgccttagcctctcaaagtgattggattacaggtgtgcgccaccacacctggcctatttattttttttattacccaggctggagtgcagtggcgcaatcactgctcactgcagtctccacctcctgggcttaagcgatcctcctacctcagcctcccatagtgctgggattacaagcatgagccactgcacccagctgcctactttttaaagcctaataatttgtcattagcttgtcttcctgcacagttcacaggacactttttctctagtgacatcttacctgtgcctccattttgacataaaattacaattctatgctgtgggtaacacaatttttggtaacatggaagtggcttcctctcccttccctgtttgcttcccaaaagtctccaaccaaaagcagcagcacgcatacctagctccgcacaggttcgaaatgttcatgaagctatttccagctgcagcttcacaccaactaaatgtttgtgtttttttgtttttgagacagagtcttgccctattgcccaggctggagtgcagtggcatgatctcggctcactgcaacctctgcctcctgggttcaagcaattctcctgcctcagcctcccaagtagctgggattacaggcatctgccaccacacccagctaatttttgtatttttagtagagacagaggttcaccatgttggccaggctggtctggaactcctgacctcatgatccaccgcctcagcctcccaaagtgctgggattacaggcgtgagccactgcacccagccacacaccagctgaattctgcatcaggtattcagaatccccctagaggaagcagtttgcccttcgcctctgccatgaattcacttccaagtactgagaggaaccattattttacaaatactctgcttctgctggataaatggccaacctgggcttttcttgcttttggaaaaaaaaaaaaaaaaagtttaccaactccctttattgaagctctggttcatgctgccttttaaaaaaaaatgcttgttgcctgtaatcccaggactttgggaggccaaggtggatcatttaagcgtaggcattcaagaccagcccagtcaatatggtgagaccctatctctacaaaaaattaaattagccgggtgtggcggtatatatctgtagtcccagctacttgggtggctgaggccagaggatcacttgagcccaggaggttgaggctgcagtgagctatgatggtgccactgtactccagcctgggcaccaaagtgagaccctgtctgaaaaaattaaaagtgcttgcttaggcacatgggtcaaatgaagctggaatgtttaggaatggtgatatgggctgaatgtgtctaccaaaattcacattttggaaacttcatccccaaggcaaccttattgggaggtgaagccttggggaggtgactgagtcaggattgtgctgccctcatgaatggggttggtgccctatacgagggctagagagggagctcatcccccgtctgccttgccactgtctgccacgcgaggacaagtgttcctccctccaaaggatgcggcaccaaggcaccctcttggaagcagagagcagccctcaccagataccaaacctgccagcaccttgatcttgaacttcctggcctccagaaatgtgagaaatcaattattgttctttataaattacccagtcttaggtccctgtaacagcagcacaaaacagacttaagggcaatgggtgtgtttatgatcttgctcgtcaaggagtgatggtcactggctgtcttccgaagtgggggagatgctgtttagcctcttttctaaaacaaatgtgaaagcaagccagtgttggggtgaggggcgggtgtatttctagatgccatgaacaccagcaggaggctgggtgtggtgatgcgcgcctgtcatcccagcactttgggaggctgaggcaggaggattacttggtccaagagtttgagaccagcctgggcaacaggtagtgagacctcatccctacaaataatttaaaaattagccaggcatggtggtgcacatctgtagtcccagcaactcgggaggctgaggtgggaggactgcttgagtccaggagtttgagaccaggcctgggtaatatagtgagattctgtctctataaaaaatttaagaattatctgggtgtgggggctggtgtggtggtgggcccctgtggtcccagctactttggaacccaaagtggatggatcacttaagcctgagaggtggagattgcagtgagccgagactgccactgcactccaggctgggtgacagaacgagaccctgtctcaaaaaagaaaaccagaagggttttgctggcaaattctaacccttggacaactgacttaactttctggagcctcacctcacagacgatgatccataaaacgaggttaatccctacctcgtggggtaaagtgtcatgtggcataccaggccatagttcagtgtgactgagactgctcgggggctgcccacctgtctggcctccaccagaatcttgcaattacctgcctgcgaaagcagtgctgctcaaacttcagcacgcggacgagtcacctggggagcaggtttaagccaagcctgggtatctgcatttatttttttcttttaatttttgaaacagggtctcgccctgttgcccaggctggtgtgcagtggcatgatcacagctcactgcagccttgacctccagggttcacgtaatccccccacctcagcctcctgagtagctgtgggaccataggcatgcaccaccacactcaattaattttttaatttttttttttttttttagagatggggtcttgccatgttgtccaggctggtctcaaactcctaggctcaagcaatcctcccaccttggcctcccaaagtgctgggattgcaggtgtgagccaccgtgcccggccggcacctgcgtttctaacccactcacaggtgacactggcgctactggtctgggagccacactgagtagcaaggtcctaggacatgctctaaattagagatttgctgaatacattagccttgacttgggcatctgacctcgctgtcagcctgaggaaggaatacagacatcagggcaggcggcctaaataaacaatcaccaatacaaacctccccaagaggcccaggcttggcaccattttgctgtctgtttatttcaactgtacagagaagcttaaacacctgtggaaaaacacgaaaggcttagttttctcttaagttcatgtactttttagtgataaatacacagtatttaactttatacacctgataaaaggaaaatgcatagtagaaagggtcgggaatgaaacagaagcatcgggcattgaatcgatcacagagtagaaaagtctgcagtccccagaaactcggcctccagctggagaggggaaccagcgtaccctgaaacttccctagcaccttggaagcaagtggaggtcatggttcttccactcggcaacgtgaagctccccgctggaagacaagtgagagcgacaggccaggcctgtgtgtccacctgcacaggcattctccttgttccagaaaggctctgaggacggaagacctgcctctcaggaaaggccagaccagtagggagaggcctccgcagccccaagtgtcaacaaggggctcaataaggctttctgggagccactggcagctggtgggatggaagggggaggtggaaaagggcagaggaaatgggaagtggatggagggtttgtgcttccttcgaggccacaagtgcaggccacaggttgcttacaccaaattggtcccacagatgagctagcaatggaagaaattatgggcgtcctctttgcccactggaagagctgctcataacagcacctcctttcctgacagggctggcttttgaaaaatcaatgtgctccaagagtggcagctcaaatgctctgtgtttacagccatcttggcttatccttttcatgtggggcaggtcctttccacagctttctttggtgtttcttcattaaaagaaaaaaaaaagtcatcaatgtgggtctcccccaccccactgcccccacagctgggtgctgcctgattgctggcattccctggaagaaatcttagatggaaggttccgtggtggggagaaatggcattgtctgatgcagctgtgtaaacaagagaagccctgcagaagctctaagcactgctgccccctgggccagccaccaggccaggccagagcccacacaagcaggctgggcctaagactagggacccgctggctttaacctctgcaaggtgcttattgcaaactaaccaagccccaactggtgccagaaggggtggagctattgagtcctctccccataaacataaagccaggagggcaagaggaagtgctgggttacaaagacccagcaagcaggccagacgaccctctctagactacctgtcctttgctcttcaaaaccagcattccctaattctgaactgcttataagatagcaaaacaagtctggctaaactacagtcaagagcttaggatctatggaagccaagaaggcccagggctccatgaatgggctgggcaggggcacgaggccttgcctttgtctgagaagtcctcacaccacagctgatcagatggaaacaatggggaagcagagtttcccggtgccgtctttccccagcccagattccaccaagcgctggaaagcagagctgggaatctcccaaggcagagtccttccagctttcctccccctcaacttcacactcccctacctgtggctctggaaggagtcacacttgaacctcaaccaaacttcccaatatcagttggaagtcaaaaagatgaaccctttctttctggacttttagctacaaaggggaacttcctgtgccaagccctggtttcctcataccccaacgagtgctgtgggtttcaacagtcttctctaaaagggtgccccaaggttattgtgtggagtctagggaagctcagatcctcaggatgatcatttgtgtgttggtccagtgaaagcatttcccacctggccctccagaaactgggtatttcattgaccacaacaatcagctaggatttaaaatgaaaacaaaaccttagcagtctttagaatatacaggttatgaactagctaagctgctaatatatatacaggcgggcataggtttcattggctctaactgatcacatgcctgaagctgtgaaatatatcctggaagctctaaatagtttctgaactactgtgctctagagttcactctagttagagacttgaaaaatgtttttgtttaatcttaagccatgtaatgtacatggaagcataggatttcaccctgaagttttcgtaatttgacaaagagatttaccagagctcggtcagctatctcagaaacctgctttgagcaactgtcatgaagaaacacgttcagtctttcaggagaaatgtttccccaccacagctgctgaatacccttccaggcttggaaaatccccttccagcagcacttattaaatttcaagccctttctgttttcctgactacaattctacccataaaaaatttaaaaatccttcttacaaataagttgcatcaaagctccctgcagctactgagggccagccctgctctgactccttgagaccacggctctggaaggtgccatggtttccggtttgcactaggagccacatctagccccctactccctctcaaatgcagcaaccacctccatggcctcagaccgccggagttttctgctcgcctttccacagttgtcaaaccccacacacagtcacttggtatatctgacgtggttctgaaaatcacaatgaaggatttttggcataaaaacgttttaaaaagcaattgtcccaaaatgcacgtgggtttgggtctgcaactcctcacacccgcctgtccagccagccagcggccacggtcgacgtcatggagtcaagtccttttttttttttttttgtcccctttaaaacaacaaaggaaaaaacaaataaccagagatgacgatcgaggctctacacacgtgctgggtttccgtaggacatgctgctatggaaacgcggtgcagcagccccccagaggcgacgcggcgcgcatgcgaggtcgagcgatccaggcagctactcgggctccatggcctcctccggccgcagtggatgcatgcgtgcgggggagccgggggcgggggcccagcaactttccacgcagggactgcctctcacaagagcacttcctcctcccccacggggggcgggtcggtgccctggaggttgtcttcgctgccttgcttcctgctcaccgaacagaaaaccaacattaagactctgagaaatgccagcgaggccctgagccagctgctcccacatctgggccccctgcccaagtgggccgtcgcgcaccccctggaacgtgatctacgtaacccagtctttgagatcctctccccttttccttgctcacataaatttttcaaaggagactttgcacgcagcccctctgtaaatgaaagaccagcatcatttgccaaaaatagcaaggacccgtacaacagttccaaaactatgtaacaccaaaattcactgcacaaatcccaagtagaaggcaccccccaccccacggcgcctgtcataccaggtttttaggtacttcgatcccccacttaggctatgagcccttacagggaagggactgtgacgcttgtcctcagtcaccagatgttgagttccttgtgtgtgggggtgatcagagcctcccctgcctggcctggcacacagctggccctcaagaaagggcagatgacaactgctccagggatcctcccgcctcagccctcctgcagccagccctgagggaggagcacctcagacagaagaggaggccccttccctcttggaagtgggaggaggagagcccttgtttccctgaagagcccaggctggagccgccggtgtgacagcgtggatggcgtgacaggtgcgaggggaatccccgagcctatcccctcaccaccatcacacagctcccctgttcttagggaggtcactgggcatgccacatgggttactgtctgtccttcccccacaacaatccgtgtctcctgtccaggagggagactgtccttacacaagggaaaggaagcgtgatgtctggcttgctatgtttctgatggagaatgtgggtaaggtccctggggaggggggcgctgtaactagacgttaggtcaggccctcagtctctgccctcgcagttgcctgttggtaggggttgggtcttactgcagacggcaggcaggcccccagtccaagacccccagtgcctgaatcagctctgtgagctcccatgaccaaggcatcctacctgctgggggctgagggcaggggatcccaggtgaagaaaggaaggggcagcatagccctttggggccagtctccatctgctggtgtcttgcaattttgatctcattgaaacgaaggccgggcgcagtggctcatgcctgtaatcccagtactttgggaggctgaggcaggcagatcacctgaggtcaggagttcaagaccagcctggccaacgtggtgaaacccccatctctactaaaaaaatacaaaaattagctgggcatggtggcacatgtctgtaaacccagctactcaggaagctgaggcaggagaatcgcttgagcctaggaggcagaggttgcagtgagccgagatcacaccactacactccaacactccaacctgggcaacagtgcaagaccctgtctcaaaaaaaaaaaagaaagaaagaaagaaagaaaataggaaagaaaccaacagcagacttgctcagagacaggaggcagccccggtttggcaaaccctaaaatggagattgagaggaggaaggccgaggaaaggccagcccgctgggtttccactccatcatccgtgaggctcacacccaaggcggggctgcccaggcgtctgtctgggcacaagctggggactgtgtctgccttctgagactgctgaagaccggttctgaaggactgccattttccctgctctatgctggagggcaaggtttctctcaaaagcataaataattcccaaacaggtgttcctcctagattaccatataagccctgactcccacgggatgggtggccaatccatttctttttcttttctttttttttttgagacggagtctcgctctgtcgcccaggctggagtgctgtggcgcaatctcggctcactgcaagctccgcctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtcattcgcctgccttggcctcccaaagcgctgggattacaggcgtgagccaccgcgcccagcttttttttttgagacagatttttgctcttgttgcccaggctggagtgcaatgacgtgatctcagctcaccgcaacctccacctcctgggttcaagtgattctcctgcctcacctcccgagtagctgggactacaagtgtgcgccaccatgcccggctaatatttgtatttttagtagagacggggtttcaccatattggccaggctggtctcaaactcctgacctcatgatccacctgcctcggcctcccaaagtgctgggattacaggcgtgagccactgcatccagcctgctggtcaatccatttcatctcgtaagccaactcctaacacttgtacacaaatgttcatagcatcagtcttcattcgatagccaaaaggtggagacaagtccatccacagaggaatggatgaacaaagtgaggtgcatccaaacaatggaatattatttggccatgaaaaggaatgaagcactaatacatgtagagcatggatgaaccttgaaaacatgatgctgagagaaagaagccagacacagaaggccacgtagtgtatgacgccatttatacgaaacgtccagaataggcaaatccatacctattctgagtggttactggggtgggggagttggatggggacagctaaggagtgtagggtgtcttcttgggctgatgaaaatgtcgtaaagttgacggtggtaatggctgcagaagtctgtattagaaaccactgaatcatacacttcccgtgggtgaattacatggtatgtgaattgtacctcagtaaagctatgtttaagaaacagaagtgactgcctggagctcccaccaagtcaggtagccacgatgtgctcagtgggaagggcagtggggtccccacccaccacagcacctgcagcaggggtgcccagcaggttctcccagtctcataaggacacaaagcctcatctgtcctgggaggttctggtcacctgggctggctatgtgtatgaaggaagggtggctgacagcaagaaggtctgcatccactcgggtgagggaactcttacgttactttgcaacaggcaggaaggggacttattttctaggtctaaacacatcaaagaaagagaagtggaggctggagagcccctagcgaagagccacacagtgcagcatgcctgacctatgtgctgaccatgcggactcgggggggcacccatgggccccgtgacagagcttcaacaccattgacgtgcactgagaagacatgggtgccacacaggatcttcagacctgggtgcattctcaggcattccagctggagcgccatgcacccgcagccccagcccacatgcatgacccaccattgggtccaagcccccgaggcccctcattctaatactgggtctggaggcccgcggtgagccgggccacagcagcccaggctggaaggagcatctgcccgggtggggatgcccccgtgctctgcagctgcccacccgcccccctcaggccccagcagaggctacggcacaggcaggcgggcgttaccttgagctcagacagggactcacattccctggttggttttttgctggaatcaccagagggagggaaaagggaagtgagaagggacccttgggatccacgggatgcccgttcccccaccctgagacactcagaccccaaacaccagcttcatagagctggagccagggtggcgttgacagcagatgagtggacacctctctgcatggacacacagggtcctgagtgagaccacactgctcgcccagcacagagcctcaaacctccccatcaggcactcacggtcccgggccacaaaagtgcttttcttctgactgaccaagagccccccagctacagtgcaagtccccgagaaaggtaaacttcaggtggattagctgtcagcaaaaggaggtgggctgagcccaggttggggtgctgactgtcccagtgcaccaggtgggtttcatctgagtctctccagatggcaccacttcagggaggacctgtgcagagtggtctgggcagggctgccccaagcctagcctccagccaccactcccccacccaagaaggcaggcggccactcacgtgagcaagtttccaggcgctgacagtgagcgttcctcccgccggctgccctcgaatgggttcccaaaggagcgtttacgtatcatggtcttcaccaggatctgaagagggagaaaagaggaggtggcaggcaactgcttggccatgtgggggcgattctgggcaacatcctccctcttccttctccccagcccctgccagctcccagggctggtgaccgatggcagactttgagagaaactgggcagcaccaccccgcaaccaacccccgccgaaagaatcctctgggaaaaggtgctgtcctgcaccacaccctcagccactgctcagcgtctctcccaggcctccctgctttccacctccctccctcccatcccttccaaaacccagatctggtcccctcactccctgactcagcatccccacccagaggggtctggaacttggcctgtggtcagccagagagccccggaaagttctggagcaaggacgtgaaccagtcattcttggtgatgctcttggctgccatttcccatgaagggaatggcctgcgggccccataagagtcactgggcccctcaccccaccccaaccagggcacggtgccccttcaagctgttttgggaattcacagagcttctgactttttaagcatttgctgctaacaagaaaaataagtgtttaagaaacactgatttaccaaaagatgcaaacacccaaatgcccatcaactgaagaagataaactcaaagcggtctgtctgtgcaatggaacatgattcagccataaggagtgaagcactgatccatgctacaacacaaacggaccctgaaaaccttctcctacgtcaaagtagccaggcccgaaaggcctcagagtgtaggattccaccagaatacacaaatctatagacacagagggcaggtgagtgggtgccagggctggggggaggtgaatggagagtcattgctgatgggcgggggtgtgaagtaatgaaaatgttcagaactattgaggagataattgcatgtcactgtgaatgtcccaaatgtcactgaattgttcactttaattttatgttatgtgaattctacctcaatttaaaagaaggagcggggaggggggaggcgggcgtggtggctcatgcttgtaataccagcactttgggaggctgaggcaggtggatcacctgaggtcaggagtttgagaccagcctggccagcatggagaaaccccgtctccactaaaaatacaaaaattagctgggcatggtggtaggcacctgtcatcccagctacatgggaggctgaggcagaagaattgcttgaacctgggaggcggaggctgcagtgagccaagaccacaccactgcactccagcctgggcaacgagagcaaaactccatctcaaaaaaaaaagagagagagaatgaaggcctcttcccctactgaggttcttacagtcactgggacatgccagcccctctttcctctgtgtctgagcagatgtcactccccaggtgagcccaccctgccgcctcccctgtggccttgtcaacccagagcaggagctcctcctctgtgaagcccccagcccttgcatctctctgcactggcctctgatcacacaggaggctgattcttcccaggtccatctttcttataaggccaggagcccctcccccagccccccagccccctacccctgagagcaggcactgggctaagctcatctttgacacctatgcctggcacacactggctgctccgtgtttgctaaatgatgaacacatgcagggggcctggaccttgccatcttgtcccaagtcagaccacttcccagtatctacccgcccatccctgctccagctgccctggttcaaaccctgattcaaacccatgctcttggagtaaacatgtaaaacctcgccacaccctccctccaccttccttgccctgcttcagtggccccacccagtgtgttagcccgtccgccctctctcggcggagttaacaccctaccatcctctcggtgtctatccacttcttcccagtgggtccaagtgtgcctccattaggggcatgtcctgtggtccctctactgcactgtacatacatttgttggtttgaccagcatctgcctctcaagcatggcagaggccatgggggttttgttcatcactccacccagcccctgctcccagcacaggcctgagaaaccactcggtgttcaacaagtgtttcccgaataatgaatgcctactccagacctccagggccagacgctttctcccaagaacccgtcccagagacccaggaaggaaagggagggcaactgattcaggactgagaacctcctgagcctggaacacagtaacccacggtgggtgcagagtccgacgccagctgtctcctcgtctacaggcacaaggggtggttgaggaagggtgagtgggcgtgggtgggtcttcaacagtgaaggtcctgcacagccccaggtggggaaagagtggaggaagatgtggatggatgccccagccagggctcagctttgggaggaggagagaggaagtgtgtggggaagcagagaagagaggtgcaaagctggaggagcaggagcagcatctgggctcctacaggggcaatccttcacagctggaccttctgtgcctttccagccagtctcaagggtccctcccagagcccaggggcccgccggcccactggaactagtgctggccaactgcaaccaggcctttcgaggtggctgtggtgggacaacctgctggtctctgtccccaagcctgctgcctggaacctggatccctgggactcttggtctctctcttggagctaactgccctcctggacagggacttggtcagtggcgattcccagagcctccaaggttaggcctgaggactctacattctggctccttcttcctgggtcaggatccaaattcaaggccataaaaggggacctacttgctcctaagcaattctcactctcaggagatgggcagaactttctgagtgtgtgcgtggaagtccctgcccctacccctggtggctgcccacacagcagacgtgagatatgctacgccatccaccctggagcctaaaattccagctaggcgggaatcctggcttagagacctgggctccagctcccaacccttgcccctgcctggaacttctcctagttcctctcccctgatgagctctgaaagcaggaattccagaaggataatcttccccttcctatggtaacatggaacctggctcagaagatgcaggggtcacctggcctgatacatgaccaaggcccagaggccagcagctgtggattaggggtggcccccggacatctgactcccgggcacccgcctgtgtccggcctgtcctggccaggccccacctcaggctcctgggtccctgctctgggtcaggggtccatccaccttaccacggttgccaagctgggaatgtgtttgactgagttctcgacctcctcttcagtcacttcgaccagcgtgcagttctcatcctccgacggcaacggctccgccccatgcctcgtgacccaggggtgcagcttcaacgaacgacaggaggggtgaggggcaggtgtggctggctaccggggggccctgccagcgagcggagccacaagggcatgcaggacggagaggcaagggcctgtggtcaggcatgcaaaacagctggcgagcagagggcaggggtgagcaaaggggcggaaacatgaagacggagagacaggacgggaggagctacaaggctgaaatggaagtggggcgattctccatccggccccgggtcttggccgaagtgatgggaatttggcatctgccttgcctggctgcccaaggagcatccatcactcctcagccacaatccctgacacctgggaggctcagtgcacagcaggcagcattctccccatctcacagcaggagaggcttggaggcatggtgggaccagctggcaggacaggatcaggagaggacccaggcaggggtctgcccccttgggtccaagccccaatccatgattttttgggctgccttctgttaagaccttcaaatgccagttagctagctgcctaggaagtcccagggcaaatctctagatttcctagagggccagatatatgtgtgtggcattagtggagatgtgtaggggaatacactttcctaaaagtgctttctgcaagagggtgggattcagcaggctggggaggtcgaattgctcattaatttcctcccatcctcactgcagtttctcaaagggacgggcctttggaaaggacctgagctctgggaatagggtgtggagcacggaggccccatgccggtctgcagagggtggatcccatcagcccacgccaatcagagcaagtgcaggctggcgggtcatagatcccactcccacagtcacagtgcacacaatgcccaaatcttcctacccagccctcaacagcccccagcagctcagaggccctggggcataggagaacagcggtgccaaggagggtgtggtgctgtggacacaagggtgtggggtctggctgaggcatggctgagccaaacaattccgagcacggggcacaggctgagccaagggtaccttgatttccggcaccacgatcctcgactcggggttcttgtccagcatacgggtgatcaggtccttcaagtcctcagctatgtcgggcctggggatggagaggcgtcagggtggcagacacgggaccgccaagaactcggacaggagagatgcgggacggcgggagatactcactggtctggaaattccagggcctgactcttgatcttactgtgtaaacacatgatccgctcgtccatgaatgggcactgcaaagaggccagggacagagtggcagtcaatggcggccacatctgcccttcgagggccacctgtgctgtgccactccacataggatacagcagagaaatcaacaattgcggcccaggctagggggcaagcagttcccattctccccgagaatggccaagacacaggggtgtggggcctggccgacacagggcagagccaggaatggccctctcgaagggctagagcctttcccaagcacactgcaggctccctctgtagctgggcctcagtttacctacttacaccaaagcaaacactgctcgtcacctacttgccaggtgaacaacaggaacaacaagaataacacaaaagactttgtgttatttgtggcagcagcagtgattttcaagggcttagcctggatcgcgccacgccctgccctgaggttttcattcactgttccccgtccctggaatgttcttctcaccaacatctacgtggcttggtctctcccaccatgcaggtgtctgactaaagctcaccttctcagggaggacttcctgaagccctgtctaaaacagacaacccccaatgccgccaccgcccacatcactcctcatccgtagcacttatccctgacgttatcgtacagatttgtttattgtttaacccctcccacgggaacgttagctccaagaaggcagggatttctggctgtcttgctcactgcggactctccgtgcctaggagcgttcctgcacaaagtaagggctcaataaatatctgctgaattaatggatacttgaattatttctgtcaatcctctcagaagtcatcagaaataataagtagtattctcattttacagaagagaaaaacagaagttcagagaaataatgtgtcccaggaagtacgaagagggatttaagcctagattcagctgactctgaagcctatttttgcaccaccttctgggtgacaaatcgatgctttcacccagctgagggcctgactcaagagcagcttggtcatgtgtgctggaaaaggaatccttacacgggacactgaaaatgttggagaaggtggcagagaggtacctgaaccacccgtctaaggaaaacgatttcattaagagcagtgacttgagctctagctaatcactgccttctaaggcatttggaaggaagagtggagatggtggtaacttactctgaaatacattaagaaaccagatggactgagggatgggtaaggaatgaacagacaagcacaggaaaaggttaatatagtagaatccaggtggtgggtatgtgggtgttcactggacacttcttccagctttgctacatgattgaaaaattttctaatcaaatattgagaggcaatcggtataaactcctttacttcttcatgggaccagtttcttaggctttcctcaataagaacacaagctcaggaaagggaaaaatctacgtttttattgctcacataatcaaactgaacttcagagttaaaacgagaaggccaggcgtggtggctcacacctgtaatcccaaatcccagcactctgggaggcccaggctggcagatcatttgaggtcaggagtttgaaaccagtctggccaacatggcaaaacactatctctacaaaaatacaaaaattagccgggtgtggtggctggcatctgtagtcccagctactcaggaggctgaggcaggagaatggcttgaacccgggaggcggaggttgcagtgagccgagatcgcaccactacactccagcctgggtgacagagcaagactccatctcaaaaaaaaaaaaaaaaaaatagagagagaagcccccagatatcaataataacaaaataacaacaacagaaaagcccaaacagcactccctaaatcaataatggtaaacagcttttaacttccattccaatgctacccctctgacaaaagcttctaggaataccctgacggaaagaacatcagagcagtatcaggctcaggaggaacgagcacagttattgattagtgatgtctgccttgggctcagaaatgggagaggtggcagaactgctgtccttgccctaatttatcaactatttataaactctagagcctctgccaatccttctgttttaacagatcattttttcatagatatgatcatgacatacatacacatgtatatttaggaaggcatcctttttcacattgagatctaggtgtagaaataaaataactcttctcttattttattttttgagatggagtctcgctcttgttgcccaggctggaatacaatggtgcaatctcagctcactgcaagctccgcctcctgggttcaggcgattctcctgcttcagcctccagagtagctgggactataggcatgcgccatcacgcctggctaattttttgtatttttagtaaagacggggtttcaccatgttggccaagctggtctccaactcctaacctctggtgatccgcctgcctcagcctcccaaagtgctgggtttacaggcgtgagccaccatgcccagcctaaaataactcttaaataagtaagtactgtctccccgcaagggtgactattaacccaggggccacccagcagtactgaggggacagacaccccgccctcttacctggccaaagacaaagcagtatagtgtcacacccatggcccaaacatccaaggcctgcaagaaaaagagcttagtgtgagggcacaaggggcggtccagcctccaatcctccagttttcctttggggaaccacctcttgactttcagcccttggagttggggcgggaccaatcttgtctcctaggctctggggcaggcacaggatccaggccaggccaatgagagcaccactacccccagccacagtgattggttcaagcatgggcacatgacccatgttgggccaatcagagccaaccccagggttttcacaggcactattcagaatgaggaatgctcttgccactgaggttggcaaatgatagaaagtaacctggtccctgggtgcctgacccacctgtggaggaaaccaaataagaaaaacaactgaaagatggcgggagatggtttctgtttgagtccctggatctagccaagcctgaagcctacccctcagtatcttgatccaggggattcactgtttaagcctgtgtgcgttgggtttctgctgcttacaatccagaagacactaacacaggcagaactctgtggctgaggcaggcccaagcttaccttcccagagaagatcttgcgggtctcagagagcgactcgggtgccatgaaggcgggcgtgcccacggtgttggagaggagcgcgtcactgcccttgaattcattgctcacaccaaagtcagcgatcttgatgtgcccatcttctccgaccaggaggttggaaggtttgatgtcacggtggatgatcttctggtagtgtactggggaggcgtagacagcaggtgggagataggggcaggaaaacctcgtgagcacctctatgcggccacatggcctggagacacaggcatggcacccctctgatgccttgtctcccacagccccaggccttttccaaccttccactccccaaacccgctgggcactgacatgctctaaaagatgaggggaaaagtgtcttcaaggaagtcccagcccaccatcaccccaccccttctcaacaatgacacataaaacactgccaatagcaattcgtaatcgcctgttatttattaagtcacaagtgacagtgcatggaaagtttttgctgggcttggctcacagctagttgtgaaactgacagtgaaacatagtttcatttaccaacagccaatactcaactgacttaccaaaccgacaatgacctgagcaggccgatttgaaatgtgaaccacacacagaactcggggcttggctaactcctcctggctggatatcagcccatggtacaggacagttctatggcctggaagacccaactgccatttctggggtgatgatgatgatgaagacgatttcagtgaaagcagcagcagagcaccaagtgaggggcccggccctgcgttgtgtttcacattcacattttacatttaattaaacctcacaaccatcctatgtgacaggcagggataagagataacgtggtggccgggcacggtggctcacgcctgtcatcccagcactttgggaggcaaggcagggggatcacctgaggtcaggagttcaagaccagcctggccaacatagcgaaaccccatctctacaaaaaatacaaaaattagccgggcatggtggcgtacacctgtagtcccagctacttgggaggctgaggcatgagaattgcttgaacccaggaggcagaggttgcagtgacctgagatcgcgccactgcactccagcccaggcaacagggcaagaatctcaaaggaaaaaaagagctaagatgtttaacaagcagaagcagaaaggacacctgccaatcaaaccactgatgtgtactggctgatctcagccctggtgagagatatgttatccccattttacagatgaggaagctaaggttccaggaggtgaacaggaccctgatcccagggtcactgggaggaataagagacaaaaaaaatagagccccaaacagtgcctggtgcacatagaaagtgctaaatagtcactattgctactgctcttcattttgccaagtggcaggaagaagggttttggctcgcctggaccatggccatagggtggctctctgcagctggccctgattctgcatttcacacaattctgtttcccactatgatggttgatactgagtgtcaacttgattggactgaaggatacaaagtattaatcctggatgtgtctgtgtgggtgttgccaaaggagattaacatttgagtcagtgggctggggaaggcagacccacaatctaatcagctgccagcgaatataaagcaggcagaaaaacgtgaaaggtgagactggcctagcctcccagcctatgtttttttcctatctggatgcttcctgcactcaaacgtcagactccacgttctttagttttgagagttagatgggctctccttgctcctcaagcttgcagacagactatattgtgggaccttgtgatcgtgtaagttaatacttaataaactccccttttaattttatatataattatatatataattttatatataattatatatataattttatatatataattttatatatatatatatgtatctcctattagttctgtccctctagaggaccccaatccacccgcccacctccctgtgctccaggaagaaaataagacactttccactttgcacccacgctcagaatgctaactacccactgggtgagagccctcccgcaggccctgctcacagtactcgatgcctttgatcagatcctggaagtagaaacgggcctggtcttcagagagtggtttgagggtgggcacttccatcacgggcctgaaaggtcgacactcatgtgaaacacaaagcagacccgccagcccttgccctctctcatgagcagagcccagtggcacctcactcagctatgcagctacagaagcttcttgcatcacccctgctgggagctgggacactcacccttggttgaccagttcgaacactgtagggaagaaaagggtgaaactgttacatgggaaactgaacatccatctctctctgtcctccccacctcccaaccacctccagaaacaccaagaaagacagaaactagtattagagctggggagaggaacagtccactgaaccaagctggccaaggtcctgctttgctaaatttccatcagaaggcaaagaaccagggatttctgacgtccccaggcccacagtctggcttgacttctagtgctcaaattggcccaggatccactggtcaaagaaaacacggcagggggctgggcacggtggctcacgccagtgtaatcccaacactctgggaggccgaggtgggcgaatcacctgaggtcaagagctcgagaccagcctggccaacgtggcaaaaccctatctctactaaaaatacaaaaatcagccgggcgtggtggcaggtgcctgtaatcccagctacttgggaggctgaggcacaagaatcacttgaacctggacagcggaggttgcagtgagccaagattgcacccctgcactctagcctgggcaacagagcaagaatgtcccaaaaaaaaaatttctttgagatgaaatttacgtaacataaaattacccattttaaagcgtgcaattgagtggcatttagtatattcacaattttgggcaatcatcacaactatctagttccagaacattctcatcacctcaaaagaaaacctcatacccattagcagtcactccctattcttccctccctcaatcccctggccaccaccaatctgtttcctgtctctatagatttgcctgttctggacatttcatataaatggaattgtacactatgtggccttttgtgtctggcttctttcacttagcatcattagcacgtttttaaggttcatccacactggtgcatggatcagtgcttcattccctttaatggctgaataatattccattgtatggatagaccacattttctttgtccattcatctgttgaggggcatatggactgtttctactctttggctgttgggaagtgctgcaatgaacgttcgtgtacatggatatgttcatgtgtggatatctgtttttggttcttttgggtatatacctaggagtggaatttctgggtcacgtggtatagttatttaatttgattctgctatgacaagcataaattggaatacaaggctgtactttaggaagttaaaaaaaaaaaagagcacagtcgatttcaaaatccagtggaggatgactctggggttgcttgttgttctggaatcatacacccacaatgagatgagcatgtaatagaaaccagaggggataccccattttccatgatgggattattatgcactgcatgccggtattaaaacatctcatgtaacctatgactatatccacctaccatgtacccacaaaaattaaaaaaactttttttttttttttgaaatggagtcttgctctgttgcccaggctggagtgcagtggcacgatcttggctcactgcaacctctgcctcctgggttcaagcaattcttctgcctcagcctcccgagtagctgggactacaggcacctgccaccacacccggctaattttttgtatttttagtaaagatggggtttcaccgtattggtcaggctggtctcgaacttctgacatcaggtgatccacccacctcggcctcccaaagtgctggggttacaggcaaaaaaattttttaaaaatgaaaccaaagggttgtttcaaagctctccaagggctgaggtggccaaggggaacagggaagctactcagacaaaaagaaggcttaaaggttctgatcaggaaaagaactgaactctcccaggccttccccatcttcagtttcatcaaccagtgtgagttagggcagatttgccattgcttcaggctgtagttaaaaacaaaggcaatgctgctaaggtacagcttctacagacaacccagcgctggccccctcagctctggcctttcctgccttggttatttaagtcttcacttgcaagcttcatgaatttctgcaccatcctcccacccacccaagcaccataaatcaggtggcatgagggagggtggcctgttgaaacaggtctattttcagtcgctaacagttcaaccacttttggggctgagcagtgggtgggaattttttaacctctagaaatagagatcgagttttctactttttttttttttttttttgagacaaagtctagctctgtcacccagactggagtgcaatggcacgatctcggttcactgcaacctccgcttcccaggttgaagtgattctcctgcttcaccctcccaagtagctgagattacaggcatgtgccaccacatctggctaattttgtatttttagcagaaacatggtttcaccatgttggttaggttggtctcgaactcctgacctcaggggatccacctgccttggcctcccaaagtgctgagattacaggcatgagccaccacacccagccccctcctccacctttttttgttttattgagacagggtcttactctgtcgcccaggctagagtgcagtggcacaatcatagctcactgcagcctcaaactcctggcctcaagcaatcctcccacctcagcctcccaagtgctggggttacaggcatgagccaccgcacctggactgagttttctgccctttgcatgtcaggcctgtagctgcagaccctttctgatacctactacccggcctcatgcactgccctgtctgtctcagtctcacacggctgtggctggaaagtaaaatataaccgtgtcaggattttcaaaaccactggaatcacataccccaaattagcatggctttctgcaactgccacctcgagttgtgaaaaactatccctgcagctgcccagctcaagcagatcacgaaactcttctttgaggcttggaccatgttctctttattctcattccacccgtcagctcaaaccccccaatggcttccatcactctcagagtcaaagccaatttttttttttttttttttgagacagtctcactttgttgcccaggctggaatgcagtggcgccatcttggctcactgcaacctccgcctctcaggttcaagtgattctcgtgcctcagcctcccgagtagccaagattataggtgcacacccccatgcccagctaatttttgtatttttagtagagacggggtttcgctatgctgcccaggctggtctcaaactcctgagctcaggtgatccacccgctcggactcccaaagcgctgggattacaggggtgagccactgtgcccgatccaagttctttacaatgttgtaaaataccttctgccacctggtccctgctgttctgcccaaatgtcaccttggtgagacattccctggggagccactgtatttctccatcccccaacccaaaactagcagcccctcgtgtcctgctcggggtttttgttttgttacggtgttgtcgctttcaaaacccacgcatcacactcaggtgcgctccccaaggacaggggtttttgaatgttgtccctgatgaacctacagcagggtctgacaaattgtaacatttgttgaatgaacaaaggcacgcctcagaaagagctcaaagccattctgacctggatctggggtcccaagtgagagaattacgctaagaatgccattctgggctaaaatgacttttggcatattgtgatttctgctgtatctccccaaacttcatttatttgcctactatgtttataatctggccatacctatatgccacatcaattatttattgaatgtttttctttaaattgactcagtttttaattttttagccttgtcctagatgataatatccatgaaactatgagtttggggtgctggttatagtttttcctatacaatgttaaattaaatataaaattgtttttctaccttttttctgtgtaccacctagaacagtgcccaccatataggaggttgtcaatatatacatgctttgggaggccaatgcaggaggatctcttgggcccaggcatttgaggccaggctggacaacatagtgacactttgtctctagaaaaattttaaaaattagctgggtatggtggcccatgcctataatccagctactcaggaggctgaggtgggaggatcacttgagcctgggagatcaaggctgcagtgagctgtgatcacaccactgaactgtaagcctgggcaacggagcaagaccctgactcaaaaaaaataaatacatgcaaatgaatgaataggatcagataaagttccagcaagaactcccttccacctgctgatcccaaccaggggtgtggcctccggtggggccagctggaccaggaaagggaaagctgtctttggtggaaggtgccagggcacaggctgcctcgagaggacccctgggcattggcaggtgtggtgcctgggtgagggtggcagaagaaaagggcttccttacccatgtacagatggtcctcattggggtcatccaggaccttggcacagccacatggaataggcaggagacggatggcgggggagaaaaagagagaatagatatgagcagggaggaggcagcatccacgtggctgcgtttgccaacaggagggctgcatttggcagcgtgtttcccagttaagatggaagatagggaaaacccccagagtgtgagatcctaatggctattcggaaaataaatgcctctctgtctgatcctcgaggatctgaacactcagaaaggaggtcgcaaaagggaggggccaaaatactcccctggaaatatctcatgcttgaataagaatccagcctatctccggctgggcgcagtggctcatgcctgaaatcccagcactttgggaggccgaggcgggcggatcacctgaggtcgggagttcaataccagcctgaccaacatggagaaaccccatctctactaaaaatacaaaattagtccggtgtggtggtgcatgcctgagtaatccacctactcaggaggctgaggcaggagaatcgcttgaacctgggaggcagaggttgcagtgagccacgatcacgccattacacttcagcctggatgacagagcaagactctgtctcaaaaaaaaaaaaaaaagaatccaacccagctcctaggagacaacggtgttcagggtgaaaattcaaatcctatctgggctcaagtgactccacgaagcctccccattgcccctaaccccacaggaaatgatgtctccctgcccagaacagccacagcactttctctctctccaaagggcaggcatcaggctacatccaccttgatttcctcggtggcgtcctgtacagggcacggcatacagaaggtgcccagggaatatctgatgaatgaacaaacagatgggctggcaaagagtcttgttgggtgaaaaggccaaatgccatagggcagcggagagaaaagacaccctgccaggacccagggcccctcgctaaccaaatgcccttgggcttcctggaaaatggccaactctagcaccagtgagtcgagattgtgtcacttagtgtgaccggtggtgatggcctacaactgccatctctcttctttgggaagaaacaaatgcagcctccctggctagactagtccccctgattcttccctcatcacgtccgctttctccagtcacccaagatcaataagacaacaggccccaagaaagggaggcaccctaggcagagcctgggctagcagcctgaagccctgagccatgccctgtggggaaggcacacccagggccttgtccgcctagagttctgcaccagatgagtcccaggcaaagtggtagctagccctcacatctcccgaaggcaccatgtactcccccaaacagaggcttccagccctttccacatgcagctccctgccctgcaatgcctttccgtgacttctcatccaggaaccaccacggccatctcaaacatcacttcctctaagaggcctctcccagcttctcccagtgagctggctgcccccgctttgtactcccatggcactctgaacatccagcacggtgacaagtccttgtcgtctagaccagaggtgctccaaacacaatctggagatgtctgcagatccccaagatgcttcatggagtttacaaggttcactattttcactttaaaacgaagacagtatttgcctttttgactatcattctccactagtctacagggttttccagaaacctgatgatatgtgatgtcacaaaacattgaatgcaaaagcagagatgagaatccaaatgtctcctatcaaaccaaacagtaacccaaaaaaaggcaaaaatgaaaaatgaagccactcttctactttttatttttcataaaaatgtattactcggccgggtgcagtggctcactcctgtaatcccagcactttgggaggccaaggcggctggatcacgagttcaggagatcaagaccatcctgactaacacggtgaaaccccatctccattaaaaatacaaaaaattagccaggcgtggtagcgggcacctggagtcccagctacttgggaggctgacgcaggagaatcacttcaacccaacaggcagaggttgcagtgagctgagatcgtgccactgcactccagcctgggcaacagagtgagactccgtctcaaaaaaaaaaaaatgtattactcatgttaatacgcaataagcttattgttttcttttcttttttagaaacagggtctcactctgtctcccaggctcgagtgcagtggcacaatcatggctcactgtagcctcgaactcctgggctgaagtgattctcccacctcggccttcggaatagctgggaccaaaggcgtgcaccaccataccgggctaattttttaaattttttgtagagacaaggtttcaccatgttgctcaggctggtctcaaactgctgtcctcaggtgatcctcccacctcagcctcccaaagtgctgggattataggcgtgagccatcgtgcccagcctattgtttttaaataattaatagtttaaattttctcagttttaaattataatgtggtagatattaataaatataactcatataagtgaaagtgcttttgggtcttcaaaaaaagtttttttttttagagacagagtttcactcttgttgcccaggctggagtgcaatggcgtgatctcagctcactgcaacctctgcctccccagttcaagcgattctcctgcctcagcctcctgaagtggctgggattacaggcacccgccaccagcgcccagcttatttttttgtatttttaatcgagtacaaaggcatcctgagaccaaaaagtatgagaacggctgatctagagcaggggtgcaaactacagcatgtgggccaaattcagccctctgtctggtttgtttgtttgttgttttgtatttttagtaaagacagggtttcaccatgttggccaggctggtctcaaactcctgatctcaagtgatctgtccaccttggcctcccagagtgctgtcattataagcgcgagccagtgcacccggacttgtttttgtaaataaagttttactagaacacagccatgccatttgtttacatcatgtgtgtggctgcttttgcgctatgactacccatatgtgtaagtagaaagagaaccagcttcaaagagacagaaatgggtgaagggatccctctgagcctcaattcctttgtccgtaaaatgagagtaataaatatctgacagaaaaacaaagcaggcaaaagaaagaagagaaaaaatagttaatgtgagtaacaaatactcttagggagcagtaaatacaactcagccctgcagtgagcggtctggtgtgacctggctctccctggaaaccagtggcggggtgtttgggtattaacaaagccagggcctccctccctcctgggcgcctccacccttttacctccaccagcttcaccacattggggtggtccagcttcttgaggatggcaatttcctggtacacctgctcaatggggcccctgggctggatgcagcctccaggagctggccgggtgcctcggggtggagggcgacctgaaggaaacaaaaacagacccagggtcagggcaaagagactttcctccgcagagggcagctgcaggtgggatgccaaaaggtgggatgccaaaaagccactctgcagggctggagtggctgctgccaccaggggctttaactaaccctctactcctctgtctcctctgctgctggaagtgagtgagggcggagccctcggccgtcctgtgaattccctccttcccgtcacatccccagtccatgccctggtccacagtgaaaggcaggagtgctgaggcaactgcagtctagctcagcaatctcaacacccagggtgagtcaatcacttcccctctctgggctcagtttttgcagtccataaaatggacataaacattaactcttatctccttaactcatagcacagatggctggctgggcgctatggctcatgcctgtgatcccagcactttggaaggctgaggcgggtggatttcttgagcccaggagttcaagaccagcctgggcaacacggcgaaaccctgactctataaaaatcacaaaaaattagggccgggcacagtgcctcatgcctgtaatcccagcactttgggaggccgaggcgggtggatcacgaggtcaggagattgagaccatcctgactaacacagtgaaaccctgtctcgactaaaaatacaaaaaattagccgggcgtggtggtgggcgcctgtagtcccagctactggggaggctgaggcaggagaatggcgtgaacctgggaggcggagcttgcagtgagccaagatagcgccactgcactcgagcctgggtgacacagcaagactcagtctcaaaaataataataataataataataataataataataataataatcacaaaaaattagtcaggtaaggtggcacgtgcctgtggtcccagttactcaagaggctggggtgggaggatcacctgcgcccaggaagatcaagcctgcagtgagaagtgatcatgccactgcactcagcctgggtgacagagcgagaccctatcaaaacaaaaaacaaaaaaaacaaaaactaaatagcactgatgtaaaatgaagccagggagaagaaaagaagcaagcatcgggagagaaaaacaaaaggctatctagaaaggagaggcactcaggccaccgcttgatcctgcagtaaacaataggcagtcacaaggatgtacagacccacagtgaaaaccctcacgatggcacacatcccatgtaagtaaggctctgagtgtgactaacagaatagaacagggatgtgatcggccttggaaaagcaaaggcagaagtacaggtgtcagagggaggatgtgaaaggaggaaagctgagtccaaaggaaaagggagggtgtggggaggtgggagacacgcgtcatatagctggagagaggggaaagtggtgggtgtgtgtccacagaggagctgaccatcaggagagcgttccactgcctgctggggaaagggaggtgctacggtcaggatgtttgtgctcctccaaaattcatatgtcaaaacctaatccccaacgtgatggtattaggagatgggacatttgggagaagagtaggtcacgaggatacagctctcatgaatgagattagtgctgttataaaagagacctcaggctgggcgcagtggctcaggcctgtaatccaagcactttgggaggccgaggtgggtggatcatgaggtcaggagatcgagaccatcctggccaaaccccgtctctactaaaaatacaaaaattagccaggtgtggtggtgcacgcctgtagccccagctacttgggagcctgaggcaggagaattgcctgaacccaggaggtgaagtttgcagtgaaccaagatagcgccactgtactccagcctggtgacagagtgagactctgtgactccgtctcaaaaaaaaaaaagaccccaaagagctgtctagcccctctgccatgtaaggatgcggtcagaaggcactacctatgtttgtttgtctgttttgagacagggtctgtctaccagactggagtgcagtggcgcaatcaagaatcactgcagccttgaactcccaggctcaagggatcctcccgcctcagcctcccgagtagctaggactacaggtgcacaccaccatgcccagctaatttttaaatttttggtagagacaggggtctcactacattgcccacactggtctcaaactcctgggctcaagtgatttgcccaccactgcctcccaaagtgctggcgtgagccaccgctcccggcctgagatggtgctaactatgaaccagcctccagaagtgtgagaaataaatatcggttaggttaagccacccagtctctcgtacgttgttacaggacaccatttgttattttgttaagacaagaggtaagaaggagtgtttaagcaagcgaaatcctctattgtcactggaagaagccagaagcagatgtcaaaaattgataatagtgacgtgaggattatgacctggtgcagcgtttggataagcaggataaaccagggtcctactgttaggatgggtttttttttttttttgagatggagtctcgctctgtcgcctaggctggagtgcagtggcgcgatctcggctcagtgtaacctctgcttcccaggttcaagcaattctctgcctcagcctcccgagtagctgggattacaggcacccaccatgcctggctacttttttgtatatttagtagagacagggtttcaccatcttgaccaggctgatcttgaactcctgacctcgtgatccacccgcctcggcctcccaaagtgctgggattacaggcatgagccaccatgcctggctgtttgttcttatctaatttctctttttggcccaagctgacattttgcccagcaatgctggcagggagcttatgttgaagcagcctctgatactctcacctgcagcctatcatctgaccacacacaggagctaccagcaactaaaagtgctaaaagccaaggctgcctataggagaaggaaagaggtcagcaagaaactggtctccatgatgagccctcctgtgctctggcccttttttttttttttttttttttttttttttggtagatataattcaaatacctcgtggtatttaaatttttttaatttatcctttttttttttttttttttttgagagatggagtctcagtctgtcgtccaggctggagtgcagtggcgcaatctcagctcactccaacctccgcctcccgggttccagcgattctgctgcctcagcctctcgagtagccagggatttacagatgcatgccaccatgcctggctaatttttgtatttttttagtagatgcagggtttcaccatattggccagaatgatctcaaactcctgacctcgtgatccacccaccttggcctcccaaagtgctaggattataggcatgagccaccgtgccctgctaaatttaccattttaaaatgtgtattttaatggtttttagtgctgacaaggttgtgcaaccatcaccattatctattgcatatttttttttctttttttgagatggagtcttgctctgtcacccaggctggagtgcagtggcatgatctcggctcactgcaacctccacctccttggttcatgcaattctcctgcctcagcctcccgagtagctgggattacaggcacacaccactacgctcagctagtttttctatttttagtagagatagggcttcaccatgttgggcctggctggtcttgaactcctgacctcaagtgatccactcgcctcggcctcccagagtgctgggattacaggtgtgagccaccgtgcccggccaactgcagaatattttcaatgcctccctaaatatctatatacatatctgatatctatcagcattcacccctcatttcccctgttccccagagcccccagcaatcacaaatctacttttgttcctatggattggcctattctgggtatttcacataaacagaatcacataatatgtgagcttttgtgttaggcttctttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatatatatatatatatatatatatatatatatatatatatactctattcatattacttttaatggatgaatattccactggatgcatatatactctattcattctctgaagccgtgtgtgctgtttccactttttagttattgtggctaaacctgctatgaacattcacatacaagctcctaggtgaacacggatgtcctgttctcttgggtatataagtaggagtgaaattactgagtcatacggtaacaccatgtttaactttttgaggaattgccagtgttttcctctattggattttttgacttgatacctatataactttaataaatatttttattttattattttttgagacagagtcttgctctgtcacccaggctggagtgcagtggtgcgatcttggctcactgcaaactcctcctcccaggttcaagcaattcttgtgcctcagcctcccaagtagctggaactacaggcatgtggcaccatgcccagtgcaatggttcccattcagggggctctgccctgtcttgtcccagcccctgtacctaacaacaaaggcccgccaaactcacgtggaaagccggcctgccggatcagcttctttttggacagcaccttcattgcctgcaggaaaatgaaggacagcacctttagccaggtcctggttaaagcagggaggaaaaggggaaggagggcgcagtcggggttcctctactccaaagccggcccaagctcctggccccctggcaggctcaggtcaacagagtgagcccctcattaccagagagggtcaagcagccatggggttgtagggaggctggactcctggggtgcctccagctctgaggtgttcctgaggctcaaagtcgcctctctcagctgggaaaccacgagcctcaggacttgctgccatcgaatcaaaacacaagtgagctggagcaatgggcaaaggaggggcaggactggttgttttacacacggggaaactgaggctcagctgttttacacatggggaaactgaggctcagctgttttacacatggagaaatatcacttgtcaaggtcacatggttggcacacgatagattcaggttcaaaactacgctggactgactccaaagccacccacacagacatctgtctcactgctgccttgttctcaatactatggaggatgcagagatgacagctcagaggaagggcataaaagccttttgctgaatgagtaactttttctgggccaatcccctcacctccccattttcctatctgtaaaatgggcataccacttccttcctaaggcacaaaataaacatgacctaagaataaaatgagacaacagctaggaaaactttccaggaagctgagtgctggaaaggaggctcttctgtggataaggatgggggcagggaggagaatgcggatactcacatagtaggtattgtcattttcattgtaggccaacttgacgacaccataggagccctggataaagggagatgcccatgacatactatccagaagttaagatctgcaaaatgagaaccctaatacagacgttgcaaaccagcagcccattggtcaaatctgtcccgcaactgtattttgttggagcccaggtttttacaaagtttggattagttgccaagatttaaaaacagaaagatctgggcggagcgcagtggctcatacctgtaatcccaatactttgggaggccgaggcaggcggatcacttgagttcaggagtttgagaccagcctggccaacatgatgaaaccgcgtctctactaaaaatacaaaaattagccggggcatggtagcaggcacctgtaatcccagctactcagggggctgaggcttgagaatcacttaaacccgaaagcagaggctgcagtgagccaagatttcggcactgtactccagcctgggcgacacagtgaaattcagtctcaaaaaaaaaacagaaaggtctgatatagaaatctatattccttgccaggcaaggtggcttacacctgtaatcccagcactttgggaggccgaggcgggcagatcacttgaggtcaggtttgagaacagcctgggcaacatagtgaaaccctgtctctacaaaaattacaaaaattagccaggtgtggtggtgcacacctgtactcccaactacttgggaggctgaggcaggagaatcgcttgagcctaggaggcagaggttgcagtgagccgagattgcgccactgcgctccagccttggtgatagagcaacaccctgtctaaaaaaaaaaaaaaaaaaatcaagattcctagtttattttgaaaaaatggaaagatctagctatatgtagccctcatttccatatgttaatggtttgccaccgtccttaccactccctactaccttacagctggcatgcctcactcctttatattacttacttgttttctactggcatttggagttttgaccatggtgatgataccccccattagctaaaacaaaagcaaaactagatgtcagagtacctcggggtgaaacaaaaccccaaatgtattggggatgtaactatcaccaaggcgatatggaatttcgttggaagctttctgagcttctgcagaaacatatttaattttaagatacaagaaaacaaaactaaaccaaaaacctagatcattaatgacaaaaccctctccaccaacctcgccttcaaagactcctctcctgctcccagctttaccccgttccctccacagtatctgaacgcccctggtgaatgcagaaagccagcctagccccagggatatttacctttccaatttcatccttcagggtatactgattcagctgcacacagtcctagagagtaaggagagacacgtgcaaaatgaattttaagtttgcaactagaggccaggcacggtggctcacacctacaagcccttcaggagaccaaggtgggaggatcacttgagttcaggagttccagaccagcctggccaacatggtgaaatcccatctctattaataatataaaaattagccaggcgtggtggtgggcacctgtaatcccagctactcaggaggctgaggcacgagaatcgcgtgagcccaggaggtggaggttgcttgagcggagattgcaccattgcactccagcctgggcaaaagagtaaaactgtgtctcaaaaaaaaaaaaaaaaagtttgcaactagatacatttctccaaattaaacacatacaggtaaccagaacccaaatcaagaaagagaacatccccagctcccagaagccactcgcacctctgccctcccccaggtggccactctcttgacttctaacaacgctgattttgctcgttgtactttgtcaaaatgtaaccacacactgtggactcttgtaaaacccattttttaaagaaggttgttcctacttttaaaaagtaaattttaaatcaaacaagtaatccttggctacattgtcctgtaaaaacataaagtgatacaagaaaagcaagtctgtgcaaccttggggtagacaagggtttcttagataatacaaaaaaggtacagacaaaagaaacaaatgataaattggacttcaccaaaattaaaactttggcttttttttctttttgagatggagttttgctcttgttgcccaggctggagtgcaatggcacaatctcagctcaccgcaacctccgcctcccagattcaagcaattctcctgcctcagcctcccaagtagctgggattacaggcacccaccaccacgcccagctaaattctttgtatttttagtagagatggggtttctccatgttggccaggctggtctctaactcctgacctcaggttatcctcccgccttggcctcccaaaatgctgggattacaggcgtgagctactgggcctagcctattttgttttttgtagagatgggtcttcctatgttgcccaggctggtctcaaactcctggtcttaagtgatcctcccgcctcagtctcccaagtagctgggattacaggcataagccattgtaccaggccttgacagtttcttaacaaacatctaccgtaccacaggccactctacccaatagaagtgaaaatgtgtttacaaagacttgcatataaatattaataacagctttagttgtaataataaaaaattggaagcaatccaaatgtccttcaacaggtaaatgaataaacaaactgtggtacgtccatacaattgaaattattcagcaataaaaaggaactacagatatacgccacaacatggataaatctcaaaatcatgatgctgtgaaagaagctaagctaaaaaggagccattgctcataggtcctagctctgtttttggctcatgctgtgaattctccctcctctcaactctccagggcccaattttcatctccaattatgaaagtttttcctggccttcaaaatgtagtccctatagccccttcaaaatcagcccctttggcagtgcacagtggctcatgcctgtaatcccagcactttgggaggctgaggcaggtggatcacctgaggtcaggagttcgagaccagcctggccaacatggcattaccccatctctacttaaaaaaaaaaaaaaaaaaaaaattaactgggcatggtggtgcacacctgtagtcccagctactcatgagctgagggaggagaatagcttgaacctgggaggtggaggttgcagtgagccaaaatcacgcaactgcactccagcctgggcaacacagcaaccctctgtctcaacaacaacaacaaaaaaaagcccctttagaaaggcatcctgatgttgggtcttcttccaattaaattcattcgttccttcaacaaatatttttgcgctcctactatgcaccaggtactgtgctaggctctggggatgggatagggtgtggaggtggatgaaatgatcctatggagcttacgttctggctgggtggagacaggcaataaacaactaaaccaacgcacagataatcagatgctgattaacgctatgaaggaaagcaaatagggccatggggcagagagaggctggagggtgctttagggatggtggcccgggaagccttttggaggaggtgatactggagttgagacttggacattatcggaataggccttacaaagttggcatggggtggtgggggaggtggttccaagcagaaggaacagcgagagtacagacccaaggcaagagcttggattccgaggaatgtgaaggcaggaacagagggagcttagggagctggcagcagaatggcaggagggatgggaaagggtcagaccacacagggccctgtgaaccctggtgaggatctgagttctctgtatccccgcagggtttacggtaagggtcctgtgagaaatgcacagcaagtgctgaacccagtgcctggtgccaacacacgctcggccaggcgggtcgtcgccaggctctcagtgacccgcctcattccatcacaccttcgcccacacctcagtctctttgctggaggctccctccggccctgcaactgctctgtccacacccacagggggtcacacacacctgccccagcagccctcacccatgagtataaacaccccagctcccttgcccctggtgggatgactgaggctgctgctctgtgctgttccccagggtcccacggaaggaaaaagccccagcggcccacactccacactggtaatcggctccatgacccaccctttgctgactgccttcccttccccatgctgattcacgacccccctagggcccctttttggccccagccgcccccaaggttccctggagtcaactcctaggtcaaccgtggcactcagatccttctgggggagcccaaccttccacagaggccctgctgggggcagggaagggcaccagggacccctaggacctggctcaccaccggctcacgcacctgcatacccgtgatggagacgtggtgagactccactgtcggccgccggggcagccgaggcgaggactgcggagagctgacgggtgagtagggcagggacgggcagatgcagcgtccgttcatgtccaggctgccaccggctgccagcccaccctgggaccgctcttgcagagacagcttgcgaccggagaggtggggccgggcctgggacccggaggtgtcaagggggacctcttggccatcggcctccaggggccggtcccgcgccaagccgaggtccacagcacagcccggctcacactcggtgaccacaatgaaggactccatgcccaggtggatgctcaaggatgagaggccccgcagggcctcacagggcttctggctttcgctgctgctgctgcccctaccccccagctcatcctggggggcggcccggttgctgctgggctggctagagacacatgatgacatggtgcatgcgccagcttcatccagcacactggggcactcccatccggcagcggagccacctgcagaaagagaaagggtcagctggcccagctcctacgggcagggacaggaaaggatcccctctcctcccggcccaggctgctgtctaattcctgcctccagttgacatcctaaaaaaatcttgcaaaacatggtgtgatctgatctctgagtctatacagaaaagcagagtctgcatcttcttatattttttcttttattcttttttctttttttttcttttttttttttttgagacaaggtctctccctctctctgttgcccaggctggagtacagtggtgcgatcatagctcactgtacccttgaactcctaggctcaagtgatcctcccatctcagcctcccaagtagctggaaccacttctcacataccatgacaataattcctaactcaattcctataggaacaagtataagaaaacccccaaatagagcacacatatcccctacagaattgacagctgcttccagctcaagccaattgttgctcggcaggaatctgggcctactattgctggtcttccctttgtttttcccaagagaagccctaaggaggttaataagtttgcctgactttttatttttaaatgctgggcattaacaatgcaggtcagggctggacacggtggctcacacctgtaatcctagcattttgggaggccaaggcaggcagattacttgaggccaggaattccagatcagcctggccaacatggtgaaacctcatctctactaaaaatacaaaaattagccgggcatggtggcgtgtgcctgtaatcccagctactcaggaggctgaggcaggagaatcgctggaatccaggaggcggaggttgcagtgagccgagatcatgccactgcactccagcctcagcaactcagcaatagaccaagactgtctcaaaaaaaaaaaaaaaaaaaaggtcggggggaatcaagtatatgccacaatatggatgaacctctaaaatattatgctaactgaaggaagccagtcacaaaaggtcacatatatatgattctatttatatgaaatttttaaaatatgcaactccacagagacagaaagtagactaatggttgcctaggactatgggggtggtgacattagtgggtgtggggaatggctgcttaatgggcacaggttttccttttggggtgatcaaaacgttttgaaactagatagaggtaatggttgcacagcattgtgaacgtactaaatgccactgaactatacacttcaaaatggccaacttatgttacatgaacttatatctcaattttttaaaaaaggccaggcacggcagctcacgcctgtaatctcagcactttgggaggacagggcgggtggatcatgaggtcaggagttcaaggccagcctgaccaacatggtgaaaccccatctctactaaaaatacaaaaattagccaagtgtggtgatgtacacctgtagtcccagctactcaggaggctgaggcaggagaatcacttgaacccgggaggcggaggttgcaatgagccgagatcacgccactgcacttcagcctggatgacagagtgagactccatctcaaaaaaaaaaaaaaagagagagaagtcggacacagtggttcatacctgtaatcctcccagcactttgggaggccaaggcaggtggatcacctgaggtcaggagttcaagaccagcctggccaacctggtgaaaccccatctctactaaaaatacaaaaattacctgggcatggtggtgggcacctgtaatcccagctactcgggaggctgaggcaggagaatcacttgaatccgggaggtgaaggttgcaatgactgagccgagatcgcaccactgcactgcagcctgggtgactgaacaagactcatctcaaaaaataaaaataaaaaagattaacacatccccttaggctgtcaattcttaccgtctctgggacagaacattaacctttgcttaacgtgtttgacaaattctgctggacaaatgtcacaggtaccactggaattcagggagtacatttgtggacagacacctgtggatgatggccactccatgctaatcacccacatcacaaagggtctctctggaccatcctggccaacatggtgaaaccccgtctctactaaaaatacaacaataagccaggtgtagtggctcatgcctataatcctagctactggagaggctgaggcaggagaattgcttgaacctgggaggcggaggttgcagtgagctgaggttgcaccactgcacaccagcctgccaacagagggagactccatctcaaaaaaaaagggcggggtggggggggggggtctctctagatgtcccaggaaaacagtgagggctcagcagagattttatgaatgaataaaatggtatctccgatgacattgggaggtagtggggtaaaagagaggaaggtacagacagcggaaagccagagctccctggaggatctggctgagaggcagaaaatggccctcagcgctctcggaacggtccttccagaagaactgatgaaagagctactacgccaggcacgtggcagggaaagcccaacaggaaaggcaaaagggaaaacccaacgccccagccctgacacgggcctgactcatgcacacagagtgtgtggtaagagaacgccaaagagtccaatcatgcggcaagatgttcaacctcacagtaagagaactgcaaattcaaactacaatcaggcagcctggtggctccccaaaaagttaaacgtagagttgccatataaccagcaattcctctcctaggtatagacccaaaagaattgaaggtagggattcaaacggatacttgtacactaatgttcatagcaacatcattcacaatagccaaaaggtataaccaagtgtccatcaacagacgaatgaataaacaaaatgtggcagagccatacaacagaatactatacagccacaaaaaagaaggaaactctgactcacactacaacacagacgaaccgtgaagacatacgctaagtgaagcaagccagatactaaaggacaagtgtaagatttcagttacatgaagtatctagaatagtcaaattcaggccagatgcagtggttcgcacctgtaatcccaacaccttgggaggccaaggcaggcagatcacttgaggttaggagttccagacaagcccggccaatatggtgaaaccccatctctactaaaaatacaaaaattagccaggcgtggtgttgggcacctgtcatcccagctactcaggaggctgaagcaggagaatcacttgaacccgggaggcacaggttgcagtgaggcgagattgcgccactgcactccagcctgggtaacagagcaagactccatctaaaataaataaataaataaaaagtgttttaaaggaaagaaaatacctgtaaccatgatcggagttatgatgataaggcctaggatgctacgggatcagacggggcaggaggtcaggagaggggagcagttggtcttatctcctatttctctgtcccccattcccccttactgtatctcagaaagaaatcatcaactctgtccctgtctcagtttccccatcaatgagagaatacaactcaagtttgatatttctctatggccctagctgctgctactttacttctccttctcatggtccttatgtcccagaagaggaaactcaagataccctgaagttcaacagcttaaggtcattgacatcctgtaaagttggtgcccatctgatagtcataggattagatgaaccaagcactcagaatcatgccctgcaagtggttaagtactcaaaaactattacttcaacaaacacctgttggatgctatggtttgactctgtgtcctctcccaaatctcaccttgaattgtactcccataattcccgtgtgttgtgggagggacccagtgggagataattgaatcacgggggcgggttcccccatactgttctcatggtggtaagcctcacgagatctgatggttttatcagggggttccgcttttgcatcttcctcattctcgctgcctgctgccgtccatgtaagaccggacttgctcctccttgacttccgccatgattatggggcttccccagccaagtggaactataagtccagttaaacctttctgttgtaaattgcccagtctcgggtatgtctttatcagcagcgtgaaaacggactaatacagatgcccatggcctgctctggtaggtagcctatgctctggaatgttcccacgaggaccaatgtccaagcgagctggcctgctcttaagtgtgtccctcagccctggctgtgtggcctgcgtcccccagggcaggcagtcagtctctcccctatcctagagctgcctctgatagggctgcaagagttcctgagaagaaaatgaggctgagcagtgcctgggaaagtcaatggagatttgtttttttctcaccaacaggaaaacaattgcttatcgaactctacaccaggccaagggcactgagccatccgcccccagcaaggctgcttttaatcggcctccttggcaagctggcatctggcccgggcctccctcacagctctgacggagtctcggcctctgcggtctgttggaggatggagaggagagacagctcagaccccgggcagggacgtcggcgctggcagggcaagcgtgaaaccccagagctcagcagagaggagccccagggacgcaggccctgacaggaagagatgcatccaggggcttctggcctcacagacacctagagtctaggccagtgtcctgaacggtttgggggtcacagaccctacaaagatctgatgaaagctaccaacactctgtgcagaagaaatcatgcaaaaagacaatagtttagcctggaaacagcaacggctaacattcaactgagctctcatcaggcacccagcacggagataaccgcctggccatgtaaccctcacaggaccaggccctctgccagggaaggacagtgaagcattcgattccagagggcggagcgtgagaggaggacttttttgcaaagttgcttggatttgacaaaatgtcagccctggccctgcatccttccccatgaaatccaggcagaggccatcccccaaggccttgcctctaccctgttccctctcacagggcagctcatcacgagccaccagagccttcctggagcagatggacccgggacccgggccaggatgagggaaacgctccttcctctgccaggaagctgagtggcgcaggcctccaggaaacaccttctcatttcctaggggctgtttccaacctgcatccgctacctcccgcgcagcaagctgccagtgggtgccaaagaggtgctcccgagcccggacacacctgtgcaggctcccccgaggttgcctcatcctgggcacaacaaaaaggcccaaaacagctccgaggatcctgccaaggccacggacgatgtcctgcccgggacatcaatgtcctccttgggaaaatgggctcagccagccaaagtcagggaccccaaacggagggaccggctaaagccatggcagaagaacatggattgtgaagattttatggacatttattagttccccaaattaatacttttgtaatttcttatgcctgtctttactgcaatctctaaacataaattgtaaagatttcatggacacttatcacttccccaatcaataccctcgtgatttcttatgcctgtcttatttaatctcttaatcctgtcagttgaggaggatgtatatcgtctcaggaccctgtgataattgcattaactgcacaaattgtacagcatgtgtgtttgtgcaatatgaaatctgagcaccttgaaaaaagaacaggataacagcaatcgttcagggaataagagagataaccttaaactctgatcgccggtgagccgggcagaacagagccatatttctcttctttcaaaagcaaatgggagaaatatcgctgaattctttttctcagcatggaacgtccctgagaaagagaatgcgtacctaggggtaggtctctgaactggcaccccctggggcgtacctgtctcttatggtcgagattgcagaggtgagatagactccagtctcccatagcgctcccatctcccatagcgctcccaggcttattaggaaggggaaattcccacctgataaattttggtcagaccggttgatctcaaaaccctgtctcctgataagatgttatcaatgacaatgttgcccgaaacttcattagcaattttaatttcacctgggtcctgtggtcctgtgatctcaccctgcctccacttgccttgtgatattctattaccctgttaagtacttgatgtctgtcacccacacctattcgcacactccctccccttttgaaaatccctaataaaaacttgctggtttttgtggcttgtggggcatcacggaacctaccgacatgtgatgtctcccccggatgcccagctttaaaatttctctcttttgtactctgtccctttatttctcaagccagccgacgcttaggaaaatagaaaagaacctatgtgattatcggggcaggtcccccgctagacgcgggcctccaggaaacacattctcatttcctaggggctgtttccaacctgcatccgctacctcccgcgcagcaagctgccagtgggtgccaaagaggtgctcccaagcccggacacacctgtgcaggctcccctgaggttgcctcatcccgggcacaacaaaaaggcccaaaacagctccgaggatcctgccaaggctacggatgatgtcctgcccgggacatcaatgtcctccttgggaaaatgggctcagccacaccctgtctcacatggggaaactgaggcccacagaggtcctcaaggaaatgcgttcattcattcattcattcatttgttcttacatgtagtaattataaagcaatgatcacgtgctggataaacaaaacagatgtggtttttgccctcgaggggactgacagtccaatgagggggaccaacatttaaaagtaggtgcacaaggccgggtgcggtggctcatgcctggaatcccagcactttgggaggccgagacgggtggatcacctgaggtcaggagttcaagactagcctggccaaatggtgaaaccccgtctctactaaaaatacaaaaatagccaggtgtggtggcgggcacctgtaatctcagctacttgggaggctgaggcaggagaatcgcttgagcctgggaggcagagattgtggtgagccaagattgggccattgcactctagcctgggtgacaaagcgagagtccatcttgaaaaagaaaaagtaggtcccaagtgaatctataagcacagactggggcagaagaccaggatatgatcaaagagaataccagaggggaccactttagatttgaagggaggcggtgggtgaaagaaggcccctcttggtgaacgtctattaggctgagacctacagggtgagtagatactaaaggagcaggaacttgttcccagcagaggaaacagcttctgagaaggccctctgtggaaaagaggcgggagagtggaggcaacagaaacaagtttcctgggtctggagcccgggagcaggaacaaagtggggaaggaggggctggaagggctacagctttgtgggaagtggatgatgacgacgagagggcagcccagggcaatgctacagggactgggctcagaccctgctgtgagttgaactgtgtcccccaaaaatgttatgtggcagttctaaccctcaggacctcagaatgtggccttatttggagacaggtctttacagagattatgaagttaaaatgaggtcattagggtgggccccagtccaacaggcctagtccaataaatgggaaaggtagacacacagccagccagcacggagggggaaggccacacggagatggaggcggagacgatgctccttctagaggccaaggagcatcagagattatcaacaaccaccagcagccaggagaggcctggaacagactcccctcggagccttcagaagggacgaaccctgccaaggcttgatcccagacttctggcctccagaaatgacagaatatatgtctgttcttttttttcttttcttttctttttgacagagtcttgctctgtcccccgggctggagtgcaatggcgcaatttcggcttactgcaacctccgcctcccaagttcaagtgcttctcctgcctcagcctcctgagtagttgggattacaggcacccaccaccatgcccggctaatttttgtatttttagtggagacagggtttcaccatgttggtcaggctggtctcaaactactgacctcagatgatccacccgcctcagcctcccaaagtgctgagattacaggcatgagccaccacgccctgcctaatatctctgttctttaagccgcccagtgtgagacttggtcacggcttctctaggaagataatacagcaccccacccaaccagtggggttcggagaagccggctgccttggaggccacagactctgaggcatttcccaaagctctagcgggagacctgagaggctcggctgcatccacggaggcggtgctggaatatttcagacccagggccctagcccagctaagcagggttatcagatccagtgacaccaactgttacaactggctctctccttcagcgctctttaatttggggccactgaaacaactgagtccgcaaaaacaaaggccctcccttgtcagatggcaatagagatatctcaggcctcagagaccccatcctcatcatagtccctagaacaaaaacgttgcaaatgatgactcctgtgtgacatctggccaccgatatactggccttacaccaggttcaaagctatctgaagaagtggtggctcatggccgtaatcccagcactctgggagaccgaggtgggaggatgacttgatgctgaattcaagatcagcctgggcaacatagtgagaccccatctctacaaaaaaaattttttaaattagttgggcatggtactcacacctgtagtcccagctactcaggaggctgaggcgggaggatggcttgagcccaggagttggaggctgcagtgaactatgattgcaccactgcactccagcctgggtggcagaatgagatcctttcgctaaataaataaataaataaataaataaccatttgaatgagatgccaacatttcagagccaggagatttcagataaaagtgcaaatttacagattttcttgaagaactgcacactgatagcactgggcctgtgttctatcctggcaaccactcgctgcagctctgggcaggggacacactcaccagcacgccacagtcctcaccacttcccagtgcctctccaaagctgaggacaggctgcctgccacggcccacgccctcccctcggcccacatctcatgccctgcctctccgctacaggtgtctgagtctgcagcccctgctttcaagtcactgaatgtcagtgcaaagacaggtgcacatcagtggtcacctgctctgaccatttcattccaccaatgaggaaaatgaaggttcagaaggatttactgatttgcccaaagtcacgcagtggttctaggcagggcgacaattgggctgagttttgttgttcttgtttatttttatttttatttatttacttatttttgagatggagtctcgctctgttgcccaggctagaatgcagtggtgtgatctcggctcagcgcaacctctgcctcccaggtttaagcaattctcctgcttcagcttcccaagtagctggggattacaggcacgccaccatgcccagctaatttttgtgttttttggtggagacagggtttcaccatgttgcccaggctggtctcgaacttctgacttcaagtgatccacctgccttggcctcccaaagtgctgggattacaggcatgagtcaccgcacccggccgggctgagtttttcaggaaggggccaacaattacaggcatagccctgccatgtccacatattgcgtcctgaataaagtccaggctggaccaaaatctctaacaagggatttgggcaggcagcccattcctctgccttgctgggacctcgacctgtgtttgagagagatgagagcgaaagcacagggtctcaaagtgcttggaggagaaatgcacaggatttgggcacagggacatggacatgactaactcatgagagctgtggctttggcctccttgtttacagctgaattcccgggcctagaactttctaggacactgctcgcactcagtaaatactgactagaagttgttgtttatttcttctgtcccaaggccactcagaaggtcagaagctttctttagctggcctagagttgaagtttctttagtctgataacagcagcccaatttatgtctgggaagccatccctccatatgagaggtggccctacagggctgaccccaccatcagcttcagagatttgcatgtgactcaagcctggccagctggctatcaattgctctggtcaagtgggtaactcaagaatagatatgaggccgggcacagtggttcacgcctgtaatcccagcactttgggaggccaaggcggacagatcacttgaggccaggagttcgagaccagcctagccaacatggtgaaactccacctctactataaatacagaaattagccaggtatggtggcgcatgcctgttatcccagctactcaggaggctgaggcacgagaatcacttgaacccgggagggggaggttgcagtgagccaagattgcaccaccgcactccagcctgggcaacagagcaggaccttatctaaaaaagaaacagagtagatgtgtgggccaggcatggtggctcacgcctgtgctcctagcactgtggaagtctgaggtgggcagatcccttgagcccaggagtttgagaccagcctgggcaacacggcgagacctcatcgctacaaaaatacaaaaaaaacctagctgggcatggtggcgtacacctgtagtcccagctactagggaggctgaggtgggaggatcgcttgagctggggaggttgatgcagcagtgagccgtgatcatgccaccgcactctagcctgggtgacagagtgagaccctgtctcaaaaaagagagtagatgtgtgacccaagtcagtctattgggtcttattctgtgattttgtggaagtgttgaaaagaaagaatgtcctttctgttgaacctagagctcagaggatatattcctaaagctaccaggggctggagagaaccctgcctcagaatgaagtctaagaagagagaagagaggtaatggatggaaaagagctgaggttgaagacactgtttaggcacctggattcagccatgcctgaagctcatgtacctcaatttttaactacatgagccaacatatttccatttttgcttaagctatttcgtgattagttttccatcatttacagtcaagggccctgacttagaaatgacagagctgactgacagggaagctgctgtctccctacaccccagggctctcatccaggccaaactgccaggcagctacaaggcctctggcaacctggacagccttcaccttgacaggcaacttgacttccaacactgcttttctctttcttttaatcttaaaacatcaaggatggggcagggaagggctgatgaacagggagaggagaagaaactggcattttcaacacaagaatcgcattgctgcagatgcagtgatactaatggttagccttcttgagtgcttggcactcttctaatcctgcatcatctcatttaactgtcacaaccaccttatgagttatagatactgttttgtttggtttggtttggtttgatttggtttggttgaggcagggtctcactctgtcacccaggctggagtacagtggcacaatcttggctcactgcagccttgatctcccgggctcaagcattcctcccacctcagccccccaagtagctgcaactacaggtgcgcaccactacgcctggctaaataggtcctgctattatccctgttccaccagtggggaaactgaggcacagagagcctggctgacttgctcacaatcatccagcttctgagtgcttcaggagggcacaagtgtgaatgctcactatatagaagctattgccaagaaagaactttggcagttactgaattcacgaccctcagttggcttcctttttttggggggcggggcggttggggacagggtctcactctattgcccaggctggaatgcagtggtgcaatcatagttcactgcagcctcgaactcctgggctcaggtgatcctcccaccttacctcccaagtatctgggactacaggcatacaccaccacacttggctaattttttgtatttttggtagagatggggttttgccatgttgcccaggctgttctcaaactcctgggctcaagtgatccacctgcctcagcctcccaaagtgctgggattataggcatgagccactgtgcctagctggtttcaatttattttaaaacgaaatctcttaaatctctaatcctgccgtgctaactcttcatcttcccctctagcccttgtccatatgcatcacattttacaaaattaaaaatagcgtatgcatatcatttcacatccttgcttccatgtgtcataagagcacattctcacatggcttttgcaatcagcgcaacagaggctgcagatggagtcaccgagactcagagaagttgagatgacctcatccaggcagcccagcaggctcgcagttgggccaggaggagatccaggtggcctgccctgcagcccagtgacccttgaggccctggatactcacagagtaagcagttcccctgtcttgctgcttgccagggccaactgtcttaagaattcttaggcagctattacttagtcagtaatgaaatatcactgaaagaatggccccagtcacgcagtcagacatctaaagccagctgtgggccaggtacagtggtggctcacgcctataatgctagtgctttgggaggccgaagcaggaagatcgcttgaggccaggattcgagaccagcttgggcaacacagcaagaccccatcaccacacaaaaaaatgtttacattagccaagtgtggtgctgcacacctgtggtcccagctccgtcagaggctgaggtgagaggatcccttgaggccaggaggttggggctgtactgagctatgattgcaccattgcattccagcctgtgcaacagagaaaggctctgtctcgaaaatttttaaatttaaaaaatataaataaaaataaaaccaggtgtgcatgggtggccccagccttgaagtgtgaggagcttacgaatgtgtgggtgagtttgggtatgtgtttagaggagggaggtatttggaaataaagtgtagaaaccatcttccttccttcctcttcccccactgcatccctctcaatctttcactgaaccaaaggaagaggttggaaaacaactggaatttcagtttgtaatgaacaagaaaaagacttctacccagcatgctcttggcaaatcagagatggagagggccagctcgaaacccacaggcatcggtgcctgggctacccacggcccctctccctccctcctccccaccttttggacatcatgctaaatctagctgcaagcctcctcagctgagggacaagaagagtgcagggagccagctctgcagctctgcggggcccaacgtccccacacctggacctagagggcagaactgtccaggatgaaccgaataaaatatttctctgccagaagccttgaaggcaataccccaaagcacatttcaaaaatgaaaaagggagtgtgctctcccttctgcaccctggcccccgcaaaacactggttccccatttaaacttctctaacagaagcttctctcaggcaccacccacaatgctcctaccccacccgctgggttcctgcctcatgcctaagccacgtgggcagaggggcaacaccttggcctccccactgactcccacccccctttcctccgaggaccaccatccctctcttttccaggttgggattagcatttttatctctgcaactgccatctctcaactatttacagaagccaccaggataaaaagaggcaacataaaaatagttgctcagcagctttcaggatggggtggggtgggggtgggggcactacagaatcttctcattttctttcattccttttcaaaagggaaaggatgtcagaattgttcatcttttccaaaaggctctgagaccactcacctgggacaggaaccaagtcccagtatttctcagttccccagggtatagcctgtcaccagcaccaatccccccaccccaccccaaccaaaagagcgggctgggtgaagggttgagcctgcagagccagggcgccccactatgctccgtttccgtcacctcctgggcctccttcaagctttccaaaaagcgagccagtttaaaaaaacaaagcaaaactgtggcttttattctatgcttaaaatgtttcataagtgaaaaaaaaaaacttcagtggccattctacaaacatgactgaaaccgaaacactggcagctaaaataatccctttcccatttggatcactaacgtccccaacggggaaagcagcagccaggggtcttccctacaaaatctaacagaactcacatcattttaaagatgtcttttttattattattatcttggttttgttgagaaaggggtccaatcagggaagaaaacaaataataattctaaatcttatttctcagagcccaaaactattcggaaatgctttccatcccataacctgccagggaaggtggactccactccatcagaaaacgagcataatttgccagtacaaggagccaaagttgggagcgatggctcatgcctgtaatcccagcactttcggagactgaggcgggcggatcacctgaggtcaggagttcgagaccagcctggcctacatggtgaaacctcgtctctactaaaaatacaaaaattagccaggcatgatgggacgtgcctgtaattccagctacttggaaggttgaggcacgacaatcgcctgaacccaggaggcagaggttgcggtgagctgagatcatgctactgcactccagcctgagagacagagcaagaccctgtctttaaaaaaaaaaaaaaaaaaggcggggggggagccaagggaggcctaagacctcaggaagagaaggtacatcaggaaaggatacagatcccagaggaccttgagccttgattttctcatctgtgaaatggtgccagacctacctaagagggtggctatagagttgatcttctctatggcagtccctagtacacagcgtggctcaagctaattgttccgcaaagatcacgtcctcccttcctttctgtactccgcttcccttgtctggaacatggaagggttcaggagctgatctctgctggccttcctctcaggccagctttccatttctgctttctgggcgggtattcctggcaaagctatcaggacagaatgggctgactccactcacggccacagggccgtggcactatctctctgcttttctctactttgtggatttacttacctggaaaaaagtctcacaaaatatatactaataaaatcacatggggaccttcatttaacaaaacagggctggttgtaatggctgacaactgtaatcccagcacttttggaggccaaggcaggaggatcacttgagcccaagagtttcagactagcctgggcaacaaagcaagaccctgtctctacaaaaaaattaaaaatattagccaggcgtggtggcgcagggctgtaggcccagctactcaggaggctgaggcaggaggatctcttgagcctgggaggttgaggctacggtgggccatgatggcaacactgcactccagcctgggcgactgagtgagatcccatctcaaaacacacaaaaaatcatcgtaactgaaaagaatggaactgaataaaaccaagactgtccctgaaaattgtaatgaaatgtgatgaactacatcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcatcgctgggctctgtcgctcaggctggagtgcagtggcgcaattttggctcaccgcagcctcaacctcctgggttcaagagattctcccacctctggctcccgagtagctgggattacaggcgtgcgtcgccacatccggctatttttttttttttttttttttggatttttagtagagatagggtttcaccacgttggccaggctggtctcgaacacctgacctcatgtgatccgcccgcctccgcctcctgaagccttaggactacaggagtgagtcactgtactcagccagccgcatgatgttttcaaggttcatccatgttgcagtatgtatcagtacttcattccttttttggtctaataatattccactgcatagagagaccacatttcctttaaccatttctcagataatggacatttgggttgtttttactttttgactattatgaataatgctgctaagaaccattagcatgtacgtttttctgtggacctaggttttcatttctctcgggtatacacctaggagtggaatttctgggtcttatggtaactctgtatgttttaacatttttgggccgggcgcggtggctcacgcctgtaatcccagcactttgggaggccgaggtgggcggatcacgaggtcaggagatcgagaccatcctggctaacacggtgaaacccgtctctactaaaaatacaaaaaactagccgggcgcggtggcgggcgcctgtagtcccagctacttgggaggctgaggcaggagaatggcgtgaacccaggagacggagcttgcagtgagcagaaatcgcgccattgcactccagcctgggcgacagagcgagactccgtctcaaaaaaaaaaaaatttttttttttaagaattgtcaggcattttcatagcagctgcatcattttacattcccaccattcatgtatgaagattccaaattctccacatcctcaccatctattttctttctttttaatgttacccatccttgcaggcgcacagcggtatccatggatttgatgtgcatttccttgatagttaatgatgttgagcatctttcatgtgcttattaactctggaggtagacctgccaggccttttctaatgagggacaaccatggctttgtaccccaagaacatttttattaagttgctttgtgtctagatcattaggagaattaattaatactttctcttccaatgaagctcagctgcgtcctacatcgtgaatgaaaggctttctgtacatttttccaaaaaaaacctaggactattatggataagaagtgacattatctgagcagcacttgaagcaagagaaatacatactctgatgcattatttcagtctaaggaagtggcctgccacgcactctctctctctccgtgtgttttaatctaatatagcacaacttgtcgaagcaaatctataatgtatataaataacagaacagtcttaggtcctcatgaagagcgaactgacttttttatgtttaaaatcttaaatactggttaagttagaggtgagattaaaaagtgtaggaaaatcggctgggcccggtggctaatctcagcactttggaaggccgaggtgggcggctcacctgaggccaggagttctagaccagcctggccaacacagtgaaaaccagtctctactaaaaatagaaaaaattagccgggtgtggggcgggcgcacgaagtcccagctactagggaggctgaggcaggagaatcctttgaacccgggagacggaggttgcagtgagccgagatcacactattgcactccagcctgggcaagagcaagaccttgtcaaaaataaaaaaaaggtgtaggaaaataaactgtcatccagtacagctgaagaaatcgataccttaatttacaacctcagtttctctgtccaaaggcaattccaagactcgagcaaattcttttattatgctacgattttggttattttgaatacagcttttcaaagagcccttgggatttgagagcccttggttttctaagtgttttcaataagtcttgtttttaaaggccgcgtcctagcgagtgcagctgccgctccttaccggacccacgagtgaggagccccgaggtcatcaccgagcatgaacgcgggaacgtctgggaaggaaatctgaggccctgctctgacggtcataacaaaggccttcgagccaaccggcgtgttcaaattcaccacggcccttcccgcgctcccctccccggaaacttgaccacctagcccagaaagccgcagcagcttcctcagggacgctatctcccatttcaaacacccaaccgagaaagcagcgccgcagcgcgccttccgccacgcccaggtccgcaggtcttcgctcggggcggaaaagaatcctccccgcgcactcccagccaggaggaacgccagaggccccgcccaatccctgtcgcttcattggctctggtgaccggcctcccgaaagtcggcttcctattggtcgtcgtggccgccgctctgcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggtgaggggccggtggagccggacagaccctcctcgccaatcctatcctgccagggcacctgaagcgcctcctttctttccgccttagcggttacctagtcgtcatctcggagagctgcgctgaggggggtcgcttgcccggcttcaggtgccccaaccgagccagggcaggctgccggaccctctcgagctcctccagtgccacccccgtcagcgacccgagcggtggggagaagccgggcgtccctagcgttcgcgccgggtgggcccctctctgcgccgggccctgtgcgcctcctcgggggcctgaggcagagccgccagggctcgcctgagcctcggtcccttggcgcgcggcgtgccctttcccgccccgagtccttgaactaacccaagtgttggggacatcgtgggaccgaggagaacaggaggggtgcagggggtggtgaggctagggccaggctaacgggttaaagaactctcagggtggggatgccacccggaaggggtgcttcgtaggctgcacgtcggggccgcgaactagagaaggctggatgtgcctccatcgccactaggtaaacgcagcaaggaatttggcagcttgagttctccaaggtgggagtgagagcgtgggagcattactgatgagaagttgaagaaaaggggaaaggggagcggggtttccggcctacttctgagagatgattctcaacccgatcactgagagttctgaagagctttgtgaacagcagtcagttcagggtattgattcatttgccgaactcaaaccaagtgggatgagtcataaggtgatgataactttcagacctagatggtttcgttaatctcagtgcagaggtgtgctgggggtgggtaatctagcaggtgagctgctagattaacgctgtctccataaagcgtcaaagatttactatagaagattgaaaaagagtgtcagctggtcacagaaattcagcacatgttttgttgaacgttttctgtgcgttagccaagagggagacatggtgaagagaagtaattcaaaatacagtctcatcccttaggaaggcagtttaccattcaaaagaagagttatttgtaagtaaccatattacaaggcagaaggctataggtatcaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttgtggcccattaaggaactagctatcgaaggaaagaattagagacaggtccagtgttgaaatttttaaacaagttctttgaaaacagacgtgtgttttgaattgaagtggaaggtactactttctaagatgaaattttagaaacaaagtttggtggcaattgaaattatagaaaagatacgtattttcagaagcaaaatatggacctgaatagacatcagcctgtgccagatgacagttataaatgatgcttttgtttttgtgaaactggatttacaccattgaggatttgggctgttaaatgtttattatttaacttaatgttgatttatattgaaattgtttaattgtgggtatgctcatctgtagatttctgggcagagactgattcctgatgtcatggaatgctaacatgtgaatgttcatgtaaggaaatacttctttctgtggaattaaaattacattaaaagctaagcaagtatacctggccgggtgcaatagctcacgcctataatcccagcactttgggaggccaaggcagatggatcacttgaggtcaggagttcgagaacagcttggccaacatagcaaaaccctgtctcgattaaaaattattttaaaaagaaaaaaaggaaaaaaaaagttaagcagttaaaaataaacaagaaaagctaagcaattatatggataagtacatgttcactcaaacctggagcagctggttttagtatatgtacggaatgggtatttactttctccctttggcgttttggtttggtttggtttggtttggtttagaaactgatgttttgaaataggtcttacctctcagactcaagtaactttttaaccttgcagtaacatccaatcaacttcctataagggattaaaaaaaaaaatccaaattggtgccctgtgttaatttgatttaatcctctttcccatttttccttatttatattgatctcaccattaattgtgctaatctgggttcttccaagctcaaaatgagatatcaaggagaaagtaatctactgaatgtaattccttttcctttttttttctctgaaaggtgggggagtggtactaaggatcaagtatactgttaaaagaaaacaaaaacccaagcatgaggaaggtaacatttgtatctatagcacatgttattgtaataatcgatcagtttggccaatgtcttgtctaaaagtattacattttagagttcatcatctgtttttgcaacctgcttaatgtccaaatggtatgagagaaataatttaggatgtagaattccttcctttgtggtatatggtcggatatttggtcactaagaaagagttaggtccctgcatattgtatttcagttgaagcagcagttttgataagaaatcctttcacattctaaggagcatatgtttctcaaatggctctaaataggataaagaggccgggcgcggtggctcacgcctgtagtcccagcactttgggaggccgaggcaggcagatcacaaggtcaggaggttgagaccatcctggctaacacagtgaaaccctgtctctactaaaaatacaaaaaattagctggatgtggtggcgggcgcctgtagtcccagctactctggaggctgaggcaggagaatggcgtgaacccgggaggcagagtttgcagtgagccaagattgcgccactgcactccagcctgggcaacagagcaagactctgtctccaaaaaaaaaaaccaaaacaaaaaaaaaaaaggataaagattttgcttttttatcaactgttttttctgctttgcttttagttatgtaggaaagtttaacctaaccaagattaaactgtaaaaccgattattttatatcaccgttgctaagatttaatacatctttttcctgtcgtttaacacaggacattgagttttagcaaactgaaggttgtccagagtttgaaacaaaccctggacatatagtgggtgagttctctgaggaagctttcattgatggaagaacagtatcgctccttggtccttgtagattcatgtagcatctgagacaattatttttgaatttaaaacttctaggttcatccttaaaataactgtgtaaataatatatttaacttagagttatggcaagcaaggtagacgcttatgagaagagtctatgggtttattattacattgctatttacctagtttaataaaaagtgaatgactgtgtagtaacatattagagttttggcaagcaagatagactcttacgagaagagtctatggcattattattaccttgctatttacctagtttaataaaaagtgaatgacttagatcatttagttttctgtttcttttttttttttttgagatggaatctcactctgtcgccaggctggagtgcagtggcacgatctcagctcactgcaacctctgcctctcgggttcaaacagttctcctgcctcagcttcccaagtagctgccatgcccggctaattttttttttttttcttcgtatttagtagagacggagtttcacaatgttgcccaggctggtcccaaactcctgagctcaggcagtccacttgccttggcctcccaaactgctaggattacaggcttgagccatggcacctggcctagttgtctgttttcatactcataaactttcttttcccactctccccctatacttctcttgtgtctggctgtcatttaatctttttttttttttttttttttttttgagatggagtctctctttgttgcccaggctggagtgcggtggcaccatctcagcttactgcagtctccgcctcaagtgattctcctgcctcagcctcctgtgtagctgggactacagttgtgcaccaccacacccagctaattttttttggtatttttagtagagaccgggtttcaccatcttggctaggctggtcttgaactcctgacctcaagtgattctggcctcctaaagtgctgggattagaggtgtgagctactgcgcccagcctgtcatttaatcttcatggaaactaccatagcttttctgattcttcgttctagtctggctggttgataatatatttaatggaatcattaaaagtttagggttgaaaatttgtggtaaatttgtgaattctttaaattgagcattttgaagtattttctccccacagggattctgaaaacatattagattatacacacacagaagcaaagacagctgaaccttgaggccatttgaaaatcctggcactgtgccagaaagagagctgggctgctgctcttgcaaagaaacagaacacctttcctcttgcttttgttgactgtaatgatgtttcatgggcttatattgtttgactctgactgaggaacctgagagagtccttataaccttattggctggaaactgtcattcctactcttacgcagattatttaggtttgtattctttcccctcccatttgcttcctctcctttgctcctacagaggggagggggcttctaattcatttttggggagggaacagtatgggagaaacactgtcagtctctgctatgggaggaaaaagagggacttgaatattgaggagtttcagtgaaggaactgacatgcttggctcagtactttctgggaccttctcacatttgtcttcctgtagtgaagatggagttctggtctccactcaactagctggtaagctgctcttggtcagctgtatattatccagacttggctacagagctaaggttctgttctccagttgatgctatcagtaaaaacaaacattttaatttccatttgtcttcttgctttttttttctttttgagacagggtcttgctctgtcacctaggctggagtgcagtggtgcaatctctgcttaccgcaacctccgtctcccaggttcaagcagttctcctgcctcacccttctgagtagctaggattacaggcatccaccaccatacctggctaatttttgtatttttagtagagacggggtttcaccatgttgaccaggctggtctggaactcctgacctcagatgatcctcctgcctcggcctcccaaagtgctgggatcacaggcgtgagccaccgtgtccggcctctgtcttatttcttttttttttttcttgagacggagtcttgctctgttgcccaggctggagtgcagtggtgcaatctcggctcactgcaagctctgcctcccaggttcacgccattctcctgcctcagcctcctgagtagctgggactacaagtgcctgctaccacgtccagctaattttttgtatttttagtagagacggggtttcaccatgttagccaggatggtctcgatctcctgaccttgtgatctgcctgcctcggcctcccaaagtgctgggattacatgagccaccgtgcccggcctgtcttatttcttaattagctccaaattggatgtggaaaaaaggtactgttactggctccctaaaatcttggtgcactgtctttgaagaaaagaggagaactggcattggataccagaatgacatgaggatatctaggtgtctgaggcagtccaggcaggttttagaatttgatttcttattatggaatgtgtaagttgttgttgttgttgttgtttgagacagactcttgctgtgtcgcccaggctggagtgcagtggcgtgatctcagctcactgcagcctccgcctcccatttcaagtgattcttgtgcctcaacctccccagtggctgggactacaggcacttgccaccacgcctgactaattttttgtatttcagtagagatggcgtttcaccacgttgcccacgctggtctcgaactcctgagctcaagcaatccgcccacttcagcctcccaaagtgctaggattacaggcgtgagccaccgcgccgggctggtgttaagtttttaaatacgatacctggtttttaactgatataagccaggcagaccatggtcctatggtggctctactgagagcagctttggcttaagagagtgggtaggaaagggattagactatcaagaacaagtcatttatttttagtaatcactgatgactagaaaataaactccaaacacaggtgaattctctgagcttggagttttgtgctaggcataggcagacagttgcctcattctcttattctctatgttgttttaaactacattcatggtcaagagaggaaatttagctatcttcacgattatcgttcttttttaaaaatataatttcaacttttagatttgggggtacacgtacagacttgttacatgggtatattgagtgacgctaaagtttggggtacagttggtcccgccagcaggtagtgaacacagtacccaacagttagtttttcaccccttgttcctttcctccctccttccccctccccccagattattgttctttctaaactgttagaaaaagggttatacttcttacataccacttggatgcatgtggtataacccatggagttttgctgccaactaaggtccccaagtaggtcatgaaagcccagatcatggcttgcattttgaaagttccagacttttcagagatctggctttgggctttattcacggaggagtaactgtagggtttttttcccccaatgaacaaataatggatggtgacccttccataaagaaggcaccactttggaattgaggccagtgaattgactgcaaattcagaagccaaaagggtatgcctagtatactgtcagaagccagaggtgggggtatgcctagtatacaacaactcagtgaattgactgcaaatgcagaagccaaaggcatatgcctagtatacaacaactcagtgaactgactgcaaattcggaagcccaagggctacgcctagtatgctgtctttccaggaattgagttttctcaaaatctaggaggaaatggagtggtttgtagaagatgcttcaatcttactatcagtatggaagcaatgaatgaataaaagaaaaataaaggaatacaggctaatttaactggaggaagatcttaaagtatagggaagacagaaatggaacaggaaagaacatgaacttaggtctctaaagcttttaaaaggagggtgcagaagagggatccttgttggttatgaccctaccggatatggtaactgggttccaaggaaatataacagaggcagagtgtgaagagctcagaaaatagattggcatatgttccccccatcccttgtccccctctccactgtaagagctcagattcaataaacccttggggaaattgtcttttaaatagttctccaattgcttttataggttctgtcaagtcataacagaaaatgtgggccaagcgtggtagctcatgcctgtaatcccagtgatttgggaggctgaagcagaaggatcccttgagccctggagtttgagatcagcctgggcagcatatcaagaccccgtctctaaaaaaataaaaataaatggccaggtgtggtggctcacgcctgtaatcccaacactttgggaggctgaggcaggcagatcacctgaggtcaggagttcgagaccagcctggccaacatggtgaaaccccgtctctactaaaaatacaaaaaattaccagggtgtgatggcaggcacttgtaatcgccagctacttgggaggctgaggcacaagaatcacttgaactcaagaggcagaggttgcagtgagccaagatcataccaccgcactccagcctgggtaacaagagtgaaactctgtctaaaaaataaaaataaaaataaaaataaataaaaactagaaaatgtgtacagatttaagaggggaaagatcagtataggacacttcaagcactgttaggtgagtgtcaaggtgacagttgtaggtagagatgcctttgccctgaggaggcatgcagaataaatttctgaaatttatgagaaagtacaggaagatgaaacatactaaaggagagccaggtagatggagtccaggcttggaaggatttatcttctggatggattcttcatcctggaggtgaagaaggacaaaaacactttgaacaatggctgcttttgatagacccagaaatcactgactttctcctcatattgggagatttcacacaagaaaacgtgcagaggagttaaggtgggaaataaaagttggggcccaaaggcaaagagcaaataaaatcaaggagagcaccaaagtccagcaaaagttacaggccaatctgtggtaaaaaggaaagggattcattgaagaatcagattgttaaaaactcaggtgaccctttctttttttttttgagatggagtcttgctcggtcacccaggctggagtgcagtggtacagtggcgtgatatctgctcactgcaacctccacctcccaggttcaaacgattctcctgcctcagcctctcgagtagcttggaccacaggcgtgcaccaccatgcccggctaatttttgtatttttagtagagacggggttttaccatgttggccaggctggtctcaaactcctgtcctcaggtgacctgctggcctcggcctcccaaactgctgggattataggcatggaccacaacacttggccaaaacttagctgaccctttcttaaaggattgggtaaaaccaaagtgggatgcaaaatactacatatcccacaacagaaaaacatgtagacaggtcttggggagtatgttgccgaggcattagttccagaactctagggccacaggcttccaaagtaaccacagccctttccactcaggaatttgtggagggtgatgtcccagctgaaacagtgtaggcaggaagaagacatcttccctttgactgagcaggtcttaagcttttaacctggcctgtatatcagaattacccagggagttttcaaaaaaattctggtgcccaggctgcaccacagaccagtgaaatcagaacctctgggcctgggaccccaggaatcagtatttttaaagacttgcctggtgagtccaacatgcagccaaggctgaaaaccattctcttaagggcagtttcacaaccctaggcaattccttagcaagaagtactgacagcagctacgaaggtacaggactaaaacacctgtttcactgaagggcagcgggggtgggtgttacctggcacttcagtgctaaaatgaatgtaaagaaattatgttcatggccaggcgtggtggctcatacctgtaatcccagcactttgggaagccgaggcgggcggatcatctgaggtcaggagttcgagaccagcctgaccaacatggagaaaccctgcctctactaaaaatacaaaattagccgggcatggtggcagatgcctgtaatcccagctactaggaggctgaggcagcagaatcggttgaacctgggaggtagaggttgcggtgagccaagatcgtgccatcgcactccaacctgggcaacaagagcgaaactccgtctcaaaaaaaaagaaaaggaattatgttcatttcagcactgggatgccaggaaatatggggcttaaaggggagatggaaattaaaattttcaaatatgctgcatggggctggcgtggtggctcatgcctgtaatcccagctctttgggaggctgaggcaggcggattacgaggtcaggagttcgagaccagcctggacaacatggtgaaaccccgtctctactaaaaatacaaaaattagccgggtgtggtggtgggtgcctgtaatcccggctacttgggaggctgaagcaggagaattgcttgaacccgggaggcagaggttgcagtgagccgagattgcgccactgcattccatcctgggcaacagagcaagattctgtctcaaaaccaccaaaaaaaaaaaaatgctggatgggaaaaaaaaaaatacttcaaatatactagtgacaggggcttcccctgcttcaaatttctgaactttccagaaggctggagtgttgcaaatgctcctctcagagatgataactataagtggatttgcccttcaatatgatgctaaggttattctctcactgggagatcatgttctcattggaagattttgcccaaatttaagttcagagattctaatgaggctgcaacctaaatttttcaggattgcttctttaccttctattcctgtagtatttggctgacagtagttaatatgtgtctgagttgtactgaatattgggttatagcaacatttttgcctgggacactttggaggttggcttgggcttttttgttgtttgtttttgagacagggtctcactccgtcacccaggctggagtgcggtggcgtaagcatagctcaccatagtctcaacctcccaggctcaagagatccttttgcctcagcctccgagtagctgggagcacaggcacatgccaccacacctggctaattttattttttgtagagatagagtctccctatgttgcccaggctggtcttgacctggcctcaaacaatcctcccaccttggccacctaaagtgctgggattacaggtgtgagccaccattcctggcctgtttttaattttttattttataatgagggctaaattaagtgtttttcttcattttctttctggggaacaaagaggaaattcccttccttgtatagaaacgtgaggaatgggacaaaattgtccccctccaaaattggtatctacacagagaatccatctgttttcccaaaataagtccttctattccctttaccagagctgtgtagttgaaaaaaaaattttcagcctagaattttaatgctcatactcattaacatggtttgaaaaattgtattcttccctaattcattgtaaaactatccctgatacaaaggtcataatctctgacagtgctgcttttaaaaaggggtgtcatttgagatttttggttttctttaccaagaaaacatattttgaactttctaaatagcatgtaaaattttataatgttacattgtctgtgaagagataataggaattttttacacagttacttgtcagtcataccatggtggaaagaggagcaggagaaaaagaagtttttgtccatgaggaactttcactgtagtccaggaggcaacatcagacatgaattagaagggggataaaagctaagagagctgttggtttagtagctacattagtaggaagctaaacttgtaaaactgcacttctgttaaccctggaatgaagagaagtttatcctgggagtactttctgcagttgaggtatttttttccccaaaaaatgtaacgtgcaaactaaattttttagaacaaagtttttccagttttaagagtgcatactctaaagaactgtggatgaatcctttacttaaaagaacattaactttattattattaattttttttgagatggagtctcgctctgtcacccaggctggagtgcagtggcgcaatcttggctcactgcaaactccgcctcctgggttcaagcgattctcctgcctcagcctcccgactagctgggactacaggcacgtgccaccatgcccaactaatcttttttttttttttttttttttttttggaaatggagtcccgctctgttgcccaggctggagtacagtggcgcaatctcggctcactgcaagctctgcctcccgggttcacgccattctcccaccttagcctcccgagtagctgggactacaggtgcccgccaccacgccaggctaattttgtttttgtttttttagtagagatggggtttcaccgtgtcagccaggatggtcttgatctcctgacctcatgatctgcctgccttgtcctcccaaactgctaggattacaggggtgagccaccacgcctggcctaatttttgtgtttttagtagagatggggttttgccatgttggtcagtccagtctcgaactcctgacttcatgtgatccacccgccttggcctcccaaagtgatgagattacagatgtgagccattgtgcctggctgaacactaactttaaattaactcttagtgaatctagatgttcatgcttttttttttttttttttgagatggagtctcgctgtgtcacccaggctggagtgcagtggcgtgatctcggctcactgcaacctctgcctcctgggttcaagtaattctcctgccttagcctcccaagtagctgggattacaggtgcctgggccagctatttttgtatttttagtagagacggggtttcaccatgttggccaggctggtctcgaactcttgacctcatgatctgctcccccacctctgcctcccaaagtgctgggattacaggcatgagccattgtgcccaggctattttttttttccttcctcttttcgaggcagagtctcactctgtcacccaagctggagtgcaatggtgcgatctaggctcactgcaacctccgcctccccggttcaagcgattctcctgcctcggccttccaagtagctgggattacaggcatctgccaatacgcccagctaattttttgtatttttagtagagacggcgtttcgccatgttgtccaggctgttcttgaactcctgacctcaggagatccaccttccttggcctcccaaagtgctgggattacaggcataagccactgagcctggccagattttcatgcttttaagcacaccatggctgtagagtttgaggtatataatcatttaaaggtatggactgttataattttacctgtccttttttttttttttgagacggagttttgctcttttgcccaagctggagtgcggtggcacaatcttggttcactgcaccctccgcctcctgggttcaagcgattctcctgcctcagcctcccgagtagctgggattacagaagcctgccaccatgcccagcttttttttttttttttttttgagatggagtctcgctttgttgcccaggctggagtgcagtggtgctatctgggctcactgcaagctccgcctcccgggttcacgccattctcctgcctcagcctcccgagtagctgggactacaggccccaccagcatgcccagctaattttttgtatttttagtagagacaggtttcaccgtgttggccaggctagtcttgaactcctgatctcgtgatccacccgcctcagcctcccaaagtgctggcattacaggtgtgagccaccgcgcccggcttcacctgacttttaaaggcatcactatttcttgagaattatagggtgtgaagacttataatattgaaatccttggctttgatacttcagactgtttgaaccttgtgttgtggtttcttctttaccttctcctttctttataatacaacattacttctgggtaatagcagaaacagccattatccttctgttgcattccaaagtgccttttgcattttaaggttgagggctttttatttgctttttgttttaagagcttgctggacaaacagtccagcattttacatgctattataaaatgtttgacagaatcagataataaaataaatggaactgtattattatatgctgccattttaactaatacctcagctatctcgacttccattacctatcacattatctagattctagaatatgcttaagaattaggacaaaggcaaaagcctattcgttctaaacactatagcttttattttaagcatgggaaaatgcctttggccctcgctgaaaatttattcttttatgtatacttgggacaagcatggttatcaggtttctgagactgcagtaaaaaggagacaggttactctgggcaggtatagtgatagccctggtggctcaaagagagggaagagacaaggaaaaaaccatagaaagcaatacattagttctgggccatttagtggagtagcaaatagcccttacgccttggaaggtcatgatggttatcaactcattaaaaattatgtttagtatcttcagtttgaaaaggtaaaataaaaaaatactttcctgttgttgttgttgttttttcgagatggactctcgctctgtcgcccagcctggagtgcagtggcttgatctcggatcacaacaatctccgcctcccgaattcaagcaattctcgtgcctttggccctcgctgaaagctgggaggctgggcacggtggctcatgcctgtaatcccagcacttcgggaggccgaggtgggtggatcacctgaggtcaggagttcgagaccagccatggtcaacatggtgaaaccctgtgtctaccaaaaatacaaaaaattagctgggcatggtggcggatgcctgtaatcccagctgctggggaggctgagacaggagaatcgcttgaacccgggaggcggacgttgcattgagccgagatcacgccattacactccagcctgggcaacaagagtgaagttccatctcaagaaaaaaaagaatttggaaagtagagaaaatttcagagaaaataaattacacataatacattaaaatctattctggtttgtctacaacttcaggtacaaaaaaatctagagagagtttcagttggtgttttgatgttttccaagtcatttaaaaaattatttacatatgctatagtatattatacccaattacaaatgcgaaaacagaggtttaaggaaatgaagtaatttaaatttatgggcctggcatagtggctcacacttgtaatctgagcacttcaggaggccaaggtaggcagatcacttgaggccacgcatctgagaccagcctggacaacatggtgaaacccaatctctactaaaaataaattagccaagtgtgtggcgtgtgcctgtaatcctagttactcgggaggctgaggcaggagaatcgcttgaacccaggaggtggaggttgcagtgagccgagattgcgccactgtactccagcctggttgacaatgagaccctgtttttaaataaataaatttattttaaataaataaataaattgatgttatttctgttaaataatagctgagaaaatctgccttagactgtagaactgtggtgcaatggccaccagcctaatgttgccaggtaaaatacagggtgcctgaaaatttgaatttcagatgaaaaacaaagaatttttagtatatgcatatcccaaatataccacaggacagacttttgtccagcctttttttttttttttttttttacatgcctgtgtacatgtatttgttttgggtgggtagggaggttttttgttctgtaaaatttggatcatgttctctttttgttaaacaaaagatcatgggtattggcaatgccaaatattctttggaaatagcaaaaaattctttccaaatggcttgaaatttcagtgcccagaggaatatactaatctcaaagttattgagggcaaacttacctctccagaatagcattccctgaggatcccagagagcccagattccacttagctttaaactgggggatttgtgttcctttttaggcgggtgccccgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttataagaaggtgagttggatgaaatgttacataacaacacacatggncagcattcttgattgtaggttattttgaatagctattgcccccccatttctgtttataaaaatatcaaaagctaaaatccattagccattttccatctagaaaaatacttaattggagggattatattactgctcaagttttatagacattgtttctcatgttcaggcatcctttctcctgaactttgacctgtttgtatcattttattttctattatgtttatttccaaaagcaagaaatttgttagtctgtagttttgttcacaaatgatttactgtaactatgattcagattcaagtttcaaaaaagtatcccgtaccttaactttcaaatgaataaatgaatgcaataaattaactactctttagagattcaacatcaaatacttagctaacagttattttcactaagatggaaagtcattcagagacccatcatattggtaggcctccttgctctctttgatctttagtttagtcttctgaaatacttaaggaaaaaaaatgttagcttgcaggaacaatgcagcgagcagaaacgaccacatcttagtgccctctttaagcttctctagtggcaaggctttgattgtgattaggctgtgtagtttacagattactgtattagtgggtcctgtattttcttggattcaccttgagagatcagttgcctttctctttccctgtcagtctgttatgctttttgtctcctgctctttaaatggaggaaattgttcatgtaggaaaagaccaggaagtgtgattctgctttctgctctgtgtggttcaagctctgttttgttaattacatgtttataccaaggggtggaaaggttttaattcattaacacaagagtgtgtttttcttaaagtcctatattagaacttctgtgaatccagactgccttggcaatgaatattttgattttcatggcttttgaaacatgaaaatacctctggaaatagtctggtgccactggggacttcactaagaactaaaattaaattttagtagaaggcagaaagaaaactcatgctttcataatggtttatatcttgctgtcatcaaatgcttttctttcttcagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacgagggggtaactaattacacccagggcccggcacgcttattcttggccgtatatggtggggcctttagtgcttgatgacttctgataaacttcaagtcatgtgctggagtgaagcttccacacccagctgaactctgcacttaaaggctgtcctgatgtatagtgtctgctgaggtgctaggtggctccaaagtctgctgtctgaagggtcccaaaatagctcatcagtctcttggccttagttaatttctctgtcttacacagttagacactaactgttgaagaaatggctgtgaaaaagtagcacatacacatttgtagtgttatgtgttagtgcacgtgtttcagtgaccacagaaaacaatcagtagtgtaagttagcctaatgcccatttgtcttgctacagtgaaattgttctaatttagttaatgaaagagccatctgaattagtgaaaaaatgtagttatttactaattgtaattaataatattgtcccagtgaggtccttggacatcctgattgaataacatgtaaaggcttgtaattaatatttacttgtacgtgagtgattctaaactgctgaaagaaatgttttgaacaaattttttcacgcttaattttcttctctgaagaagggggttattaaaagtagaggaaagctggatgcggtggtgtgagcctgcagtctgatacttggcaggctgaggcaagaggattgctttagttcaggagtacgaggctgcaggtgtaccatgattgcaactgtgaatagccactgtacccccagcctgggcaacatagcaagacttttttttttgtttggaggcagagtctcactctgttgcccaggctagagtgaagtggcgagatcttagttcactgcaacctctgccccgctgggttcaagcaattctcctgcctcagccttccgagtagctaggattacaccccagttaatttttgtatttttagtaaagatggggtttcaccatgttggtcaggctggtctcgaatacctgacctcaggttatctacctgccttggcctaagtgctaagattacaggcatgagccaaccgcgcctggccaagagtgtcttttaattagtaaatgaataaatgcagagggaaatttggtctaattgccttctagatatagtcctgtgtcctctaataatgttttggtcagtgatagaccacatacacggcagtggttctgtaagattataataccatatttttattgtaccttttttgtgtttagatatgtttagatacacaaatacttattactgtgttatagctgcctacagtattcagtacactaacgtgatgtacggcttcgtagccggccatgccctatagcctaggtgtgtagcaggctgtgccatctaggtttgtggaagtacactgtgatgttcgcacaatgacaaaatcgcctaaggacacattactcagaacgtctcctagtcgtcaagcaacacatactgtagtcgtaaattagataagtccaagccaggagttttattattctcccaaatgagaattggcatatttatgctgcaaacataaggcacagctgacttacataccccttttgggtatacaccaccatttgggtgatgtggattgttggatgctacagtatggtgcctggcaatcagggtggaatatttgaaattgggaaccgacctagcttattggagagctattgtcaaatatagtcaaaagaaaatatgtgaaggaaggtacataacccaaactgaagagatttgtgttttctaaagtgttctgattgagaaattttaaaaactagaattagcctcagccatcagtgaagtctagaaagccttcgttggaattagattgtctaagtacgctgtggtaggactgagatctttcaaatcagatgcccctgatgcttgggctgacccatcagagctttagcttttttctgtctgcatcttacaggctccagttaaactagccatttgcaggtactttgataatgacacagtgctgtcccatatccttaatggctttggcattccattatgggaccttcctgagagagttaatactctggttagattttataactttacacacacacaggaatttgtgttttgagctaactttatggaaggtaggttcttcatgcaattttgtagggcccaactttttggaagggtcagcagcattctgaatccaaagatgtgcattatgctggctttctggtcatcatggggagcatcaatgacaaggttttctctagtgataaatacagattgattcctgacctaatcagatacgttgtataagtgtaggtacaaagtgaaatcacttcagcaaacacagaagatgatgatgacgacgatgatgaggatgatgatgatgaagaagaaaacgcagaggatcgggtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttactataattaactatttgttacaaccctaattaaattcctcgtctctgtaaaaatgcttattttctcactaatgcctttggccggccagtaccttggttctctcaacttttaaatctaacagtagggggaaaattccctatagcccagatgttacatagttcttagcatcaactatctgtagatttctgtgtaagtcacaaaaagctgaggttaagaacttctgaactaggctgggcttggtggctcacaactgtaattctaggactttgggaggctgaggcaggaggatcacttgagcccaggagtttgagaccagcctgggcaacatagagagatcccatctctaaaaaaaaaaaaaaaaaaaaaaaaaaaccaaaaaaacctggtgtggtggcaccagcctgtggtcccagctacttgggaggctgaggggggaggattgcttgagcctgcagggagccgtggtcatgccactgcactccagcctaggtgacagagcaagactgtctcaaaacaaaacaaaacagaacaaaaacttctcaactatacattgatgaaatttggcacagaaattcttcctcagctggtaacacgatcaagccacggaacatttatggacaagaaaaaataattcagttgtatttatttttttctttttaattgtaaaaaaaatatatatgtacttaatatttttaaattgagacagggtctcactatgttgcccagactagtgctgaattaggcgtgggccaccatgcctgaccctcagtggtgttcagactaacaaatcttatgttcctatctagcttaaacagccctcccatcattaacttttatcatcttgagttttgtcctttaaaagctggttataatacagcatttgttgatgaacaggtttatgcccagaatatgcacaaaatattttggcaatcctacttcaaagatgatgtcacagtggtagatgcaggaatcttcatcctcagagctttcagaggtcgtaggctgctggctgggaaatggttttctggcagtgaggggagaagtcagttgacttcataaatgtaaatagcaactatgtacagtgcacaacgataatgccattcccacccttaagtactttgcggcgtaggatataacatggttgttattatgacagcatggtttccagtgtctttctccattaactcactgcataatctaaccctagttcaatctctggcttgggtggaacacacattttgttttgagcacagctggcatctttcctagcttgactggctccaagtcactaccaagattgttcccatatccctgacaagatactggctcctctgctttcctaagttctaaagagtgggaaggaaccctccacacagaaggagagaccaaggcccactctgatttcatcttgagttgcctagtgccttctccattggcatatctgccatctcatcccatagatcctttctccccaggtccacaccagtagtcgtgggccatgaactaagaccccagatcacaagaatctctccccatgaatggcagtaaaacatttctcttaaatctagagactactgacctttcaagcttgaattcctgttctgttccaactattcatgattccctttgatctcctctgacctgtagaaagggaagcacccaaatccatagccctatggccaaatctcaggctggggttaacttttttttaacttattcatcgtctttcttattcacagactggattttctcagatgtaaaggtgggccaagagccaggacggcccatctctttcaagttagacttcagcagggccaggaacacagatggcttgagatgattctaaggctagggagggaaggatgcacaattattcctaactttcctaagggggaactaaggctccttttcctactgagatgaggctccagagactgtggtgttcccagggctacaaagctggggcaactgagttaaattccaatagcatcctgactccaaagcccatctacagaagaccagctgagggtttctttttctagttacagaagtaatatatccctatcacagatgtcttgaattagacaaagatataaaatagaaatacatagctaacatttgttgggtacgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccagagtgcagtggcacgatcacggctcactgcagctccgcctcccgggttcacgccattctcctgcctcagcctccggagtagctgggactataggctcccgccaccacgcccggctaattttttgtatttttagtagagacgggtttcaccgtgttagccgggatggtctcgatctccagacctcgtgatctgtccgcctcggcctcccaaagtgctgggattacaggcatgagccaccgcgcccggcccgaggatttcttacagaaagtgtgaagctgtgccttgatggataagcattgtctgttgagtaacagtgatggcagaaacagatctgggtccctgggcctctatattatgggatcttaaaagataaacctaataaaattagtgtctagagttgcatttatattccttagtatagtttataaaggcttttttaaaaaatttatcacttgtatttgtgggtgaggggcatgggaagaggggagaactgaggacaccatggtcaagagacctacccagttaaataaaagggatgtctttataacttgtggctcccagggctagccacgtctgctattactataaatgcatttccctccattattaaagttataatactaaaattttggtaaataaaaggccgggtgggatcacacctgtaaccccggcactttgggaggctgaggtgggtggatcacttgaggtcaggagttcgagaccagcctggccaacacagtgaaaccccatctctactaaaaatacaaaaaaaaattagccgggcattgtgatgtgcgcctgtagtcccagctactcgggaggctgaggcaggaaatcatttgaacccaggaggtggaggttgcagtgagctgagatcacatcactgcactccagcctgggcatccgtctccaaaaaaaaaaaaaaaatagaaacagtgattctggtctcttaactctcaccttcctgctcatgttgttttttgctgtttggaattctttctggtttttaacctggctaactactatatagttattttatttaattttttatttttaaatttattttttttttaatttttttagagtggtgggatctcactccctcagtcacctgggctggagtgccgtggtgcgatcctagcttaccatagcctccacctcccaggctcaagctgtcctcctacctcagtcttctaagtagctaggactacaggcacctgccaccatgcctggctaatttttaaattttggtagagatgtagtctccctatgttgctcaggctagtcttgaactcctgggctcaagggatccacctgcctcagcttcccaaagtgctggcattacaggcatgagccaccacacctggccccctactgtatagttttaatcaaaatgtatgtagagttcatctagtagcatcccagccagacctcaactcctttactaactgtttgatttcttaaattagttaatttttggcttggtgcctagactttgggaggccaacgtgggaggatcacttgagcctaggagttcaagagcagcctgggcatgggatttcaccatgttgtccaggctggtctcgaactcctgacctcaagtaatctgcctgcttcagcctcccaaggcgctggtattacaggcgtgagccactgcgccaggccccaaatggtctttttaatggctgcattatatttcacagtaagaaaagcaacataattcaactctgtattataaattaagtctttattggacttacaggctcctttcagtttttcttcatttcaaacaatgtatgccaaaataacttccctagaagtgcaattgctgggttatccacatctaaagttggcatatatgcagtcatcttattctctgaaaaagagtctaaatttagttttaaatctcaactagactgtaatcttcttggtagctgaggttgcatactctttattccttgtggtactcttttttttttattggagacggagtcttgctctgtcgcccaggctggagtgcaatggcgtgatcttggctcactgcaacctccacctgccaggttcaagccattctcccgcctcagcctcccaagtagctgggactacaggtgtgtgccaccatgcctggctaatttttgtgtttttagtagagacggggttttgccatgttggccaggctggtcttgaactcctggcttcaggtgatctgcccaccttggcctcccaaaatgttgggattataggcatgagccactgtgcccggcctctcgtcatactctttatagacttcagcacatagtatgtctgcctaccttacaaggtttgggagaagatcaaatgagattgtgtttgtgaaaaatagtatttgtatagtgttttccagtttacaaagcactttgtattatcttatttaatctttgccaaaaacaagggagatattattatctccattttactgatgaaggaaactagaactcagaggtcacaattttgcaatgattacaaagctaagaaggaaggaacagtggatcctcagactataaatcctatgctttttttctattttagaccattccactgactagacaaaaatggtatgcaaatgtgaagtattactttagtgttttaggtagatagaaaaatccttatttgcatgtttggagtgattattaaagcagaggggttgataaatgaatttatgtttgcaattctttatcagtctccagctctttaaaatccatacctccctatctctcctttacacagggcccagatattacactgtcaaaactttacaagttaattgaagagtcttgtccacagctggcaaattcagtgcagatcaggtaaacttcattttcttctttatatatgaaaaggtgtgaaggtagatgaaaatcacaaaagggtatgtggtagttaattcttttaaaaagatacctttattaccctaggttgttttcccaagagcctttacttaattctgttttgttgaaaaatggatagctttttctttggagacagggtctcattctgttgcccaggctggagtacaatggtgcaatcagggctcaacgcagcctggacttcctgagctcaggtgatcttcccacctcagactcccaagtagctgggactacaagcatacaccaccaaacctggctaattttttgtatttttagtagagatgggattttgctttgttgcctaggctggtcttgaactcctgggctcaagcaatccctccgcttccacctcgcaaagtgctgggattacaagtgtgagcaaccgcacctggctgaaaaatgggtaacattaagcatactgttttatagcttttttccccaaattttattattccttatggatccatcttactctttttagtcattgcagataattgaatgtttattggttgatgtgatagtttgacaaattttatgatcaagaaaacaacaatgatacttttcagaaatacgggagtaacattttgaattatgaagtttgttttatgagccaccattttatacaaatctctgaattgcctgtaaaatacattatttgaggtaattgaggaatatgaaacatgagaaattattcaaagggcctttctaaaatatgcacctcgattttctcattcagaatcaaactgatggctgaaggcgagttgaaggatatggaacagttttttgatgacctttcagattctttctctggaactgaaccagaggttcacaaaacaagtgtagtaggtatgaaactcttctaagaagagcagagagtattttcattgaagtgagcagctttctaagtcatgtctatcattgttctgctatatctgtgaacagacacagtggggatgttggaggtgttgcagtttgtatttattgccttactgttttgatctatatttaaatcattaactgtggaaaagcaccttctgttttgtctacaatagtaagagtcagagcctggtcctggggtttttaggggttcccagctctttctcacagtcctctggatcacttgcctgcatggtccatctgtaagtgagggtcaccagcccagacttatgaagagaggtaagtaaaaatacattattgatatagtatgcaaagtgagggcatacgtggtgtttctttgatgcttttctattagctttatcccatgctctatccctctggcttttttgcatggtaatttttatgttattcagcgtgagctatttctctctctcttcctatgtgccaggctctggacgtgtaagatagacatggaatttcctcttatggagattacctctggttgggggagccagttggtaaaagtaaacacataaatatcatttcagatagtgtaacagccatgaagaaagtaaaatggaagccttcaggtggaggtggggtgggtagattgtgccctgtataagaagaaaccagctttgtaaaggactggggaagaacattccaggaggagggaatggcaactgcaagtgtctctttcttactcttctgaaggaagaattccagcagacagtcattgccattgtggagttgccattgcgtagcctggatgtcagttaatgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaaggtaatttggcttttctgacagggatccttttcctgtgaaatagtataatttcaagtgcaataagtccttgttcatttagaattcacgtgctggcttatgccctttttacccttccagatctgggaagttaactgataagggctgcaccagtgggtcccttgccctctgacttgtgattggccaatgggaggcactggcaggaaatcccaagggccagggagaatgacgtggagtgtggattcattggctccctttcttgggggtcctggggggctggctgtagggtcacagcttctgtcaggtcgctctttctgcactccttcagggggttcggtgactaggagcaagtgtttgcaggccccaggtgaaaggtaccccactgttatcagtcctggggactgtattgtgtcttatgacttctctgtcctttcccctacttttgtcaattgatcctttgttaaactcttctcagactactcaatttgaatgtgttctttgttttctgctgggtccctgactggtattgttcatcacatcagagtgaagtaacacttgattaattcagtgaaaatttattgaatgccttctaaggtctagcctctaaggaagctgttgtaaggaagttactcacttagttggtcaagcccaaaatgcagtagtatccttgattcctccctgtccttcaccccagtccctcagcagatccagtcagtccttcctccctgctatgtttggaacttgttcacttatctcatagccactgctacccctggagtctaagcacccaatctctaccaaatctactcaccaaatctgcactagcatcacttttctccttgacttaactcctgtctccctacatctgttcttcaggcagcatctggggaagcccctaagaatattaatcagatcccagcacttttctgcctaaaccctttggaacttagagaggagtttgagcttaccatggcctcagtgcctgtataacctggcccaatgaacttccctgacctctttctctttattttctccttcactctcagcatagtgactgctctgactttatccttcagtttcttgactactccaatcagtttctacctcaggttgcctagaatgctcttccctggcttttcacctcatgtgctccctttcacctttcagatcacagctcaactttcctcagacgggcctccctgaccacgaggtagcgcctatcccaaatactttctttttctttcttttttttttttttttgagatcaagtctcactgtcacccagcctggagtgcaatggcacaatcttgactcactgcaacctccacctcctgggttcaagtgattctcctgcctccacctcccaaccaagtagctgggattacaggtgcccaccagcacacccgctaatatttttgtatttttagtagagatggggtttcactgtgttggccaggctggtctcaaattcctgacctcaggtgatccacccgccttggcctcccaaagtgctgggattacaggcgtgagccaccgcactcggccccaaatactttctatttctttattcctccatacctctcattactaagtaaccttcttaatttacttgcttgcttgcttatctgtttcccctgcctcttcaccccttgagaactgagacccttctctgtcttgtttgatcacatttccccagtgtttagtagagtgcctgactcatagaatgtgttctgtacctgaatgttggatgaatcaatatatagtccatcacccatactggtaactggcccagtaacacactttgtattaactgtccttccttttgctgttttacttctccttccctaactactgttatctgagattgcttccaaataaactacttgtacttgcaggcaaaaagatatgtatgtatttcatattccctgatgtcaaagagcctgtgatctggtgaggaaggctgacaagtaaacagatacactgtccagagctctgagagaattaagccccacctgccctaaggaggtggtcaagggaccttatcatttcctgggagcttattatttactgcattgcaggctgttaggctactgtaatccccagggtggcagggggtgacattgtttataaatggggaatgcttatcgcactttctatgagtagtttttgtactgttaaatgatttgttcagcacatattgagagcaagaggataatagtaccattaactgctccccaaaactcatttccttacaaatgcttcttgtctggtggaaagacaacatagtgtggagttaagagtctggctctgcagtcagatccccaggttggcctgctgctcctctgcctttggtctctgagaccttgggcaagttattcaccctttctgtgctttgagctctttatctgcaaaatggggctcataccccttccccagagggttgtcagaattaaatgataaattcatataaagtattcagaactgtgcctagaaatgttaactattattattctctactttctcttttagttagttgccctcagaaatgcttctaggctacagtgtaatcctttttctagctactttatatgcttaaagtagcaaagtgtcacttctgcagaaatgttaaaattcagacttttcttatttgggttggttttctcttaacttgatttatttaggtctaactccatctttttgtttttatcttattctaagaagtcatttatgtataatccaatatattttctataaaggtatatggtttcagaaaatcatgcatatttagtaaactgaatttcatcgtgaaaattgaagaaatgtattctttatatttaaatctaactaatgattataattctttgtctaaaagaaattactttgttagagaacctttttattttataggatgtacttacatgtatttcttagttcttttttaaaggaaaatttcaattgttttctttttgtgatcttttctttttgagatgaagtctcgctctgccgccaggctggagtgcagtggcgtgatcttggctcgctgcaacctccacctcccgggatcaaacaatttttctgcctcagcctcctgagtagctgggactacaggcacgcactaccacacttggctaattttttgtattttagtagagacaggttttcaccatgttggtcaggatggtcttgatctcttgaccttgtgatccacctgccttggcctcccaaagtgctgggattacaggtgtgagccaccgcgcttggcctcctcgatgttttcttctaagagtttttaattttttttatttaaaaatgtattatttattttttattactagcaggtggaaggaagatcttctaagagttttacggtttttggcctcacattgaggtctttgagtccttggcctcacattgaggtctttgagtccttgtgagttaatttttgaatatggtgttagataaggatccaccttcatgcttttgcatgtggatgtgcagttttcccagcatcattggttggaaaggctgtcctttccctatcaaatggtcttggcactgttgccaaaaaccatttgaccatgcatgccagggcttctttatgggctctgtgcattgatctcaacatcactttttatgtttttctttcctagttctgaggagagagttaaattttttgaactctttcgatacaagaatccatctgattttataaatgttatcatttttacttttgtgtaattctttactatttttgtttttttattttttccagagaagaggaggtatcttgcagtgggcctctgtcccaaaaacaagcagaattttttctttctcaacaggtatgtgaattctgtaatttatcatgaacttctgttctagtcctgtgatgtgtctagtcctgtgatgtgtgttgtggcataggcccgttatgtgcataggtttgttggtcagtctgtgtcagcctttactcttggtcccctctgcctcactaacgaagcacttgtagctctgtgccccttcctattttgtgtgtgattttatttttctattaaagttataatccaggtttcatttagtaatggtatgtgactaacagcctaaaaccctgtgatttaacccttctctcaacattttattatagacatttgcaaacataaagagagcctgaaaagcagtgtatggtaattacccatacctattacctcgattctacaattaatatttttgttctatttattacttatctaaccactctctattcagccaccatttcatcttattttttgatatatatttccagttgcagatattaatacactttgctccaaacacttctctctttttttgttgtttttgagacagagtcttactctgttgcccaggctagagcattgcccaggctggagtgcagtggcatgatctcgggtccctgctacctctgcctcctgggttaaagctattcttatgcatcagactcccaaatagctgggattacaggcgtgcaccaccacacttggctaatttttgtatctttagtagagatggggtttcaccacattggccaggctggtcttgaactctcgatctaaggtgatccacctgccttggcttcccaaagtgctgggattacagacatgaaccagcgtgccccaaacatttcttttttgtttcttttttttgagacggagtctcactctgtcactgaggctggagtgcagtggcataatctcagctcaccgacacctcagcctcccaaagtgctgggattacaggtgtgagccaccacacctggccttcatcttctttatacatttcaaaacctagcacataatagacaacttaataaatatgaatgaaagacatatggggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagctcttttgaggcaaggcaggagaatcgcttgaaccagaggcagaggttgcagtgagctgagatcacaccactgcactccagccttggccccagagcaaaactccatctcaaaaacaaaaacaaacaaacaaacaaaaaaccttagaagtggaaatgacaggcacttttaagttctttgagatatattactaaattaccctatataaatgtaccaagtactttcataccagaactctgtgcttttcttcctctaacactgaagtatctttgcttatataattggtgaaagtagtaccttaactgctttaaatttaatttcaatgactagattgaaatgttttcatgtttttgggccatgctttctgtgaatgtacattcatgacttttttatactcttatattgtcgggatgtttatcttttttttttgagacaaggttttgctctactgcccaggctggagtgtagtggtgcaatctcagctcattgcaacctctacctcctaggttcaagcaatcctcccacctcagcctccctagtagctggaactacaggcatgtgccaccacacaccacacccagctaatttttgtatattttgtagagacggggtttcaccatgttgcataggctggtctcaaactcctgagctcaagtgatacgcctgcttcagcctcccaaagtgctgggattacaagtataaagataaacagcacccaactgggaggtttatcttattgatcccgaaatactttcaatttgtctcaatcctttcatgaggtaatgcactttttgtctacatagacgctcaggccacatgtggacttttatttgaagtgaataagcagaaattacatagaattacaataaaagatcattattcctgtgattttaactggccagtctcaccaattattttcatgaccgccacagggagtcgggcatggggatatagatcctgcagtatcccccaaaaatattcccatcgtggcctgcaattcctgagactgagagaggagtgatataagatgagctagaattacatggaaagagcaaaggaaaatggttatattagaaaaagaattcactctacctcctctgggttgcaagaggaagctcagaaagcagttctgagccccataacttatttatgggcttaccgaaaccccaatcactctcataccacaaaacaacgtgcaccatccaatttacttgaaggaaagtttcagaagcagatacaagagaaagaaaagagtaactggagactcatgataaagctgccttctctgcagctggccaaacttaatttcacaagtatgagtctaacttgtctaattaaaaatgtgacagtcatcagcccagtaagtatatatatatccacacggttgatgttctaaaactagaaagatctaaggcaagatgaagaaaggggtaaaggactgacttaaaaaaaaaaggcagctaccttctagttgtgtactaaaaggcttcctaacacagcctggctgttgaagccaaacaatgattgggtcagcaggtttttcacataagcccagaggtgaaagggagatgaagatggaattattaatatagacccaaagagcatggttactttttagggtcttactcccagaaaaaaaagacacaaaattctaacaaatggccttgaacaaagttacaaggctaaagaattgagccacaaggcactgtgactcacacctgtaattccaacactttgggaggccaaggcaggaagatcacttgaggccaggagttcaagatcagcctgggcaacacaacatagaaagattccatctctaagaaacaagaattaaaataattagctggatgaggtggtgtgcacctgtagtcccagctactaggcaggttgaggtggagttcaaggctgcagtgagctatgattgtgccaccgcactccatcctgggcaacagtgagaccccatctcttaaaaaaataaaaaatacgctgggtgtggtaatcccaacactgtgacactgaagtgggaggactgcttgagcccagaaatttgagactagcctgggcaacagagtgagattccatctctacaaaaagatattttaattagctgtgtggtagcacgctcctatagtctcagctactcaggaggctgaggtgggaggatcacttgagcccagaaggttgaggctgcagtttgctgtgattgcaccactacattccagccctggtgatacagcgagaccctgtctcaaaaaaaattaaaaactggctgggcgcggtggctaacgcctataatcccaacactctgggaggccaaggcaggtggatcatttgaggtcaggagtttcagaccagcttggccaacatggtaagaccccatctctacaaaaaacataaaaattagctgggagtagtggcacacacctgtaatcccagctacctgggaggctgaggtaggagaatcgcttgaacccaggaggcagaggttgcagtgagctgagatcacaccattgcactccagcctgggtgacagagtgagactccctctcaaaaaaataaaattaaattaaaaataaattaaaaattaaaaattaaaaaaaaaaaagaattgaaccaagactaaggtttttgaaaagtagttttctattctaatagtaaaaaaaaataatttcgccaggcatggtggctcacatctataatcctagcactttgggaggctgaggcaggcggatcacctgaggccaggagttcaagactatcctggccaacatggtgaaacctcatctctactaaaaatacaaaaattagctgggcatggtggtggacacctatagtcccagctattcgggaggctgagaaacaagaattgcttgaaccccagaggcagaggttgcagtgagctgagatcgtgccactgcactccagactgggcgacagagcgacactccgtttcaaaaaaactaaatacttcaatatgttcaccgactcattcattaccagatgcttctcttatccaaggcaccaggaaaggaagagaagtgatgttaaggaggtgccagtgccacgaagagggaagaaacaagcgagagacagacttgcaacattcccaggggaagcaaccagctagccctttcgacctcagaaaacatgggcagtgcttcccagacatgggaagaaaccagctggcaaaggcgccgtggaacccatcagtcagggcccatccacccctcagtttacacagccatgtaagagactgtaaaatgctaacatgtttgctatagggaagtatgtctagacttctgaaaggagtggaaaccacccaaaaatctttaggctgcaattagggaatgttgagtgttatgatgcaatctaacagtaacaggtatcacaaagaggaagagaaaaatatgatcaaggaaacatctggattgccacagcagtgtttactgagatggagggctttagataaaatagttttccctgactctttcccatgaaagaagatattttgaataaagggaagataaagcctacagtagcagaagagatactttaattgatcccttataaagagaatctcgtcaaattacttgagctgtaagtcatcaagattatgtcccattcccactgctcttctttggagtcaaccaggtttcggttggagacctgcctctgacatttacaggtgttggatacaggatttagctcccaggacctcagtctttagttctgtgaaatagggataacaacaaacctgagcccatgaagtggattctatgagacagtacccataaaataggcacagggactggcacagaacaaatttacaaccaacattagttattatgatttcagatatacttctattatactctcctctctcctaaaacacacaaacctctgctaccttaaatgtcaaagaatcctatttatttccttagttacatgaaactggctgacctcttagaattcccttcattgatgccaaaaaaagacctcaaattcaaccaactttgcagactccacccttggtccccttccactggtgggatttcactctttcagccacagtgtcgagcagaactgtccaacacgtgtccagtgctttcctcaagcattagaggaaagaaatggtagagcctccattgctccagaagcacgtgggcccggccacctgcctacctgctccgcgtgtagctctgcgaggtggcagagtgcgacagcaaaggactctgtgttgttctgctgcacgcccgcattcaccgcctccaggctgttcatgctcagcaacatctgggcctgttgcagtgccatggtgctgggtggggagagggaacaggatttcctttcagcagcagacctggctgcgctttggccatgcccgtcagctatcttgagtggaggcgtaaagtcatacacctcacaggctctggctttcttgggagcagatgcctcccagtgccagcaaccttgccctcaggataagaaaggcagaaaagcatcctggatgtgcagcgcgaggagacacgtagtggttagggcacagctgggagtacacgctcccagatccccccgcccccaccccatgttccctgcagtcatagtatgttaattagttttcacgggtgaattcagacccgatgccatcctggcacagactgctctggcaatgtaagcagtggccagtgtctgcagctgtttcagagcacaccgtgccaaaaaattatctgaaatacaaaaacaagactggtaaaaaaggcacttcctttcattactgaattcctagaaacagactgtctaagtgaggggtgaggtagcgacagaactccaggattaaaatgcggcaacaaagtttacttccaggctaaaagtggctaaatgtgaaagtacacaataagatgaaaatattccacagaaaacacctcagttaacagaaaagcaactttcttttacacaatagttttggggttcaggtgacactcaactagagcaaccatggatcatgcctcctataaacaggaaggttcctgtcacagagcagaggagcccggtgcttggagtcagatgacgtgggtttgagtcctttctctgtcacttgttaactgcgtttgcgatcgcgggtagatcagatgtgtgaaccctggtttactctcccagcatggagatcacccacccattacctcacaaagtggttgggaggagtaagaaggaacatgcatgggaaaaaagttttcagtctgtgcaaaatacaaaatgttttatagtctaaaacatagtcccctgcaggaacaacatctatccaaggcaggtaaatcttgtatgtatggcctttcacagaaccagcttgctagctcctgcttctctctaaagaattcacacccccagggccttgggagacctacctgcggccatacagcctccagatggccgttttctgtgcgatgctgatatcgatgagctctgacaggctgtgtttccagtgcaggaggtcggagtcctttagggcatccatcagcttgtttgccgtcttcccagcaaaagctctctgttgaacaagggactgtattcccagggaggcgaggtactaaggggacagatatacccacgacccaagatagagattacatgacagaatttgttttgctcttcagaaatgtggtggatttcacatttcagcacatgcacagtgacagcactatttaaaaggaaagtacctataacctggccttaaccctgagccatacgagatgtgttcctgaaaaactgggtctgggagagaggcagagggtacacgggaaagagccagcagggctttagcattagatggacctggacttaaacactgcctctgctacttactgtgtgacttagggccagtcacttagcttcttagctaagcctcagcttcctcatctgtaaaatgggcatcaaacctatcataaagaattatcgtaaggattacaatgaaataatagatgtcaaacagtgctgcgcacatatgtaataggagatcaaaaaaggatgcctatcatgagcaacaaaattatcttgtcattagcttttggtgtcatcttcaaggatgaaagctcaactaaaaaatgccagcttaaattcatggcaaaaattgtagttaagcctgcgcttacttcaaggagccacttttgtcattataatcaattctgtacgtatgagtttctttcccaggtgtgaatcaatggacaagctacagatttgttttttggttttagggttgtttttgagacggagtcttgctctgtcgcccaggctggagtgcagtgcagcaatctcggctcactgcaaactccgcctcccaggttcaagcaattcttctgcctcagcctccagagtagctgggactacaggcgcccaccaccacgcccggctaatgtttgtatttttagtagagacgagcttttaccataacggtcaggctggtctcaaactcctgacctcacgatccacccgccttggcctcccaaagtgctgggattataggtgtgagccaccacgccaggccgattttaaagtgtatacattaaattactacctgtaattactttccattttactgaagtctgtcacaaacttcataagacagaatgcttaagcaatcccactgcctatggtctagttttcaatgggtgtttctgagagagaataaggttctccaagcttgtgcttcctttttttttttttttgagatggaatttcattcttgttgcccaggctggagtgcaatggcacaatctcggctcactgcaatctccacctcccaggttcaagcgactctcctgcctcagcctcctaagtagctgggatcacaggcatgtcccaccacacccagctaattttgtatttttagtagagagagggtttcaccatgttggccaggctagtcacgaactcctgacctcaggtgatccacccaccccggcctcccaaagtgctgggattacaggtgtgagccaccacgcccagccagataagccttttcaatgcccctctgtgtatgtcattgaggactataattcacggccttccctatcactcaaaacgagaaaggacaaatctgcctgtcaggtttactggttcctggctttgtttattgtttaaaacaaggatcagcaaacttgttgtgtaaagggccagagagtaaataatttcgatttttcaggccacacttggtttctgtcacgtatttcttctctgttgttgattttttttttctgcaatcacttaaaaatgtaaaatccactcagcctgaagcccctaagtaggcagaaagccagatttggcccaagggcgggaaagttcaccaatccctggtttaaaaataagcctttgctaaaatttttctaagtgactatgtgctaaattaatgttgctcaataaactaaacaatgatctcttatcaaattggtaaagggaatttccacagatgttattaggatacagggaacagagagaaacctaccacacagaatttagtggtctgattaataattaaagtcatatgaaactgccaagaataaaaccacactttgaaacccattctaaatctatcgctggttaatgacagaggtgggcagaaaaagagacaaaggctcgaccatttatggaaacaatctcacagaaagatgagccttaccggtaacccaaaatgtactgccttcttcacagaatgctccagcagaacatagctatcggatctcttctgccccagcacataaagccagctctggcaagagaaatcatcaaaatatatcataacagtggcaatggctgatgttctagtgaaatatcaatgtggtcataagaaagaatttaaaagggacaaaatgaatcctctcaaatactctttcaagaaatatcaagaatctcaatgagacctgtcaaacatatcaacatcattaaaaccaggctgaaataaatgagtcattgttctgcttcacctgacagccactgagtggcaggtgtttcagaaaaaaagcatgaagctcccatatggccttcaattgagaaataagattctcaggtgcttgtcaagtagcttctgtgttccactgccctggtgattttgctattacaggacaacatctcacccagttactaagtgtagtatacatcttttgttaatgccagtgctaaatgtgataaaggtttctcttctttcatggcaagttgcattaaactttgtagagcagatatatgccaaaagcaaaacagatgtcatgaattaagaaaggtaagtaaagataagttgccctttctgaattcccatgaccacctaacttgtttccttttgctgctgaagatctctgctccaactgcaaaacaacccaattcaacggggccttgtgaaggccaattcaacccgtgaacaaaactcccaagaccagaggatggcctcaccaaacagtgctggagacacacgtgatcgttggactcctgggcaatcctaattgcctcctgcagggcgagctctgcctgttgactaatgacagactaaacattaatatcccattaataatcacaaacatgcataagcaaccatagcaggaagtcatctgtacacagtcatccaaatgcaggtctctgggttggaagctgtaactatttctgggcttattctctcagaggcgtgccccaaccctagcagcagaaaacactgacagtggaaatataggacatggttcttctaaggggaaaagatacgaaaagggcataaagcaaaggctttttncncgctcaaagtgngttttncnatgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtccaggtaaattcccaacatccttatcaaggagtcatcagatagtttccgtctttgaagcctgggttgtctttgaatttagagcaaagaatgcgtatggagtttttccaaagttgccagcaaaaagcatgcgtttaagaggtcagacttggcttctggtcccatctttgcctgtagctagatgtgtgatcctgagcacacttaactcttctgggaggcactttgtcaatgtaaattgagaaagtacataaagtgaccttgaagggcccttctagctcaaaaactttatagcaaatgatggactcttttttttttttttttgagacgaggtgtcactctgttgcctaggctgaagtgcagtggcaggacctctgctcactgcaacctccacctcccaggttcaagcaattctgcctcagcctccagagttgctggtattacaggtgcctgccaccaagccttgctaattttttgtatttttagtagagacagggtttcaccatgttggtcaggctggtctcaaactcctgacctcaggtgatccgcctgcctgggcctcgcaaagtgcagggattacaggcatgaggtactgtgctctgccgggactcattattaagttcagaatttctagatcttagtgagactccgttcaagcaaaaccatactatgatacaacggttaacaagatgagaacctggcaaacttttaaatttttatttatttacttattattttttagagccggtgtctctctctcttgtccaggatggcctgcagttcctgaggtcaagtgatcctctggcctcagcctcccaagtagtgagaactatgggtatgtgccatcacgcttggctaaccaaccccctgcttaacctgagtttgcaaatgtcaaagttggagataggtcataaaatcgactcactggtagattttacagactgaatcttgctgtgttgcccaggctggtctataaaacttgggctcaagtgatcctcccatttgagcctcccaaagtgctggtattacaggtgtgagccatttcccccagccctgcaaataaacctattttctttttaaattactcagtctcaagtgttcctttatagcaacaccaatggactaagacgtatatgaatgtagatttactgtataagaatgaacttgttttggaaggtctgtctttttattggaagaatcgtaattctggtgagcatcatgctggactggggataggagagttggcagctcttctttcatcactgcctcactgagcctcaggcaagacagctcaccttcccaagccatgaaaagaagaaaaccctttctcctttctgcctgctaaggagggttattggagaaaaagcctgtaaagtgctccaacttcagagaaatatcaattggccctgtgttatttgtctcactctctggaaaccactttatttatttatttatttattttattttgtttttcgagacagtcttgctctgtggcccaggctggagtgcagtggtatgatctcagctcactacaacctctgcctcccgggttcaagcaattctgcctcagcctcccgagtagctgggattacatgtgcccaccaccgcacccagctaatttttgtatttttagtagagatggggtttcaccatcttggccaggctggtctcgaactcctgacctcgtgatctgcccgccttggcctctcaaagtgctgggattacaggcatgagccaccatgcctggccttttttttttttaatttatttatttgacacagagtctcgttctgtcacccaggctggagtgcagtggcatgatctcggctcactgcaaccttcgcctcctggattcaagtgattgtcatgcctcaacctcctgggtagctgggattacaggcacgcaccaccatgccagcctaatttttgtatttgtagtagagacagggtttcaccatgttggccaggctggtctcaaactcctgaactcaagtgatctgcccgcctcagcctccaaagtgttgggacataggcatgagctaccgtgcctggcctgggaaccacagaaagttctgtttctgtttcactttcaggattcttcagctatttggcaaagttgaagacataagttcccggttcacaaccattttctccattttacagagggagagacgtaaggcagaagaagattacatgtacgagttgacagcataattcactggcagaattccaaaaagatgctatcagtccaaaagaaaatgattctggggagccatctgttctccagctgcagagatgtttctctaaagtgcaataagtattgttgaaaccatctttactgtagcggaagtcaatcacagtctggattcagatgggagctggtttaagcattcagatgaagagatacttcgtcatttctaccagtgagtcaactttatgacctatctacaactttggcatttgcaaactcaggttaagcagggatggttagagagtttatttgatcttttaaattataaaacttatgcaatgagtccaaaaaagatggattaccttgagtaggtaaaatagttatatttgttaaattgaccaaggataaataaaaacatagcaaaccagatccaattctcaaatattttgatctggctcatatctaggcaaccagagttgggcactcgtctaatgatgatgcagttgagcttagatgggagagtggtggggcatgggtagagaggtacacgtgctggagatgagacacgaatggcagaatgtagagaactgttaaaactgggtgatgggtatgtgagggttcattgtattattctatttactttaaatatgtttgacattttccagaataagaaatggcttaatacagcaagttgctaaccaacttttaaaaaggcatattatctgccttctatgacttgttatcattgggtgattccattgttaggataataataaagccttctaccctattgtcttttttttttttttttttttttttgagacagagtcttgctctgtcacccaggctggagtgcagtggcaccatctcggctcactgcaagctccgcctcccgggttcacgccattctcctgcctcagcctcccaagtagctgggactacaggcgcccaccaccacaccctgctaatttttttgtatttttagtagagatggggtttcaccatgttagccaggatggtctcgatctcctgacctcatgatccaccagtctcggcctcccaaagtgctgggattacaggcgtgagccaccgcacccggccaaatactctttttttttttttttttttgaggagtcttgctctgtcgcccaggctggagtgcagtggcgtgatctcggcttactgcaagctccgcctcctgggttcacaccattctcctgcctcagcctcctgggtagctgggactacaggtgcctgccaccacacccagccaatttctttttcgatttttagtggagacagggtttcaccgtgttagccaggatggtctcgatctgacctcgtgatccactcgccttggcctcccaaagtgctaggattacaggcgtgagccactgcgcctggcctgttgtcttttaagtacacatcatgttgaaaaagattattcagtaacttacaaaaatttaattattattattttttgaaacagggtctcactttctcactcaagtaggaatgcagtggtgcaaacacggttaactgcagtctcaacctccagagctcaggtgatcctccaacctgagtctctggagtagctgggactacaggctcctgtcaccatgcccagttaattttttgtgttttttgtagagcccaggctgatctcgaactcctcggctcaagttacctgcctgccttggcctctcaagtcatgagttacagacatgagccactgcacctggacttattagttttttttgagacaaggtcttgttttatcgtccaggttggagtgcggtgacacaatcacggctcactgcagtctcacattcctgggctcaagtaatcctcctgtctcagcctcctgagtagctgggaccacagccgtgcaccaccacacctggctaattttttattttttgtagagacagggtttcactatgttgcccaggctggtgtccaactcctgggctcaagctgttaccgaatggaaagtcttgattgtgagttgtccaggttcttggcacgttgaacaaagaattgaacaaaatgcacaaagcaacaaaagaatgaagcaacaaaagcacagatttattgaaatgaaagtacactccacagagtgggagcggactcaagcaagcagctcaagagccccagctgcaatgttgtttagggtttttattaaactaaaagaattttgcaacatccctaggtaccctttagaggcttccaattgcttacatcctatgccaatgaaggatttgcccacaaccaatcaaaggctgaagtgaaggcttggccctctaccaattagaggcatttactgtttgtgacctaagggagaggggattttgtagagggaggagcctctggccccttatcacttgggcatggagaggtggggttttccttctggtccagttccaagaagtctgctgcaggttggccttaggctccctgtctccagaccctgttctcctgcctgaaagtggtggtcccacttcggcctcccaaagtgctgggattataggtgtgagagaccgtgcccaacctaattgtgtatttgagatagggtcttactctgtcacctaggctggagtgcagtgacacaatcatggctcactatagccgtgacctcccaggcccacatgatcctcccacctcagcctcccaagtagctgggaccacaggtgcgtgccaccatacccagctaatttttgtgtgtgtgttttgcagagatggggtctccctatgttgcctaggctggtctcagactcctgggctcggcgaaccccctactgggcctctcaaggtgctgggattacaggagtgagctaccatgccaggcctcaaaaatttagatagtggaacttttgcttcttcttgacattgagagaggtttgaaattatttgactttcagcacattgtgaattcaataaaataattttttgaggtgctaaaaagaaacaactcagaaaatgccccactacatcctaaggatccaatgcatcctcaattgcattgagttgcaataaattatcccatgtgtcttggcattcctactttttgtctctgaaatacaaagtattaggttgttatgatcataacttaacagacaaaaatttcctgaaccacaattgatacaattagtacacaattgaaagaggagggtcattggccgggcatgctggctcacgcctgtaatcccaggactctgggaggctgagactggcggatcacgaggtcaggagatcgagaccatcctggctaacacagtgaaaccctgtctctactaaaaatacaaaaaattagcctggcgtggtggtgggcgcctgtagtcccagctacccaggaggctgaggcaggagaatggcgtgaaccccggaggtggagcttgcagtgagctgagattgcatcactgcactccagcctgggcgacagagcaagactccatctcaaaaaaaaaaaaaaaaaaaaaaaaagagggtcattatataaaatttgaaacaaagaaaaaactatgatcacaaaatgcatctctttcattgaaaaaagagtgatatttaagcacaaatctctctcaacttcagaaggtcccaacttcaggtaggtaggcattgtaaactcatgtgtaacctatttactcccttatgttttttttttttaaatcattttccttctccaccttccagaaaaaaaagtattcactcaaacttttattgatgggtgggtgtggtggctcatgcctgtaatcccaacactttgggaggctgaggcagggggatctcttgaggctaggacttggagaccagcctgggcaaaatggtgaaacccctctactaaaaatacaaaaattagctgggcatggtggtgcacacctgtaaccccagctactactcgggaggctgagtcatgagaatcacttgaacctgggaggtagaggttgcaatgagccaagatcgcgtcactgcactctagcctaggcgacagagcgagactccgtctcaaaaaaaaaaaaaaaaatacaattcagctgggcacggtggctcacgcctgtaatcccaacactttgggaggccaaagtgggcagatcacttgaggtcaggagtttgagaccagcctggccaacatggtgaaacctcatctctcctaaaaataaaaaagttacccggatgtgtggcatgcacctgtcatcccagatactcgggaggctgaggtagaagaatcacttgaacctgagaggcagagcttgcagtgagcagagattgtaccaccgcactccagcctgggtgacagagggagactctctcaaaaacaacagcaacaacaaaaaaccaaacacaatttactgggagcttgcttatgctaggtacagatctgtgtgctggggacaaaataagacaagtcttcccaagtattgcactgttttaaattttcccctgatacttaagtttctccctagcctttgttgttttcattgtccttctgtggccactttccagctgcattaactcttctttttgtgttcctcaatattaacagctttattgagatataattcacataccatataatacacccgtttaaattatacaatttagtagtttttagtatactcacagagctgtacaaccattcacatagctaattttagaacgttttcttttcctttttttttttttttttttgagcagggtctcgctttgtcacccaggctggagtacagtggctcactgcagcctcgacctcctgggcacaagtgatcctcctacctcagcctcccgagtagctgggactacaggtgtgcaccacgatacccagttaatttttgtttttatgttttgtagagatgggatctccttatgttgcccaggntgttctcgaacnccgggttncaggaaatgatgatntnactccaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcatgttgtagttcctagctcggccattcacctcttctgacgttactcaacatgcatgcatttgctggaaatggcttaaacctgaggccgggcatggtggctcacgcctatgatcccagcactttgggaggcccgggcggagagatcacttgaggccagaagttcgagactagcctggccagcatggtgaaaccccatctctatcaaaaatacaaaaattagcccggtgtggtggcggtgcccgtaatcccagctactcaggaggctgaagcacgagaaccacttgaaccgggaggcagagagatcgcaccactaccctccagcctggacgacagaccaagactgtttcaaaaaaaaaaaaaaagtctgggcacagtggctcacgcctgtaatcccagcactttgggaggccaaggtgggcagatcacgaagtcaggagttcaagtccagcctgaccagcatggtgaaaccccgtctctacttaaaaaaaaatgcaaaaattagccaggcatggtggcgcgcgcctgtaatcccaactactcaggaggctgaggcaggagaatcgcttgaaacccgggaggcagaggttgcagtgagccgagatcatgccactgcactccagcctgggtgacagagcaagactccatctcaaaaacaaaacaaaacaaaacaaaaacacaaaaaaaaaaccacctgggaacaacttcctatatgttcatcaaaggaatggataaatgaaactcattatagttgtttgatggaataccatctaatagataaaaggggtgcactggatctgtactgacataaggaaatcccaaaaacataatgttgagtaaaacagcaagttgcagaatacaacatgatgtacaatttgtgtgtaccttaaaatcccatgcagtagatactgttcatggacacatgcttacatacaagatttttaaagtcaaagagaagaatatacattaaattcatgacagtgtgccacaaagaaggaaaaaagcacagaacgggacagggagcataaggaatgttgtaaagttttattccttttagtacttataaatggctgtgaggcaaatggcaaactgttagcaatagtcaattctgaatgggggatgcatagtcccgtatttttctatattctcatattttctcccccccccccaaaaaaaatatgtatcaggcctggtggagattatctggggcactttaaggcagggtcagcaaactttgtaaagggccagatagtaaatattttaggctttgcaagccataggctctgtaatgcagctactcaaccctgccatcctagcagccacaggaaatagtaaatgaatgcatgcggcagtgttccaataaaactttatttacagacactgaaaactgaatttcatatgattttcataagtcacaaaatattactgttttggtttttatttaaccattgaaaaatgtgaaaggccaggtgtggtggcttacacctacacgcgtgattacaatcttagcactctgggaggccgagggggcaggatcacttgagcctagaagtttgagaccagcctggacaacatggcaagacccatcttgacaaaaagaaaaaagaaaaacgtaaaaaccattcttagcaggccataaaaaacaggtggcatgacagatttagcttatgggcaataaatagtttggcaaccctgctttactaaggtaaccaaaatagatttgggtgtcctttcctgttactggatgtcttttcctggtacttgttaaacaattctgtatgtttacatcatgttactaaattgcctgtgttttattagaacactgtagctcacacaggcagaaacttagatatacacacagctgtgtaaacttaaaagccaattaagtaagaaaggttgggaagtgcccctacaaatccaaaccctagctcaagagttgcttttcctgatagtttcctgaaatgctgtgagccaggccctccctgcccgctcctctctctgatgtcttaaagcaaggactgtaccatttatttgatgctcagccacctcccttccttctttattccttcctttttcactctgtgttttgacttgccaatagacctatatcttcctggcatctaggcaggtaccacatctgaaacctttgtatactctccgcattgtgggtgacagcaatgaccctgaagtcagatagattttgttcacatcccagtttcactagttaccagctctgtggccttgggcaaatgacttgatctctcccaatttggtttcgtcagctgtcaaatggggataataatagtatctagctcacaggtttcccatgaggtttaaatctaacgatgtatgtatgtaaagatacatgcactgtagcttggtacataagtcttcaatgatgctaactaaataaaaatagcccaaagctaaaacccccatcaatatatgtgctttccttattaaagttaattagaacaggacagaaacatcacagttgcaattctttttttttttttttttgagacggagttttgctcttgctgcctggtctcacagttgcaattcttttttttttttttttttgagacggagttttgctcttgctgcctggtctcacagttgcaattcttctaagaatcatcccactgccgggcgcggtggctcacgcctgtgatcccagcactttgggaggctgaggtgggcggatcacctgaggtcaggagtttgagaccagcctgaccaacatggagaaaccccgtctctcctaaaaatacaaaattagccaggcatggtggcgcatgcctgtaatcccagctacttgggaggctgaggcaggagaatcgcttgaacctaggaggcaggggttgcagtgagcggagatcgcgccattgcactccagcctggacgacaagagctaaactccgtctcaaaaaaaaaaaaaatcccacttaaggcaaccgttttcttcttagaaatatgaaagtaagaatttgctttgttttttggatttttctcctccaagaacaccagaaaattctattctaggcaaacagatcttgttgtcctgacaacagattgccaagaaaataagtaaacaaagcatctgaatcatatttttacagaaaacttgaacagtacaagggaggggctggaagcaagagtgtaaaattacctcacccccaaggacagcactgtaatttcctgcggaggtttcatccttcctttctgaaccgtgtgccgctcatgttgctcactggaatgttccacctcccaaaccttgaacatccagatgcagacagcaggattcatcacaccaatgtactgggaaaggaaaagaaatctggggaccccaaactcactaagccaaagggaaaagtcaagctgggaattgggtcatgcaaacccgcctcccattttggttcctaaataaggtggctacaaagatgaaaagcgacacacctccctcacattttgcccacaaggaaattcctggcggcccccaagatctttaccctaaagcagttctgttgaagttctccaaggcaatgtaaatggatagcttatcttcacaggtgcgggggacataggacagaactcaaagtcatccctctactcacctgagacaaatgcgtatctgattgcttccttggccctatcttctatgttatcttatataaaaattcagattcggcccggcgcggtggctcacgcctgtaatcccagcactttgggaggccgaggtgggcggatcacaagatcaggagatcgagaccatcctggctaacacagtgagaccccatctctactaaaaatacaaaaaattagccgggcgaggtggcgggcgcctgtagtcccagctacgccggaggctgaggcaggagaatggcgtgaaccccagggggcggagcctgcagtgacccgagatcgcgccactgcactgcagcctgggcgacagcgagactcaaaaaaaaaaaaaaaaaaaaaaaaaaaatttcagattcaccaagccaggcaaagggatgaatgactatttttcccctacccactctcacatgaaaattgtgtatttctcaatatcctgccctttcccctttaaatactgaagccttcaaaatcattttcggagaaaggcatacacctgtctcccaggtagttccttaactttggcaagtaagcctcctaaaatgattgagacttgcctgggtcattttctttgatttacagcacttgttgaatttttttttttcccattcaccaggacagtagaaaaacgctgtcgctagctaggcgtggtggcaggcacctgtaatcccagctacttaggaggctgagtcaggagaatcacttgaacccaggaggcataggttgcaatgagccgagatcgggccgctgcactctagcctgagggacagagccagactctgtctcaaaaaaaggaaagaaaaatgctgtggggctgggcacggtggctcatgcctgtaatcccagcactttgggaggccaaggcaggggatcacttgaggtcaggagtccgagaccagcctggccaacatggtgaaaccctgtctctgctaaaaaattcaaaaattagccaggtatgttagcacgtgcctgttatcccagctactcaggaagctgaggcacgagaatcgcttggacctgggaggaggaggttgcagtgagctgagatcgtgtcactgcactccagcctgggcaacagagcgagactccgtctcagaaaaaaaaaaaaaagaaagaaagaaaaggaaaaaaatgctgtcaagtcaggctcagaggcacgcgcatgcagtcccagctacttgggaggctgaggcaagaggatcacttgagcctcagatttcaaggccagcctgggcaacatagtgaaactatctctaaaaaagaaaagaaaaatgctgtcagaaagaagatcttgagaagtttcacttcaacaggcagtgagattactagtcccaaacataaacaacatcatagaagaagaagtgatgggggcacagatgaggaggcttttcatttgtctcagcatacatcttcgaggaaaaaaactggccgggcgcggtggctcacacctgtaatcccagcactttgggaggccaaggcgggcagatcacctgaggtcaggagttctagaccagcctgaccaacatggaaaaaccccgtctctactaaaactacaaaattagccaggcatggtggcgcatgcctgtaatcctaggctgaggcagggagactgaggcaggagaatcgcttgaacccgggaggcagaggttgcagtgaaccaagatcacgccactgcactccagcctggccaacaagagcaaaactcggtctcaaaaaaaaaaaaagaaagaaagaaaaagaaacaggaaaaaaaaaagccagtgtaaccacccaaaaatattaggaccaaatttaaaacactttgaacaagtagaaatattcagagtatggaggtgaatacaaaggcagcctggtgatgtgagaaagagcctaggctgtggagcccatcacttctggggctgaatcctgattctggtcctcaccaaggtgggggctgggtcaggcccaacctccagggcccgctttcctgcctgtaaaacagggatgatgtttagctcacaagcattagagatggtatgtgtggaagtacatagcagtgtctggcccacattgggcactacgtaaataacaactaatattatcgtttatgtgttcaacaaactgaaaaacaatgttcacaaaaacaggacagtacttttgaaaattctaagggtaggcccagccctggaacctatcagcagcgtggccttgagcaagtaacttaacccccttatgcctccatcctatcctgttcaatggaattcatgctattgctaactcttggaattactgtgaagattaaacgtgttaatatagctaagaacttaaaacagggcacacggctgctgggtagagttcccactgtgccaccaggtcagaacacctttttccttctctcccttagaggatacatcctgaagatctcgggtatagacccgaatgcctgctgcttaaaaagcttcaattccggccaggtgcggtgggtcatgcctgtaatcccagcactttgggaggccgaggcgggtggatcatgaggtcaggagttcgagaccagcctggccaatatggtgaacccctatctctactaaaaatacaaaaattagctgggcatggtggcgggttcctgtaatcccagctacttgggaggctgaggcaggagaatcgcttgaacctgggaggcagaggttgcggtgagccgagattgcgccattgcactccagcctgggcaatagagcgagactccatctcaagaaaaaaaaaaaaaaagaaaaagtttcaattccctcctcatttaaccttttccccatttaaccagacgatcaattcttatacccttaaaccactcatcatcacatcattatgaaattattgactcctttttttccccccaccaaatgctctatcaggagaaaagccagttagctgtcaccccgacagttctgagttttggggtcacaaatgtctctacttttcattcaacccactctgctatcagggaggagacaagcccctcaatcaacaaatctaagtcacagatagcaggagaccccagaccccttctattagctttggatttaggccctgtctccctgctagggtgaagctgccatcagctgagaggcgctttgggcaggctggcttttcaggtgtgcaaactgtgcagggctgtgggctcagaagggccctatattggtttaaggctctgccgttgccgtttgaaattattttatgttttttttttttgagacagggtctcattgtgtcaccccaggctggagtgcagtggtgcgatctcagcttactgcaacctccgcctcctgggttcaagcggttctcctgcctcagcctcccacgtagctgggattacaggcgcccaccaccatgcctggctaatatttgtatttttagtagagatggggttttaccatgttgcaaaggctggtcttgaacccctgacctcaggagatctgcccacctcagcctcccaaagtgctgggattacaggtgtgagccactcacaccncagccttttaaatttttactttttaatagaggcctcacatttttagtttgcactggattccatgagttgcatagctggtcctggtcaggcgtgatgacatcaagcttttatgttggtatctgtggggtcacctgaacaacctgaccccatttattcaaccttctgctgaggcagagtagctaaggccacttcttaaattgaaaggctcttactttaaatacattaatcaaaaatgacatcagatgaaaaaatatacttgaaagaataaaaaggaactgataacagttacctcctaagaggaagtagtacttttttttttttcttgagatagagtttagctcttgtcacccaggctgcagtgcaatggcgtgatctcggctcactgcaaactctgcctcctaggttcaagcgattctcctgcctcagcctcccgagtagttgggactacaggcgcccgccaccacgcccagctaatttttttatttttagtagcgacggggtttcaccatgttagacaggctggtctcaagctcctaacctcaggtgatccactcatctcagcctcccaaagtgctgggattacaggctgaagaattactttttactacatagcctttaatattattcaatgtttaccatctctatatataacctttcaaatgaatttaagattttcagtcaacataccaattagtctctatctctccaccaagtctcttgtttccagagcagctgtctttggccagcaaatgtaccgtaatggatacaactgttttacactgcttcaaagagccctgaagagaaattactccccatcagaaaaactttctgatgggaaatttaacagagaaagaaccaataataggagctgcacaatttagttggttccctgttgctttataaagactatttggggcaggcacggtggctcacgcctgtgattccagcactttgggaggctgaggcaggtgaatcacctgaggtcaggagtttgagaccaacctggtcaacatggtgaaaccccatctctactaaaaatccaaaaattagccaggcgtggtggtgcatgcctgtagtcccagctacttgggaggctgagacaggagactcccttgaacccaggtggatgttgagtgagcgaatgattaactactagagcattttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaagaattaaaattttagccttgcatggggcatgcacctgtagtctcatctgctctggtggttgaggtagaaggatcacttgagcccaggagttggagactacagtgagctatgatagcaccactgccctccaccctgagcaacaaagtgggatcccatctcaaaagaaaaaaaaaaagaaaaaaaaagctgggcgccgtggctcacgcctgtaatcccagcactttgggaggccgaggcaggcggatcatctgaggtcaggagttcgagaccagcctggctaacatggtgaaaccccgtttctactaaaaatacaaaaaattagccaggcgtggtggtgtgtacctgtaatcccagccactcgggaggctgaggcaggagaatcgcttgaacctgggaggcagaggttgcagtgaaccgagatcacaccactgtactctggctcgggcaacaagagggaaactccatctcaaagaaaagaaaagaaacaaagcaaagcaataagcaatataagaccctctgatttaaaggaaaatctgaaatagcatttgccccaaatccccaggatcaggaaatgaaatgtttcccataaccaccagaagaaagtatgctggggcgggaagaagatcacaggtgaccctgagcaaattactcagcctctctgagcccttcatataaagagcccttccataaaatgagttgatagaataatggtgattctgtggcccatgttaaaatttgagccaaaatgccttgaaaacaggcttggcctgccccacttggcctggtcctctcccctgagagtggtgtctggccactcatcttccatctaggatgaggttctcaaagaggaaacccccggctactgcacaaagttccctgctaggtcaccccaccctatccccttcccctcctactcccatcccatctcccatttctggcccatccttcaaggctctgcacaaatgacacctccttcagggagcctcccagattcacaccagtctgaggagatttctccagaaccctcagtgccctgtgctccttcgatcacaacagcactcattccttgtggtgtttctcaacagtggcactgctggcatttgggggagggtgatttttttttgttttttgtttgttttttgagaggaagtctccttcttgtgccccacgctggagtgcaatggcacgatctcagcacactgcaacctccgccttccaggttcaagtgattctcctgcctcagcctcccaagtagctgggattacaggtgtgtgccaccacgcccagctaatttttgtatttttagtagagatggggtttcaccatgttggccaggctggtctcgaactcctgacctcaggtgatcctcctgcctcggcctcccaaagtgctgggattacaagcgtgagccaccacgcccagccaggggagggtgattctttatgtcgtggccctggcctgcctacaggacactttagtaggcatccctgactcccgcccactaaaagccaggagtgcttagcatcattttgacaaccaaaagtcgcccccacactttcccaaatccctgccaggagggtgggaccacccccggatgagaactagtgcattgttattagtgactatatttagctaccagcccactagccatatctaaggatgggcagtactacagaccctgcatagagctgcatcggcaaacactgatgtagtgaataaacaaaacaaaacaaactcctgggctcctcaagaagctcagggcagccttgccagggtctctgctcttgaacaggtgcacaaaggttctaaggcctgacatgcctgcactggctgtgtgaccctgagcaagttacttaacttctctgagcccttctataaaatggggctaaatcctagcaacactgcaggatttctgtaaacctcagtctcctaatctctactatggggttaaaattccctacgttgtaggatttggtaggcattaaatgagataatgcatgtaacacatagcacagaatctggcaggcagcaagaactcaatagatgttagtttttaatactgttattattattattgtccagggccaggtggcagctcatgcctgtaatcctagcacttgggagactgacgtaggcggatcacttgaggtaaggagttcaagaccagcctgaccaacatggtgaaaccccttctctactaaaaatacagaaattagccaggcatggtggtgggcgcctgtaatcccagctactggagaggctgaggcatgagaatcgcttgaacccgggaggcggaggttgcagtgagccaagattgtgccactgcactccaccctgggcaacagagactccgtctcaaaataaataaataagtattcttattattatccaagttaggggctcatcaaatgatggctattactcttcattacaaaaatatgttttgcgtcctcatcaccaatgcctgcttcctccataggaagggtgtgtgtcaccaatgcctgcttcctccataggaagggtgtatgagcagcagtctggaaggggtatgtggggcttgccctaaagctgcatttgcatggcatgcacactatttattctgaaactgcatgtttttgtggggtgattagggaagagggtggctaactcccccaaagccctccccttgttgcagcccccgcctcctccaaggaacaaaggagcttatggggacataaagccatccttttctctctcctctgggggcagagctaggggagggggagtggtaaatggcagcacagctctagggcacctgaagtttctatcccctgcgtggagactccaaacaccaggctggggaaggtaaaagtagcctgtagggagatggacgctgcaggtcccatccggaggccaggtatccctctcttgctgatagcactgagacgccctccccaaagctcagccttctcggggagatcggaggggctgagctgcatcctgtccagcactaagtgagagtggccaggagggcaggctggcagagctgtgaaagcacccacttccccagctaggcagtgcaggggctgggggaaagccaggaaaagctcaaggctgggtcgggtggcaccccaggcacagagccccaatgctgagaggggctgggtccagtgtccctgagagtcaggcggacgcctctccgcattcacagcatactgcaaccccgaggtgaatttaggtcagaaggaccaagcctgtgaggctccggctgagagaagaggtgcggtgggggtggtcaaagggcagaccgaagacagccaaaggtcccctaggtccccacaactgctggcctagggtcctgccacctggtgtccaagccaccagggcctgggtttgccccgagacaggcaggctgcggggtgggggtgctccaagtccgctggtcctctcttccccggaacgctccagatttccccacctgtcaaacgcgaggggctgggcctaggccgcctccacgaaccctgacggacccggcccccggtgaccccggttccaaactccaggaccgcccctgccacccggacagggcgcggcccagccgaggaggccatcccgaggcccagggcgcccagaggacgcgggggaagggctgtcggggaccgtgtccctccacgtggcggggcgtggggaggcgcacgtggggtccctccgtgttgggagccccaggccagcctccgggctttgtgtgccatgccggcggcggtcccccgcctcgagagggaaacggagcgggcgcccggggccgcggcggctgcgtcccttgccccgggcccggctaccgccagctcacctgggctccgcgccgccgccgcctcccgcgctctgcgcccccagctcggctcggctcggctcagcttgctctgcgcggccgcgcgctcctctcctccgcccgggcggcgggcgcgcggggggcgggggcgggaggagccgcccggctcggcttgggcgcgtcgccgccccgggcagcgcggggattggccacggcggcgggaaacccgaaagcggaaccgcccgcgcccgccgcgcaccgccccctgcgcgcccccgccggctcggccctgcgccggggaggggtggggaggcgggagccggcaaagacgaaagtagcgaagaggcgaagggcaaggagcagaaagggaggaggcgaagaacgggggaagagaggcccggccgggaggatcggaggcggctgggaggagagcctggaggggcgcggagcgcaggaggtggccccgcaactttgtacccgctcgcccgcggcgcgcacctgcncaggttcttcccgcggcgccctcgggcgggccgcgccggcagcgcttgctttgtttagccaaatgccggggctgcagggcgcctccgggctgaccctgggaaagttcccccaagccggcaagaacacccggggcccctcctgtggcgacccggctgctgcccctgcgctaggcgccgggcggtggatgcggcctggactttgggccaccaccgactcgggggagcccccttccgcagctgcctgccgactgaccacttgctcagggccggccctaaaggctgggggaaggcgttcctctcccatccccagcccacctggatgcaccattgaagttcattctggcttttccagatggctacttagatgctttttgtgaaatacagcatattcttcccattctcccctttttggcacttactttgctggagccttaagtgtgcgttggatcccccagctggataacagcactgtgcggggaagaggagaaacgaagacctggagggctccctgaaccgtcctacggggtcgagcgacccaggggatgtctcactgaccctgccaaacagccaaaagggaatcgagttgacaggagagtcaacctccaagttaataaaaggttcaaagccctctagttaactgggtggatttccagcccgttccgatgtgcttctctggtatttctaggccgtagggacactcacatgcaacgagccaatgagagctccaccccgactcccttttttttttttttttttttttcttttctgaaacggagtctcgctctgtcgcccacgctggagtgcagtgacgcgatctcggatcactgcaacctctgcctcccaggttcaagcagttctctgcctcagtctcccgagtagctgggattacaggcgccggccaccatacttggctaatttttgtatttttcgtagagatggggtttcaccatgttgtccaggctaatcttgaattcctgacctcgtgatccacccgccttggcctccgaaagtgctgggattacaggtgtgagtcaccgcgcccggcccactcccatttttttttctttgttttttttgtttgtttgtttgtttgtttgttttgagacagggtctctctgtgttgcccaggctggagtgcagtagcacgatcacggctcgctgcaccctcgacctccccaggctcaggtgatcctccagcctcagcctccagagtagctgggactacaggcacacaccaccacacctggctaattttttctattttttgtagagacagagttctccctatgttgcccaggctggtctcaaactcctgggctcaagtgatcctcctgcctctgcctcccaaagtgctgggattataggcatgagccaacatgctcggccatccacctcttctgatgttactcaacaatgcatgcatgatgtactacntagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctagtagttcatcaaataaataaataaatacaaataaataaaaaataaataaataataaacagaatcgggctgggtgcagtggctcacacctataatcccagcactttgggaggctgaggcaggtggataacctgaggtcaggagttcgagaccagcctggccaacatggtgaaacctgcatctctactaaaaatacaaaaattagcaaggtgtggtggggggtgcctataatcccagctactcaggaggctgaggcaggagaatcacttgaacccgggaggcagaggttgtggtgagccgagatcacgccactgtactccagcctgggcgacagagcgagacttcgtctcaaaaaaaaaaaaaaaaaatccaatttgatgataagtgcacttcctatggacagcccatctcctttcggacccagccatatttcaattttcaatagccacgcgtggccagagtctcctgtgttggagagcacagctctgtgagatcctctccagctctaagatgctaggattccttttctttttctatctccttcctttgccttagcaatctctaaatctgcagttctcagcctttccttctgtctcaacacacccaggatgaggttcagtggcttcctgctccccggggctcatggagacctcggtctgagctctcggtgagaaaggccctaggctgcacgcacttctcagagcgctgcccggactccaccccatgaagcacagccaattacaaccacgaagaatgttattctagagcaaccttgaacctggctagtttagttgatttttaaatttttatttatttatttttttaaatttttattttttgagacagagtctctctctgtcgcccaagctagagtgcagaagagcgatctcagctcactgcaacctccacttcccgggttcaagcaattctcctacctcagcctcccaagtagctgggattacagacgagcgccaccctaaccctaatttttgtatttttagtggagacggggtttctccatgttggccaggctggtcttgaactcctggcctcagatgatccgactgcctcagcctcccaaagtgttaggattacagcatgagccaccgcgccaggatgaacctgtctagtttagtttaaaatacactgtagcaaacatccgttgttttcttcccagcatctgctcccagcttttctggtaacagaaccccaaatgtcctttggaagccatatctccccaatgcttgcctatgtcacttgggtgggtctgactctagccccagctgcagaggtgggcatgtgacccaggcccaagctgataagcaaaacccattccccagccacagagatgggttgagagatatggccattgatacgatgatggacaggtctagaatctccagggacagctggaaagggagactcagacttggggggctgtaagtgcagcgctgcctcccgggctatgctgtgggtcctgcgagtgaagctggcacggcgggatgcagagccaggaagggagactagggtgttgtcctttgtctctcactctgtcgcccaggcaggagtgcagtggcctctgtcgcccaggagggagtgcagtggcaccatctcagctcagcaacctcctcctcccaggttcaagagattcttctgcctcagcctggcacgagattctcctggccacgctggatctttttggtcagccggacaatacactgcccccccgctgtgcacgcatgtgtatgtgtgtatgtgtttgtgcacatgtgcttaaggcactgagaactgtttcctgtcagttatttgcaactgacagagtcctaacatacaaggaagtcagtcacctgcacccttctcgtgagtgacagactacttgtggcccatcttgccactgatggtcgctgccttgtggttgagagcagccatcctagggcagcctgacttcatacagacaccagaaacacacaaaaagccacaacacacaggtgtaactccttgaccacctctgttcaaggctgacacgcagagttgaaggtgcttccggctgggtgtggtggcttctggctgggtgtggtggctcccgcctgtaatcctagcactttgggaggccaaggcaggtggatcacttgaggtcaggagttggagaccagcgtggccaacatggcaaaaccccgtctttactaaaaatacaaaaaattagttgggcgtggtggtgggtgcctataatctcagctactcgggaggctgaggcacagaaaatcacttgaacacgggaggtggaggttgtggtgagccaagatcgcaccactgcactccaacctgggatacagagtgaaactgtgtctaaaacaaaacaaaacaaaaaggcacttccttccctagggctggactcactgtggcacgtgtgtgtcatcctccaccgggcaccaggccgccacctcacacgtcttgacggacccgttgaaagctacgcacctgcctgttgagactcctacaagcacaagggtggcaggggggtcccatgtccacaggggtctcctattttctacctttttggagtagggagtgagagccccatccagcctcccatgcagccagtcttgagctgtgcaaatctgggatttagacagtgtcactgtccaggagttagaatcggaggaagacagttacctgtgtgccagccacatctcagccagggtgatgccaagctaaagaatgggacaagaggccaggcacagtgggtcatgcctgtaatcctagcactttgggaggctgaggcgggtggatcacctgaggtcaggagttcgagaccagcctggccaacatggtaaaacccatctctaccaaaagtacaaaaattagctgggcgtggtggtgcatgcctgtaatcccagctactcgggaggctgaggcaggagaattgtttgaaactgggaggtggaggttgcagtgagccgagatcatgccattgcactccagtttgggtgacagagcgagactctggctcaaaaaaacaaaaaaacaaaacaaaacaaaaaaaacaagaaaaaacaacaacaacaacaacaaaaaaaacagtagggcaagagctgggatggcttgtggggctccaatgacagcaatgaatgtagaggggctccaggaccccagcctcggcacctggctcacccagggtcatgtgaaggaattgggaagatttctctatcagagacgctccacagtgggggcgatctgctcaggggctgccctccccaggaggccacaagctcgtaccgttgctgtgggtgccggcagagccggcagtacagctggcatctgatttacacacagtggtcgcatctggaatctggaaaaagaaggagcgaaaagaaagtccacgtggcccggccccacacacaggtggacaggcgtggagaggggtgtggggcctggggctcttcccgggggcctcctacctcggggcacaggccctgtgtctggttcatggtgaggatcacgttggtcatgacgaagagggagttttcctcctgcagaggggagacagcacgggcaagccacgctcagaggactcacggagagccaagaaaggcagacgctgactgaagaggacaactcaaacactgaccgcgtgctctcccgctctctcccatcaaagtttataacccaatggaaaacagtgactcaaacaagtccttgtacataaatattcagagcaacacttttcacaagagccaaaaggtggaaacaggtcgggcgcggtggctcaagcctgtaatcccagcactttgggaggctgaggcgggcggatcacgaggtcaggagttcaagaccagcctggtcaacacagtgaaactcccgtctctactaaaaatacaaaaattagccgggtgtgatggcgggcacctgtagtcccagctacttgggaggctgaggcaggagaattgcttgaacccgggagtcggaggttgcagcgagccgacatcgcgccactgcactccagcctggatgacacgagactctgtctcaaaaaaaaaaaaaaaatggtggaaacagcccaaatgtctgtcctagtctagtcacatgatggaatgtgattcagccatgaataaaaaggaatgaagggtccaggcatggtggctcacacctgtaattccagcactttgggaggctgaggcaggaggatcacctgaggtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctggccaacatggtgaaaccctgcctctactaaaaatacaaaaaattagctgggcgtagtggtgggcacctgtaatcccagctactcagaaggctgaggcaggagaatcgctttaacccaggaggcagaggttgtggtgcactgagatcgtgccattgcactccagcctaggcaacaagaacaaaattccgtctcaaaaaaaaaaatttttttttaattacacacgtaagacatatccattctagaaaaacacttacaaaatacatgtaaacaagaacaaacaaattacttttttttttttttttttttttttatgagacagggtcttgctctgtttcccaggctggaatgcagcaatggtttgatctcagctcaatgcagcctcaacttcctaggctcaatcaatcctctcatctcagcctcccgagtagcagggaatacaggggcatgccaccacacacctggctatacaaaatccttttttttttttttttttgaaacaaagtcttgctctgtcacccaggctggagtgcaggggcatgatcatggctcactgcaccctcctcctcctgggttctagcaattctgatgtcttagcccccacctcccgagtagctgggattactggtgtgccttaccataaccagctaattttttatatttttgtagagatgggtttttgccatgttacccaggctggtctcaaactcctggtctcaagagatccacctgcctcagcttcccaaagtgcagggattacaggcatgagatactgtgcctggcctattattgttgaattgtctatttctcccttcaaatctgtcagtttttgcttcatgtgcttggaacactgttgtttggcttgtttataattgttatatcttgatgaatcgactgtttcatgagtatataatgtcctcctttttccttgtctcttgtaacggtttttaacttaaactctatattgtatgatactcatataggcactccagctttcttttggttattgtttgcatggaatatttttctatccttttactttcagctgatttgtgtctttattttatttttttagagacagggtctcactcagtcgtccaggctggagtgcattgctgcaatcgtagctcactgtaaccttgaactcctgggctgatgggatcctcccaactcagtctcccaagtagctaggactacaggagagcaccatcatgcctgactaatttttaaagtactatttgtgtcttttaatctacagtgagtctcttgtagacagcatacagtggatactttaaaaaaaaaagtttgttctcacaatttctgccttttaattagagagtttaactcatttacctttaatgtcattatttctaatttgattttttttttttttttttttttgagatggagtctcactctgtcacccaggctggagtgcagtggtgtgatctctgctcactgcatccattacctcctgggttcaagtgattctcctgtctcagccaccaaagtaactgagattacaggtgcgtgccactatgcccagctaatttttgtatttttaggaaagacagggtttcaccatgttggccaggctggtctcgaacccctgacctcaagtgatctgcccgcctgcacctcccaaagtgctgggattacagatgtgagccactgcgcctgccttgttttctatatgtcatatcttttttgtccctcagttcctccattactgctttcttgtgtgttaagtagatgttttctagttttattttgagacaaagtcttgctctgttgcccaggctggagtgcagtggcacgattgtggctcactgcaaccttgacctcctgggctcaagtgattctcctgcctcagcctcctgagtaactgggactgcaggcatgtgcaaccatgctcagctaattgttttaaatttgttttttgagacagggtcttgctgtgttgcccaggctggtcttgaactcatggcctcaagtgatcttcctgcctcatgctcccaaagtgttgggattataggcatgagccactgtgcccagctctagtgtaccattttaattctctctctcttttttttttaaacatactaacaccaaccggaatctcttgtttcttttgctttattcttttgagttattttctggattgttacctttctcccacctagttcaacccctcagaatcaccaagctaaaggatattaatgctggatctttttgtaaagacaagaaccttttcatagtgtgaataaccgccccctgctatatttgtcatagtctgaaatcagattgtcacatgttgtgttttctaggaatgtggttcctgttttaacgtagtacatgtcaggtaaaaggtaagccagagatagccattcaggagagaactgccagaaatgaaacgcttcctggtgaagggcagtgggtttgggtatgtacagtgccatgatgtttctttttcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaaggtaggaagctgtacgaagactgttaggcaatgctattccagaaagcattgaaagtttaggacccagaagaagaaaagacattaaatttgggacagcatttaagttctgagtgttcacaaatatatattaaaatttcatgcagcatttaaagtgctttcacatgcatgcttggcagaaagattgaggacaagtgaatggctattttaaccctatagagccaagtaccaggctagaagtcaggagttaaagacttttttttttttgagacaaagtctcactctgtagctcaggctggagtgcagtggcgtgatctcggctcactgcaacctccgccttccaggttcaagcaattctcctgcctcagcctcctgaatatgtaaaggcgcacaccaccaagactggctaatttttgtatttttagtagggctttctccatgttggtcaggctgatcttgaactcctgaccttgtgatctgcccacctcagcctcccaaagtgctgggattataggtgtgagccactgcgcccggcctttttttttttttttttttttgagatggagtcactctgtcgcccaggctggagtgcagcggcgtgatctcagctcactgcaacctctgcctcccgggttcaagtgactctcctgcctcagcctcccaagtagctgggattacaggtgcctgccaccacacctggctaatttttgtatttttagtagagacaaggtttcaccatgttggccaggctggcgtcgaactcctgacctcaggtgatccacccgcctcggcctcccaaagtgctaggattacaggcatgagccacttcgcccagtcttaaagacctttttgaaaacctcaccctagtggtttgttttttctctctcaaagaatggagaatataaaagaatcttctggtagttgttgaacaaataaaactaaataccacgttttgaaaactatacgtgaagggttgagttaaatgtgtgtgttattttcccctttccgtcagctctggaggctgccatcgagaacctcaatgaagccaagaactattttgcaaaggttgactgcaaagagcgcatcagggacgtcgtttacttccaggctcagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaatacgtatttgttttattccccttttcttccctcttggtagcaaaggacaccaactttttcttaataaatgggtattttgctaacaagttagtgcaagcatctcagattatgttctctctgggcaaaattgccaatatcttgattagaaattgtacgcactccatcattatgtaaattcatttagcacctattctcagacaagagctcttcctggaattggtagatctctccagggtggtcagtgcaggtctgtatgaggcttggactttcttgctgaggcctccctgccttgttggactgaaccagcgcttgtggttcctgtggctgctcacgaggacctgttggtccctgcctggagattaagaaggaaaagattttttcataatttttggcccaatgaccaggagcatttttcagtccctttctagatgttggctttgttatatattctgcatgagaaatttttttttctatatttaactctataaatgagggatgatgataaattacgtccaggaattcatcatgagtaaggtgattataaattaagggggccggctgcggtggctcacgcctgtaatcccagcagtttgggaggctgaggcggttggatcatgaggtcaggagatggagaccagcctggccaacgtgggaaaccccatctctgggatagtaacagtagttcggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatagttcatcaaggcttttatctccgcttctaagatgtttattttaaaggtccactgctgagagggaagggcaaggagaggatataatattttacttttcatggcattctctcctacattatttgaccttttttcttactatgtgcatttgttacttttatcattttttcaaaatcacttttatgtttgtttgtttgttttttagagacagggtctccctcatgtcacccaggattggagtacagtggcacaatcctagctcactgcagccttgaattcctggactcaggcgatggacctcagcctcctgagtagctgggactaaggcactcaccaccatgcttggtcggctaatttttttaaaaatagatatagagtctcactatgttccccaggctggtaaacttctggcctcaggcgatcctcctgcctcagcctcccaagtaactgggactacaggctcataccaccatgcccagctaatttttttaaggagataaagtctcactgtgttccccaggctggtctccaactcctggcctcaagcgatcctccttctttggcctcccaaagtgctgggattataggcatgagctatggtgcccagcccaaagctagttttagaaagtattttgaggattcccacttctgtaatattttttcctttaaatctctgttcaaatattaagttggcagagatcaaggagggctgatctgctacctttctatttaaccagagatttacaaattgaaggagttgagtgacctgtatatgtatctggagtaagagtgttactcaggaaaacaagagcacttcaccttcactttctaacctcttatcctggtctatcactatctgagatattacaactatgcttagcgttgtttattccctatttcccctgatataagctctataacaagtttttttttttctttttcactgctgtatccctagtacctacaatagtgcctagtacacagtaaatgctcaataaacaactacaaggattttcaagaaatccttttagctaagtgacaaagatttacacaggcccatagatccaagaccagaaacaaagaagcctgggcctgagtaaatcaggaattaaggaaaatgtacacattaataaaaatctacctctcctcatttatattctgtgcaattagctgtctacccattgataatattgtaaacatagacaaattctgagatgggtgcagtagcttatgcctataatcccagcactttgggaggccaaggtgggaggatcacttgagaccaggcgttcaagaacaacctgggcaacatagcaaaaccttgtctctatatttttaaaaataaaaagaagaaattctgttcatcaaaatattatttgtggccgggcgcagtggctcacgcctgtaatcccagcactttgggaggccgaggcaggtggatcacctgaggtcaggagttcgagaccatcctgaccgatatggtgaaatcccatctctactaaaaatacaaaaattagttgggcatggtggcatgcacctgtagtcccagctactcgggaagctgagacaggagaattttttacctgaacccaggtggcgagatggcagtgagtcgagatcgagccactgcactccagcctgggcaacagagcaagactccatctcaaaaaacaaataaattaattaattaaataaagattatttgtatccagaaggctgtgtacaaatttctaacccccaggggaagcagttccttactaagttaaataggttattggtaaatattaaaaatggcatttctattatttttgagtacataaaaaaagaaaggctctgatcgagaggttattaaatgtgggaagaccaaaagaagttagttattacaagatatcatggaatgttgcaaaaatcatggagttttgaggagccttaaatatttttgggtacaactatcaatctgatgtttgaatacccttaataacatctttggtctaggcctcagcacctcactgacaccttcctcagagggttcaataaggggaaactgtttccttataatgagcagaaatattttgtcctttaacctacacttacttaccagctctcaatcttctcccgtagccataccctcaatcaatctaagctcttttcacatgacttttcactacatgaagatgtcaaacacatgcttggataagtcatttttttccaggctaaacatgtctcacatccctcccacattacttatatgatatggctttgaatgtctcaacaccctgagactgttccctccccacacaagcttcagcttgtctacatcccttttaaagcctcacaactgggttggcccagtggctcatgcttgtaatcccagcactttggaaggccaaggtgggaggattgctggaagccaggagtttgaaaccagcctgggtaacaaagcaagatcctacctctacaaaaaataatttttaaaaaaattagctgggcattgtggtgcatgcctgtagtcacagctaggaggctgagatggactgcttgcttgagcccatgagtttgaggttacagttagctatgatcatactactgcactccagcctgggtgactgagtgagaccttgtctcttaaaaacaaaaacaaaaacctgacaaccagagataaaaagaattccctaggtgctgcctgacacagagaaagggatagatgtctccattattgaactgtgaacactatgctcccattaatacacgctatagtctgtatagaaggatgcctgtagcaaagaccacacttctctcaactggtaaaaagccacagggcaggtgggggggtgaagggatctttgaattagtaatttcccacctttcaccattatttacattatttcattatttccaagatagcctccatgttttgaaagttgttttatctacttaattctatttactaaaacataattgatcgattttcctatttctattcattaaaaacagaggcacactgaggcaacagtataaaccagtgtcacctgactgagcagcctgaattctacctgaaagcaaacctgactttcagtaagcctatgtagtctttcatccagtaaaggtacaactgccttctggctttttgaaatactaaaaatagcttctgcatccccatttttacctccaaaaaatcctttagggactctctggcctaatgacctaatttctttttcactgaacggcctgttgttcttagaagtaatgaaagaggctaggcactaagacggcaatgttacatagtgacactagggggcagactatttaggcagaaggttttcataaactgttccagtgccaataaggttccctctatggaagttactgactagtccaggttgatgagctgctttcctatcttctttttaaaaaatacattttttaaaaatgcatcacaattaacatttgagaattcatttcttccatttcttttcccttttcttttctcccaaaatagcaaatctttatttattttttctttttttttgagacggagtttcactcttgttgcccaggctggagtgcaatggcgtgctctcggctcactgcaacctccacctcccgggttcaagcgattctcctgcctcagtctcctgagtagctgggactacaggtgcctgccaccacacctggctaatttttgtatttttagtagagatggggtttcaccattttggccaggctggtcttgaactcctgacctcacgtgatccacccgccttggcctcccaaagtgctgggactataggcgtgagccaccgcaccaggccaaacagcagactttttattgtcatcggttccttcaatttgcgcaaggacaaaggtctataaacttactagtgaccgaagcggcagtgcagggcggcaagattcagagcggcgtatctcaagctccggccatagccctcttccccattacttttgctttcggctccggtaagaatcagacgatcaaaataatggaggagactgtgtgttgaactgaaaacatcttggacacggaggttgtttaagtagctgagataatgctaaaacaagaaataatcaatgtattttaaacgctgtaaatatctctggtgtaagacaactgcagagagttccactgtctacaaacactagtgtatcccatacccttctaataagatggtcatagtttagcttaatcttctccctagaggcagaataaaacagcttcaagacacattccccctagagggagtccacaaattaaaaatgggagttccattagtatttgtgtcagttttatctcaaatatactccactatgccactggttacatgagtgatagatgagaatactgggccttacctagttcaaatattgaggaaaactgagtgttcagaattaaagatcctaaaacctgaattcatatacaaattataaaattaagttttattaatgtacaagttaaaacacactgagacttactagtttactaagttaattattttcattttttttttaatcactgaaacttccctaacaggcagatctcagttactaggaagcaaaatagatatatttctgcacccaaagtcagatggaaaatccaaatactatttaagaaaattttccgagtaaaaaatccattaaggaatggaattattagaactttaaaaataaacactgacaaaagaagagaaaggaaaagagtttttcagcctcaaaactgtcatttaggctgggcgtgatggctcatgcctgtaatcccagcactttgggaggccgaggagggtggatcacctgaggtcaggagttcgagaccagcctggccaacatggtgaaaccccgtctctactaaaaatacaaaaaattagctgagcattgtggcgtgtgcctgtactcccagctactcgagaggctgaggcaggagaatcactgagaacccgggaggcagaggttgcagtgagccaagatcgcaccactgcacgccagcctgggcaacaagagcgaaactcagtctccaaaacaaacaaacaaacactgttttttgcatcagtctagtatattatctccagtccaaactttacaacatcaggaggatgatgactgaaagagaacatcaagagtaagaagaaatcgcctatggcccgaggagggagggaggagctttgcaacctataccgagttgtttgcctaccaagaacacgatttccttcaagaacctgggccaatgggctgattctcatttgcacagctactcaatataaaaagtagccttggccaggcgcagtggctcacgcctgtaatcccaacactttgggaggccgacgcgggcagatcatgaggtcaggagatcaagaccatcctggccaacatggtgaaaccccatctctactaaaaatacaaaaattagctgggcgtggtggcacgtgcctgtaatcccagctacctgggaggctgaggcaggagaatcacttgaaccagggagtcggaggttgcagtgagccaaggtcgtgccactgcactccagcctggcaacagagtaagactctgtttccaaaaacaaacaaacaaaaaaagttgccttgtcattcctttccaacacagcaacaaattctgggaaagacttaccgcttcagcaaaatcaggattaaatttcaacaaattgtttaattccttctgcaaggaagctggagtgagggccttagtctcatcatctttagcaaagagcctgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatatttagccatgtctttttttctttttttttttgagaaggagtttcactcttgttgcctaggctggagtgcaatggaatgatcttggttcactgtatcctctgcctactgggttcaaacgattctcctgcctcagcctcccaaatagctgggattacaggcatgcgccaccatggccggctaattttttatttttagtagaaaaggtttcaccatgttggtcaggatggtcttgaactcctgacctcaggtgatccacctgactcagcctcccaaagtgctgtgattacaggcgtgaaccatggcgcctggcctagcaacattcttaaaatcagatatatacatatagaaaagtctaggccgggtgtgatggctgacacctgtaatcccagcatcttgggagactgaggtgggaggattttgtgagcccaggacttacagaccagcctgagcaacacagtgagactctatctctacaaaaaaattaaaaattagccacatgtggtggtgcattcctgtggtcccagctattcgggaggctgaggtgggaggatcgcttgagcacaggaggtggaggctacagtaagctgtgatcatgccccgcactccagcctgggccacagagtgagaccctggctccaaaaaacaaaacagaacaaaacaaaaaacccaataacgattgatgaggattgtagtgagttggaaacggcatgccctaaataaaggtggcttatttatttatttatgagacagagtctcactctgtcgtccaggctagagtgcagtggtaatcataggtcactgcagccttgaactcctgggctcaaggtatcctccggcctcagcctcccaagtagctgggattacaggtgcatcccagcacacctggctaatttttgtatttttagtagagacagggtttcaccatgttggccaggcatgtgtcaaactcctggcctcaaagtgatccacccacctctgcctcccaaggtgctgggattataggcatgagccgccacctccagcctatttatttatttatttttgagatggagtttttgctctgttgcccaggctggagtgcagtggcatgacctcggctcactacaacctctgcctcctgggttcaaccgatcctcctgcctcagccccccgagtagctgggattacaggcaccccccaccatgcctggctaatttttatatttttaatagagacagggtttcaccatgttgcccaggctggtctcgagctcctgacctcaagtgatctgcctgccttggcctcccaaaatgttgggattacaggcatgagccattgcacctggccaaaggcagcttatgctgtgcatatccagtcagttgttaccatctaggaataaatcatgttaccaaattttcaaatttttcaagtgaagctggaaatgtagttctttgttggcagaaatatcctaatttttaagtgttggcaaacaccatgcaaagcaaataaaatatatctaatgagccgcatttagtttagattgcaacttcagtttgcaacttctggcttagaaattcatcccttttggtccccagcacctagaacagtgccttaaatatagcaggagcttagcacagtgttactgaataaatgaatcaatggcttgaaagtcttaccaatttacagtaaaattgttatttaggattttgtaaaattactttcctctttccattcattaagtgttcctactcaggattttaaggttgaatactagtttattccacacagaccctttgtcaaaccttatttatggtatacacatatgcaaaaatatcctaaagagctgggagattgtaagtatgctttttcattaatagagtgaggcataaaaataaaccgaggcaaagaaagaggttaagtgagtattaaattcctggcaaaagccagcttctcctttcacaaataaaagatagttatataataattatgtatggtaactaaaacatacagagttctcaagataggaaagcttgtattacaagatatcaatgtcttcttttttgatagcatcatttagcttatacatatctgccttcttttttgtttttgtgaactaataatgcatattcattcattattcattaaacaaatagcgattgagaaaacaaaaaccaggcatgaggctgcatgcagtggcccatgcctttaatcgtagcaatttgggaggctgaggcaggaggatcacttgagtccaggagttcgagaccagcctggacaacatcgcaagacctcgtgtctacaaaaaataaaaaaattagccatgcatccaggcacagtggctcaggcctgtaatcccagcacttttggaggcggagatgggcgggtcacctgaggtcaggagttcaaccagttcaagaccagccgggccaacatggtgaaaccccatctctacaaacaatacaaaaattagccgggcgtggtggtgcgtgcctgtagttccagctactcgggaggctgaggcaggagaattgcttgaacccgggaggtagagattgtagtgagccgaaatcgagcgactgtactccagactgggcgacagagcaagactccgtatcgggaaaaaaaaaaaaaaaaaattagccatgcatggtggcacaagcctgtagtctcaactactcgtgaggctgaggtgggaggattgcttgagcctggcattcctgagggcgagggggtctcctgccctgctcatgtctaattacctactttaactggaggctgaggttgcagtgagccgtgagcgtgccactgcagtccagcctcggtagcagaatgagagagagagaaagtataatttaaacaaacataaaaatgggcacaaggcaggccgggcgcggtggctcacgcctgtaatcccagcactttgggaggccgaggcgggaggatcacgaggtcaggagattgagaccatcctggctaacacggtgacaccccgtctctactaaaaatacaaaaaattagccgggcgtggtggccgatgcctgtagtcccagctactcggtaggctgaagcaggagaatggcgtgaaccagggaggtagagcttgcagtgagcagagatcgcgccactgcactccagcctgggcgacagaggagactccgtctcaaaacaaaacaaaacaaaacaaaaggcacaaggcacagtgtgtgcatgtggatagccaaagttgaatggtatgtggtttttctttcaagggacataaagactaatagggataccagatcattaataataattcagggtatagagaactaagtgtcttgggagaggtacagatgaacggaaggggaattgtgaaaaatcaggttcaaaatgttggctggggattgcttttggagggctttgaaatgcagagtatagattttgtagtttattaggtaggaaactgactcagcacatggaggtgatgttgctaatgttctatttcacgtaaggatacacgaccactggcaacctgatctggctgtctgcaaatggcatttgtgaaacgctgaagaaaaatctcatgttcctatctttaaaaagacagagttaaactcctaaacatttgagtttaaaagtaacataataaatacatactttaagggtgcaaatttaatttcggtacttttaaacacaatcatttaaacattctatttgaactattttcaaattacatgaacaagccaggcgcgctgcctgtagtcccagcttctcgggaaggcgggaggatcgctcgagcccaggatttgggagggtgcagtgctctttgagggcgtctacgaataaccactgccctccagtcttggtaacatagcgagatatcgtctcaaattataacaacgacaaccaccaccaccaccaccaacaacaacaaccaacaacaaaaaaaccactttgggagctcctcagtcccttcagccccgaccccaagcatcgacttcccctcccatccggtccctgtccacgtagcctgggaacctgctcccactcggcaaaagtttctgtagggagtcagtcttttggtgcacccctccccgcactcttgtacattctgactggctgtcgctctcccatgtgctctgacagactgctctgattggttaacaaatgccgcgagcacgcggatgtctgtttcctgggatattgtgagggcgggcggagatgtagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcaggtgagaggcgcccgctggctcctgctcgtgcagcaaacttttactgagcatctgctctgtgcggaaccctgggcttggggacactcgtgtccatcagatactctccctgcctggaggaacgtgaagaaataaagatagctactaccggtagctaacacgtactgagcgtttacggtgggccaggcgctttacatgcattttttttttttgcaagttcatgtctggctccagtatttattagctgagagttagagtctcagatcctgtatcttctttaaaatggggctatacaatagagcgttggagacacagggataagtcatacaggctccctatcctagaggaccgtaataaacagtaaaaatgccataaaaccgggccgggcgcagtggctcacgcctataatctccgcactttgggagggtaaggcgggtggatcacgaggtcaggagttcgagaccagcctgaccaacgtagtgaaaccccgtctctactaaaaacacaaaaaattagctggacgtggtggcgggcacctgtaatttcagctactcgggaggctgaggcaggagaatcgctagaacctgggaagcggaggttgcagtgagccgagatcgcgccactgcactccagcttgggcgacagtgcaagactccgtttcaaaaaaaaaaaagacatatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacctcccgtccggccccgccggcttcgggcagtgaggggcttagcacctgggccagcagctgctgtgctcgacttctcgatgggccttagctgcctccctgcagggcagggctcgggacctgcagcctgccatgcctgagcctccccccaccccctgccccccgccctgagctccttggcagccggaacctcccggacgagccgagctagtccctcctgctccacggacacccggtcccatcaaccacccaagggctgaggagtacgggcacatggcacaggactggcaggcaggtccacctgcagctcctgtgcgggatccactgggtgaagccagctgggctcctgagtctggtggggacttggagaatctttatgtctagctaagggattgtaaacacaccaatctgcactctgtatctagttattctggtggcgacttggagaacctttatgtctagctaagggattgaaaatacaccagtcagcactctgtatctagctcaaggtttgtaaacacaccaatcagcaccctgtgtttgctcagggtttgtgactgcaccaatcggcactctgtatctagctcaaggtttgtaaatgcaccaatcagcactctgtgtctagctcagggtttgtaaatacaccaatggacactctgtgtctagctaatctagcggggaagtggagaactggagaacttttgtgtctagctcagggattgttaaatgcaccaatcagcaccctgtcaaaatggaccaatcagctctctgtaaagcagaccaatcagctctctgtaaaatggaccaatcagcaggatgtgtgtggggccagataagagaataaaagcaggctgcggagccagcagcgacaatcggttggggtgtttttcaggtgtgtgggtggtttagttttttcgctgtttggggccatattgcttttatgagctgtgacactcaccgcgaaagtctgcgaagcttcattcatgtaagcccccgagaccacgaacctgccgagaggaacgaacaattgtagacgcgccgccttaagagctctaacactcaccgcgaaggtccgcaacttcactcctgagccagcgagaccaggaacccaccagaaggaaaaaactctggaacacatcggaatatcagaaagaacaaactccagacacgccgcctttaacaactgtaacactcacagcgagtgtctgcacttcattcttgaagttagtaagatcaagaacccaccacttccggacacaaaagtaaggggattacaggtgggagcccccgcgcctagcccaaactggcgctgattcttcatttgtatatcgcagttagtaaaagggctccctgacccctagccttgaatttggggagtaatttgatattcttgatcatcactacctcctttgtaatatattctttcaaagtatgtctgtttccctttcccccagtacttgtcagtattttgtttgtggggcgcggggggggtctcattctattgcccaggctggagtgcagtggcgtgatcttggctcactgcaacctctgcttcctgggttcaagcgattcttctgtcttctgagtagctgggattataggtgagcgacaccacgcctggctaatttttgtatttttagtggcgatgaggtttcatcatgttggctaggctggttttgaactcctcacctgaagtaatctgttcacctcggcctcccaaagtgctgggattaagaggtgtcaaccaccgtgcctagctaaatgtttgcattttttatggagacggggtttcaccatgttgcccaggctggtctcaaactcctaggctcaagcaatctgcttgccttggcctcctaaagtgctgggactgcaggtacgagccactgcactcagcctaaggcattttcttttctttaaatttatttttatatcttactttattcatttatttttcgagatggagtcctgctctgtcacccagggtggagtgcagtggcgtgctcttggctcactgcgtcctccgcctcctgggttcaagcaattctcctgtctcagcctcccgagtagctgggattgcaggcatgtaccaccacatctgactattttttctatttttagtagggacagggtttcaccatgttggccaggcgggtctcgaactcctgacctcaagtaatccacacgccttggcctcctaaagtgctggcattacaggcgtgagccaccatgcccagctgtattttattttatagagacagggtttcactgtgttacccaggttagtcttgaactcctggactcaagtgatcctcttgccttgacctcccaatgtgctggggttgcaggcgtgagcccgttcccagatattttctgaacctttgttcagaaataccaatggtgaataggcagtggacaacatttggggaataggcaggaagtggggaaggtgcggagggggtggagatgaacacccaaactctggggccttgcctctcaaattttagacaccttgaaaatatacctgattccaatctcttacacaaatggtaaacataaataggaagatagcgcatttggcaaacaggtgccaagcaacagtcttgaacagatgattgaacatttcatttgtttctctgttaataattaatccatttggaatgtaaatttccagctaatcttttaactcttctttagccactctagagtaataggaaaagggtagtaagcttctggatttgatttttcctaagtacaaattatcctgagaactcaaattacatgatttttctttttctttcaggaaaagcattcaggtataattaagtcgaacaacatcgtgcccataattttccacttttaagagatggggtttcactctgtcacccaggctaaagtgcagtggtaggattatagctcattgcagccttgatctcctggcctcaagccatcctcccacctcagcctccgaaagtgttgggataataagtgtaaaccactgtgcctggtttactttctacatgttaacactagtgattaaatgaagattgaaaatagaaacatgctaggggaaaaatactttgaatgttatctatggctccactatattggagaagttgtcaaactttttacaaaatcaaaatgaaaaaaaagaccaaaaaaaatttttttgagtgtctcactctgttacccaggctggagtgcaatggtgcaatcaccatggtagccttcactgtgcaggctcaagccaccctaccacgtcagcctcatgagtagctgggaccacaggcacgcaccaccttgcgtggctagttttttaatttttttgtagaggcagggtcttgctatgttgcccaagctggtctcaaattcctgggctcaagagatcctcctgccttggcctctgaaagtgctgggattacaggtatgagccactgtgcccagtggaaaagcaaattcttttattttgtttagcttgttaaaaattgagatgaaattcatatgacatcaagttaaccattttaaagtaaataatttggccaggcatggtggctcacatctgtaatcccagtactttgggaggccaaggtgggcagatcacctgagatcaggagttcaagaccagcctggccaacatggtgaaaccccatctctactaaaaataaaaaaaaattagccaggtgtggtggtggccacctgtaatcccagctactcgggaagctgaggcaggagaatcatttgaacctgggaggtggaggttgcagtgagccaagattgcaccactgaactgaggttttnncccttaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggcggttaaactggtttaactaagactgtataaatctgaatttttgaatttaagtttagacaaaaccagcacctactgcttagcttctatggcctggatttaaagacttgccaccaccaagttaccaatttggaggaaatgttaagatttccagagtctcatcaaaagattactttgggaggaagaggcgggtggatcatgaggtcaggagattgagactatcctggctaacacagtgaaaccccgtctctactaaatatacagaaaaattagccgggcgtggtggcgggtgcctgtagtcccagctacttgggaggctgaggcaggagaatggcatgaacccaggaggtggaatttgcagtgagctgagatcacgccactgcactccggcctgggcaacagagcgagactctgtctcaaaaaaaaaaaaaaagtttagacaaaaagcacaagtgcccacaaaactctggcaacttatgctgcttctaaagggaaaccatgacctgctcaagccagttactaccaattgtggttgcagacaaacaagtgggaggccttgatttacatgctttgatcttcaaaagcagaaaatttttttctttactattagccacacaaactttctgcccaaagcacaggggcatctgcctcctggtgttcacaggtattttcagctctgttgatggactaataaattctgagcacccaaggccatatgtgttactcactgcacagtcaggagataacagactctgagaagtggccactcccagctgcactgaaatgacagttggtctcaactcaaccatcctgagtcaagtcaagttggacctaaaagagatttcacaacatttttgcataatagctcaagttcctctttttttttttttttttttgagacggagtttcgctcgtcgcccagcctggagtgcaatggcacgatcttggctcactgcaacctccgccttccagtttcaggcgattctcctgcctcagcctcctgagtagttgggattacagggacccgccaccatgcccagctaattttcgtatttttagttgagacagtttcaccatgttgaccaggctggtctcgaactcttgacctcatgatccacccgcctcagcctcccaaagtgctaggattacaggcatgagccaccacacctggcccaagtttctcatttcttatgtggtactggaagggttaagagcaactctggcatcagagctaggttcaaattctgcatagccactttttaaccatgaggttttagacaagtctaacttctcagaggttagagaagcaaagcaatgtttatttcagaaagttgctttgaggactgcagaggcaactacagcacctagcgcaatacctggacacaagaaacagcacatcagcagttaaccttactgataagcaagcaggaaatgtaagcactgttgctcatgtggcattgtttttttcttttttttctttttttttttttttgagacaaggtctggctctgttacccaagttggatttcagtggtgtgatcttggctcactgtaacctccacacccaaggctcaagccatcctcctacctcagcctcctgagtagctgggactaccacgcctggctaattttttccaaagacagggtttcgccatgttgtccaagctagtcttgaacttgtgagctcaagcattcctccagcctcaacctcacaaggtcctaggattacaggcgtgagccaccgcacccggcccccatgtgacatctttgaaggtgctcccaccatctcttctgaagaggggtgctaggccaggtcacttgatttaggaactgaccaagacaatgtaaacaaaagcttttaaaactaattttattcctaaagttaaaatcagctagcgggtagcactgaaaatacaccttcactatacaaaacaatgtaaactgattacacattaataaggaatttagcacacacacttctaataaaagaagctagatgcagcccttgctataaaaagctatacctgaacaaaaatggacatgtggagtctaaggccctggcagtcgactagagaatgtcagttgttcccaattatgtttaaatgcagaaacagcaacaatgtggaaacttacattcatcaaatgttagcatttaaaatatacatgactaataaagtgaacattcagaggagccactgctcagcatgttccatgtcggccacttgtggacactgatctcatccaaagaggacagaagtttcaaacatctgagcagtttaagttaaaaataggatgaaggggaaataagagaacaggataagtgtcctcccaagacagcagtggctgatgcccacatggcgcaaacaggctgacttcaatgagtgttcacgggatgtgtgataaagcccagctgagcccgggaagctcacgtgtccacaggcagacaggctcacggcatggaccaatgtttccacaactcaggatggatctttctgtccccacttagtagtcaaaataatgttttaaaatagcttcagcctttgaacataactttccagtcccttctgtgcattgaaatgttgggggtcaagtttgggggtgactgtcctggtgaggggagcctgtttcaggacttgaacacgtgcacggctcgcaccacatactgccggcagatgggacactcactcatgcgcttgccgcacttggtgcaggtaaccatgtgcccacactccagtaggacacagtcgatgacggcatccatgcagatgcgacacaggctgtcgtcttcctcatcctgcagctgcagccgctcgccatctgaaaggcaacagagagctaaggcctcggcttcaggcatggccagtcagccagccaccctcccagtccgaagctgagcagccacctgctgaatgacccctgcaggcccaatgccaccccagtgttgtacaagatataatcccaacttctctgcactttggttctctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatgtggcgagctaaaaggcattacctcatgaaggatgagacaaattgaaagtatttcgggatcaataagataaacctcccagttgggtgctgtttatctttatacttgtaatcccagcactttgggaggctgaagcaggcgtatcacttgagctcaggagtttgagaccagcctatgcaacatggtgaaaccccgtctctacaaaatatacaaaaattagctgggtgtggtgtgtggtggcacatgcctgtagttccagctactagggaggctgaggtgggaggattgcttgaacctgggaggtggaggttgcagtgagcctagatcacaccactgcactccagcctgggggacacagggagactcggtctcaaaaaaaaaaacaggccaggtgcggaggctcatgcctgtaatcccagcactttgggaggccgaggtgggcagatcacctgaggttgggagttcgagaccagcctaacaaacatggagaaaccccgtctttactaaaaatacaaaaattagccgggtgtggtagtgggcacctgtaatcccagctactcaggaggctgaggcaggagaatcgcttgagcccgggtgatggaggttgcaatgagccaaggttgtgccattgcacttcagcctgggcaacaagagtgaaactctgtctcaaaaaaagaaaaaaaaaaaaagaaaactgcagtgattacattaatttattgggatattttagagattaacatcactgactgtaataaaaatagttaagaggcaaaatatagaagtctcctgtctccttgagcctttgttcacccctgtgctggtaatgagacctttctgttgaagttacaattcaaggattaggcattccatccccaataacagttggcaaaagtcaaaataaatatttttggattccacaaaatttgaatttcacactgaagtgattcaattttaaaacatatttacttcaagtcaagtgtccaagtaccatataagtaatatcatctcaaacagctacagaaatgtgaaaatacatttcagacattcaccaacagacgtcactgatacgttgcagttatcgtatttagcataagcttcaggtattaaaagtaggccaggtgcggtggttcacgcctgtaatcccagcattttgggaggccaaggcgggcagatcacttcaggtgtggagtttgagaccagcctgttcaacatggtgaaaccctgtctctactaaaaatacaaaaattagccgggcatggtggcgcatacctgtaatcccaactacttgggaggctgaggcacaagaattgcttgaacctggggaggcagaggttgcagtgagccgagatcacaccactgcactccagcctggatgacagagtgggattctgtctcaaaaaaaaaaaaatgtagattaagtcaactctccccaccctcttgagcaagtgctgacaaggtcgagaagacgataaatgggactaagcctttcttcaaagatcataatcatacacatttattaaaaccttgattgtgtgtagtgctatgccatgctaaatgattcacacagagaattagctaaaccttgcctctctcctctaacagtttacaatccaaggcagacaggctgacgctcttgcacatttatagccaaattagacagacgcaatgaaatacgaacattatcaactgataaatgaataaagtagacattcagggaaggagacattcagatggttgtgataagaagagttgccttgaaaattccaatttcagactatgcaggataaaaagattagtactcttatccatcaccaccttcatttacaatcatgtaagaatatacatgtgcctaggctgggcacggggggctcatgcctgttatcccagcactttgggaggccgaggtgggtggatcacaaggtcaggagttagagaccagcctgaccaacatggtgaaaccccatttctagtaaaaatacaaaaattagccaggcatggtggcgtgcgcctgtaatcccagctactcaggaggctgaggcaagagaattgcttgaacccgggagacagaggttgcgaagagccgagattgcaccatttgcactgcagcctgggcaacagagtgagaccccatctcaaaaaaaaaaaaaaaaaagagatacatgtgcctaataattgttcccaaaaatgtcaacctttgtccatcctcattctgaaacccttacaccttctagagtcacaatacttgtagcagtactttttttttttctttttgagacaggctcttgctccattgcccaagctagagtgcagtggcaagatcatggcttactgcagcattgaccttcctggctcaagtgatcttcccccctcagcctcctgaatagctgggactacagacaccatgcctggcccgttttttttttttttttttttgtagagacaagatctcactatgttacccagactggtctcagactcctggcctcaagcaatcctcctgcctcgccctcccaaagtggtgggattacaagcatgacccaccattcctggctgcctgtagtaattttgtaagactataatttcaaatggtattcttgaacacacatctgactatgtctttgctaaaaggttaataaaatagccttttcttttcagcactgctgccaagatttccaaaacagctcttttcatcttgtattgaatttttttttgtttcaactgattcaattctatttaattcttatctcccctacttcaacttttttttttttttttttttgagacagagtttcgctcttgttgtccaggctggagtgcaatgacaagatctcagctcactgcaacctccacctcccaggttcaagcaattctcctgcctcagcctcctgagtagctgggactacaggtgcacaccaccacactcggctaattttcatggtttttttagtagagacggggtttctccatgttggcctggctggtctcgaactcttgacctcaggtgatccacctgccttggcctcccgaagtgctgggattacaggcctgagccacaccacctgctgaagctaattctttagaatggcccctttaatttgaatggctaattattacaccattagacgcttgaaaaaaatacttttggccaggcgcggtggctcagcagtacacatatgcaggtgtgtatattgatatgacactcatagaagagttctaggaatttgctcgatatgtttatagctgggtgtgaactgatagtcccgaagctgaaagtggaaactccagtacctagattcagatccatgtttcaagtcgctctgaatatcacttttttttttgtttgagacagggtcttgctctgttgcctaggctggagtgcagtggcacagtcacggctcactacagcctccacccctgggctcaagcgatcctcctgcctcagcctcctgattagctggaaccaccagtgggcgccaccacacctggctaatttttgtaatttttgtcgagatggagttttgccctcttgcccaaaatggtctggaactcctgggctgaagcaattctcccacctcagcctcccaaaatgctgagattacaggcctaagctaccacacctgcctgaaaattatctttaaaatgacctcagatgcctggctgagtaatgtgtaggtactagaataggcacaggggtgccataaaaaatgttagtagatgaatgacataatccaagtttcttggttttcgttgtttttcctgtaaatgaatgacccctaatagaaattttcagttcatgactgttaatggggatgggggagaaatgtccagatctgttgtaatccttagctttctaaaattcttgcccagcctctaaagcactgctctccaaatcttattatgtctaagaatagaaatatcctggagcgctgacctgatagaagtatttttcagttgtttgatagtgttcacctcgactcttattagaagagagggtagcaaagattgggatgcctttccaaaaatatcgaagcctttatccaatatggaatcactgtcccacagcagtgagaattaccttaagcaaagttatcttgcttagaaagttgactataaagacggctatgaggaccgaaatcttaattttcttttttttttctgattacaaaaggaaaatgcattattgtagaaatatagaaaagtgtacaaaagaatattaaaattacgattccactacttaaagataagcagtaccagcattttgatgtacatctgacaattacaacagccagacttaacatttactgagtcttctaattttttttttttttgagaaagagtcttgctctgtcgcccaggctggagtgcagtggcggcatctcagttcactgcaagctccacctccccggttcacgccattctcctgcctcagtctccccagcagctgggactacaggcgcacgcctccatgcccagctaatttttgtattttcagtagagtcggggtttccccggttaggcaggatggtaaccatgatgtgacctcgagaggcgaccgccttggcctcccaaagcactgggattacaggcgtcagccaccgtgtccatccgagtattccaatttttaaaaagtatgctggccagaggccgggcatggcacccaactgtagtcccagctcctcggcaggctgaggcaggaggattgtttgagcctaggaggcacaggttgcagtgaaccgagattgtgccaaaaaaaaacagcctgggcaacagagctcgactccttctcaaaaaaaagaaaaaaaaaaaagctaagcactatgcgttagaacacagatgttctcattattttaaagacatgggggtcttgctatgttgtccaggctacattcaaatttttccagagaatgggtgtatcaatttgcatttctattggttttgtatagaaacagcccaattctctgcactctgatcagcgcttattaatttactcaaatcttggccaatactgtgtctattttatttatttatttgaaataggatcaagctgggcatggtggctcatgtctataatcccagcactttgaaaggccgaggtaggcagatcacctgaggtcaggaattcaagaccagcatatagccaacatggtgaaaccccatgtctactcaaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggagtggactagaagtttaagcccagagtcagtaaacactgttttgaagtccaaacaatgtaatttctgattcatctgatgtaccctgtggtgcgtcatttctctttcttcagaaagcaagcaagctgtttctggctagtaaaggtaacgggaaagagctatactctgacaacggccacgcgtaggaattagacacagacttctttaaggagaagagctgctcatcatctgtctgtgtgcctcttaccacacagaattaattccatggctacttgccattaccattgcctaaaagttcgccagatttgggagacagtgggagcaactgcaggaggctgcatcctgtacaggtagccttgggccatggtggctgtaggaaacacttggtcatgaggtggcttccccaagtggcagatgcagaaaccagtgagaagtaattttagattacggaattttttttaaagacaggaccctgctggcgatgtcatattcacatacagaaacaactgctctagtgaatctgaagatggagaaagtaaccaacctccttcctcagtgattgataagagcaatgtacgatgttgcccctgtggaagaagccttttcttgctgatggctgagttttctatttgtcccttttatttttactatggcaaaacagttttaattaaaatgagacaaggccacgtggagtggatccagcactttgggagggatcacctgaggtcaggagttcaagaccagcctgaccacaatatggtgaaaccccatctctactaaaaatacaaaaattagccaggagtggtggtgcatgcctgtagtcccagctactcaggaggctgagacaggagaatcgcttgaacccaggacacggaggttgcagtgagctgagattgcgccattatactccagcctggcgaccgcgagaccgcatttcaaaaaaaaaagagaaagatctcatctagatacatgtctcctgttaatttaaatccacagacccttgttgactcaatctaaagacacttgaagccactgtaccccagaatttaactcaggaatccacttcactccatggtttataaaaatgtgactttcttttgtaagcctgattgattgtttaaaatgcagtgtcctcatgaatggtaatatttgttttcttgacagcctgagttctccaaacctccaaacattaataatatagctaccctgatatccagtaaagtcatcctcttccttaagaattgctttaaggttaatcattgttctctggtgaacggatcccgtagtcactcattagtagccaagacagatttgtggctgcaactgggactagttaagggaagtagggctcagggttagaaggcagtgtttctcctctaagggttcctggagcacacaggtctgctagggaggggctgccagggctggggatccaagccaccacatggatgtgcaatacagcagagacacagcagatctgtagtttcaggacaggccattgtataacacagtggccataaactctcccaagagtactgaacaatccagtaagattgtacttcagtacaaatccatggtctctgtacagacctattttattttatttattttgagacagagtctcgctcttgtccaggctggagtgcagtggtatgatctcagctcactgcaacctctgcctcccaggttcaagcaattctcctgcctcagcctccccagtagttgggactacaggtgcctgccaccatgcccagttaacttttgtatttttagtagagatagggtttcacccaccatgttggccaggctggtctcgaactcctgacctcaggtgatctgctggtctcagcctcctaaagtgctgggattacagggatgagccaccgtccccagcctcttttatttttaaaatgagccaaagatgaggccagccgaggctaaatgctacaagcaactactctgagcctacacgccatgtctgatgaagtaatgaaaggaccataaacccaagggaatgtttgctgtgtcaaatcacagcttagtaacctagaaaagaggctctgtcccttcctctagggaatctgatgtttacaaaggaagacaccatggcacctcaaatgacatcctttcatattgtgaagatgggataaagagacttcactgtattccactgcagacttatccatatgacatgacctatttaaaaaatttacttaaagcagcatggggctgggtgcagtggctcatacctgtaaccccagcactttgagaggccgaggcgggcgaatcacccgaggtcaggagtttgagaccagcctggccaacatggtaaaaccctgtctctattaaaaatacaaaattagctgggagtgtagtatgcacctgtgatcccagctactcaggaggaaaaggcagaagaatcacttgaacctgggaagcggaggttgcgataagccaagattgcaccattgaacttcagcctgggcaacagagcaagactctgtctaaaaaaaaaaaaaaaaaaaaaaaattgtttaaaattatccaggcatgggggtatgcattatatgccagctcctggggaggctgaggcgggagggctgcttgagcccagaagttaagactgtagtgagctatgatcatgccactgtactctgcctgggtgggcaacagcaagactctgtctttaaaaaaaaagggggggggagggggtagaaaggcatgccagtttaaaaattcaaattccagggggaaatgcttgccctctgccaaacaagccaatttccaagtatcaagcctgttacactaaacatttctgttgctgacattcctattatctggctaataaaccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggttgtgtcttatgttattcctgacatgtatagcaactctaccgaacgagagcgaggagagacggcaacacgccaagagtagggatggcacgcccgcgcggcgcgcgaggaagaagaccgcacggtccggcggcggaagcgacagagcgggcggaggggcgggacgcgagcagagcggcgcgggggcacgaggaggacggcaggcacaagcggccgataccggggaggcggggcgtgcgaaacacggaggacgggccaacggttcgcaagccgccaagagacgagacgggcccacccccgcaagaacccccgtgcgcactccaacagcgatccacaaggggatgaaggagcgccctgggccagcggggcgccaagggggcatctgttcgccccagctaacggacccccggcaccaaacaacccagtcccacagaccaaagaacgatgccaaatatcactcgcctcatgcacgcgcccaggcaatcacagctctcaatagcatagagggtgcttataggtaagaaaccttgaaaactctaaccccagaataaaataattgttaaatggttttgttcttgtcttatatgcgcattaatttattttagcttagaaaaaaactttattttcttaataaataagaaaatacaggtaagcagctgggcatggtgacttacacctgtaactgggcatggtgacttacacctgtaatcccagcactttgggaggctgaggcgggcgcatcacttgaagtcaggagtttgagaccagcctggccaacatggtgaaaccctctctctactaaaagtaaaaaaattagccaggcatggtggtgggtgcctgtaatcccagctacttgggaggctgagggaggagaattgcttgaacccatgaggcggaggttgcagtgagccaagatcgcaccattgcctccagcccaggcaacagagtgagactccatctccaaaaaaaaaaaagaaaatacagataagcaaaatgaagaaaataagtatctcccagagataatcattaacatgctgttatctataattccagaatttttcctgcatgcgtgtgtgtgtgtgtgtgtgtgtgtgtgtgtgtatacacagcatgctcacatacatgctcacacacacattcatacacacatacaatttattctttcaacaacaaaaacattttttttttttgaggcagagtctcactctgtcgcccaggctggagtgcagtggcacgatctcagctcactgcaatctctgcctcctgggttcaagcgattctcctgcctcagccttctgagtagctgggattacaggtgcccaccactacgcccagctaattttttgtatttttagtagaggcagggtttcaccatgttggccaggctggtctcgagctcctaaccttgtgattcgcccgcctcggcctcccaaagtgctgggattacaggtgtgagccaccgcgctcagcctctttcaacaaaaattaaatcaggcacagttttttcccttgggaggtttatagcgcaattgaataaattgagattcttaccctcaaagtgactagttaaaacacttgtgttcattttgattctgtttcaggaaagcggttgtattacaagctcagaaccaaatgtcagaggcacataagcttttacaaaaattgttggttcattgtcagaaactgaagaacacagaaatggtgatcaggtaaggggtctcttgtacatctcacggagatgtggtggtggatcttctcatcctgtgttttcctctttacggtcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcaggtaagccgatctctgtttttatagcacatatttgtgctcaagagctggtgagtctgtgactacgtttgagtattgaaaggataataatgagttttcatttgttcatattgacgtctggaaaggtagtcttcctgtgcaagccctccaaggaggcctgtggaggtgtgaacctggtgacaaactgacactttccagtggcactggctttcctgagctgtgtattcagtaaggaggactcgcctcttcagtgagaacacctgcatcatattaatgattagctgacacagagtgatgcttgatttagcaacaaggggatgtgaataaagaaatgaggaacacagatgttcattgaaagcttttggaaatcanattgtattttatgtttgttttctttctcccccagtaaaggccatgaaggaattgactcttcattttcatctatattccctagtaccttataggccctacacatagaaggctttcaataaatattaatcaatgaatgagtgaaggtcaaacgcactggaagaatttattaattaaagtggaggttctccaaactggctgtacattagaattattgcggagatttaaaaaatatcttcgtacctgaggccttgcctcagacctacggagtcagaatctctaggggtggagctaaggaatctgtttcttactaccttcctcagtgattctttttttttttcttgagataaaatgtacatggccaggtgtggtggctcatgcctataatcccagcactttgggaggctgaggtgggcagatcacaaggtcaggagttcgagaccagcctggccagcatggtgaaaccccatctctattaaaaatacaaaaattagccgggcgtggtggcacgtgcctgtaatcccagccactcgggaggctgaggcaggagaatcgcttgaccctgggaggcggaggttgcagtgagccaggatcgtgacaccgtactcccagcctgggcaacagagcgagactccatctcaaaaaaaaaaaaaaaaagtatgtaacacaagatttaccactttaaccattttaaagtgtacatttcagtggttttgagaatattgacaacattgtgcaaccattactgctatctaatttcagagtattttcattacatagaaaaggaaactgtacccattaagcagtcattccccagtcctcccttcccccagcctctggtaacctctcaccggtttctgtctctatgagtttgcctattctgaacagtttgcataactggactcatataaatgtggccttttttgattggcttcttttacttagcttgatgttttcaggttttatccatgtagcaataggtatcagtgcttcattctttttcatggctgaagaatatttcactgtatggttagatcacattttgcttatccattcatcagctgatgggcatttgagtcgtttccaccttttggctgttatgaatagcggctctttacatttctgtacagcttttgtttgaatacctgttntcttttttttttttttttttttttttttgagacagagtctcgctctgtcacccaggctggagtgcagtggtgcaatctcggctcactgcaagctccgcctcccgggttcatgccattctcctgcctcagccttccgagtaggtgggactacaggcgcccgccaccacgcccagctatttttttgtatttttagtagagatggggtttcactgtgttagccagggtggtctcgatctcctgacctcgtgatccgcccacctcggcctcccaaagtgctgggattacaggcgtgagccaccgcgcccgggcttgaatacctgttttcatttgatgcctacgaacggaattgctgagtcatgataattttgtgtttaacttcttaaggaaatgccacagtggctgcaccattttgtttcaacctgcaatgtatgagggttccaatttctccacaatcttgcccacccttgttattttccatttttaattattacatccttcctagtgggtatgaaggggtgtctcattgtggttttgatatgcacttctctaatgactaatgatgttgagtatcttttcatgtgcttattggccatttgcatatgttctttggagaaacgtctattccgatcctttacctgttttttaactaagttgtttatctttttgatgttcacttgtaaaaattatttatatattgtggatactagacccttatcagatatataatttacaaatattttctcctgttctgtgtttggtcttttcactttcttgttagtgtcttttgatatacaaaagtttaaaatttttatgaagtccaatttatttttcttttgttgcttgtgcttttggtatcatgtctaagatactgacaaatctaatgtcatgaagattttcttctatgttttcttctcacagtattatagttttaatgcttatgtttaagtctgaataattttgagttaatttttgtatatactatgagatagggctccactcttattcttctgcatacggatataggttattctagcaccatttgttgaagactcctctttccccatttaatggttttggtacccctgttaaaaaccagttgatcaaagaaaaaaaagaaaacaactgatcgtagatatataggtttattttcggactctcaattctattcccttgatctatatgttacccttatgccagtactactttgttttgattactatagctttgtagtaagttttgaaatcaggaagtgggagtcttctttgttctttttcaggattgttttggctattcagcatcccttgcaattatatgttgattttagaattagcttgttcatttctgcaaaaacagtagttgtaattttgatagggattgtatttgaatctgtaggtcagtttggagaacattgccatcttaatgctattctcttccaacccatgaacacaggatgtctttccttttatttggatctttaacttacttcaacaatgttttgtagctttctgtatataaatctttcacttctttggttaaatttatccctaagtattttattctttttgatggtaatttaaatgaaatttttttaaacatttatttttgggttgctagtttatattgatcttatatcctgcaactttgccaaacttattacctgtaacaggttttggggattttttttttatggttttgtatgtataagatcatgtcatctgcaaatagagatagttttacctcttccattcccacttagatgccctgtatttctttttcttgcttaaatgctttgagtaaaacttccaatacatgttgaataaatgtgacaaaagtgtgtgtcttggctcggtgtctcacacctgtaatcccagcactttttgaggccaaggcagattacttaaggccaggagttcgagaccagcctggacaacatggtgaaaccccgtctctactaaaaatagaaaaattagctgagtgtagtggtggtggtgcatgcctgtaatcccagctactaggtaggctgaggactgagaatcacttgaactcagtcctcaggagctggaggttgtagtgaaccgagatcatgccactgcactacagagtgggcaacatgagtgaactacaaacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtttaggtatcattgagatcaggttttcgagaccagcctggccaacacagcaaaacccctatctctactaaatacacaaaaattagccaggcgtggtggcacgcacctgtaatcccagctactcaggaggctgaggcacgataattgcttgaacccgggagtcggaggttacggtgagctgagatcgcacattgcactccagcctgggtaacaaaagcgaaactccacctcaaaaaaaaaacttgtgagactgggcgtggtagcccacgcctttaatcccagcactttgggaggctaaggcagatgaatcacttaaggccaggggttcgagatgagctaggccaacatggcgaaaccccatctttacaaaatatacaaaaagcaaacaaacaaaaaagttgggcatggtggtgagcgtctctagtcccagctactcgggaggctgaggtgagaggatcacttgagctccaaaggtggaggctgcagtgagctgagatcgtgccactgcactccaggctcagcaacagagccagaccctatctcaaaaaataaaaataaaaataacatttgagtggctgaatttcagcaagcttgggcagggacctctgggtgcccctcagaccaccctgcttctggcatgacaatcagtccatggttttgggttgttttggggttttttttgttttttgagatggtggtctcactctgtcatccaggctgcagtgtagtggtacaatcacagttcactgcagcctccatctcccaggctcaagtgatcctcctacctcagtctcccaagtagctggaactacagccacatgccataatgcccggctaattttcttgatttttagtagagacagggtctcactatgttgcccaggctggtctcaaactcctgagctcaagcgaccctcctgcctcggcctcccaaagtcctgggtttaccagggtgagccaccactcccggccttcaatacatgttagttaaatggaaggacattacaggctgccacctaattagcttttatttgcttacctctatctttgcctgtttttttttttttttttgagatggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacggggtttcaccgttttagccgggatggtctcgatctcctgacctcaggtgatccgcccgcctcggcctcccaaagtgctgggattacaggcgtgagccaccgcgcccggccttttttttttttttttttttgagatgcggtctcgctctgtcacccaggctggagtgtgcagcagcgcgatcttggctcactgcaacctctgcctcctgggttcccacaattctcatgtctcaccctcccaagtagctgggattacaggcatatgccaccatgcccagcaattttttgtatttttagtagagacaaggtttcaccatgttggccaggctggtctcgaactcctgacctcaggtaatctacccgtctcagcctcccaaagtgctgggattacaggcatgagccaccgcgcccaacctcctctttgttaaagactccccaccacttcagtcctctttcttgctttcttccccatagactccagcacctgtatctgcctgttatatccttgatctgtcataacacatccctttttgtctttattttttattttatttatttatttatttattttacaaatgtagtcttgctatgtttcccaggctggatttgaactcctgggctcaagtgatcctcctgcctcgacctccctagaagctaggactacacgcaggtgctactgtgcccggtttaaaacatcaattcttttttgcgcatgagtgtttttaaaaatgcctaatgaaaaaacagtatttatttgctatggctgccataacaaagcaccacacactgggtggcttaatcaacagaaatgtgttgcctcacaactctggaggctagaagtccaagatcaaggtgtgtgcaggatcaattctttctgaagggtatgaatgaaggatgtgttccaggcctctctccttggcttggagatggtcattttcacatagcctgtacacatacctgtgttcgtatttccacccccgcttttttttttttttttttttttttgagacggagtctcactctgttgcccaggctggagtgtagtggcgcaatctcagctcactgcaacctccgcctcccgggttcaagtgattctcctgcctcagcctcccaagtagctgggattacaggtgcccgccaccacacctggctaatttttgtatttttagcagagacgaggtttcaccatgttggccaggctggtgtcgaactcctgacctcaggtaatccacccgcctcggcctcccaaagtgctgagattacaggcgtgagccaccgcgtccagtccatatttcacccttttataaggataccagtcatattgaattagagacccaccctgattcataggatcccatattttaactaatctacatctgcaatggccctatttccaaataaggttaccttctgagttattcagggttagggctttaacatataaatttgggcaggtagaagcgggggacacaatttcccacaatgataaaatgcagtaaggtttggaggaaactgacagtttcacacagtactggaaggaatatgaattgatagagcccttagaagggtttatccatcagagagcaggcaggaaacagaagctacaaacaaaaagatgaatacagagaattggttccacaagtaatgaaagatctaagaacccaaatgggacagagattagcaataaagctgggtgcagtgactcacacctataactccagcactttgggagatcaaggaggaagaattgcttgagcccaggagttcaagaccagcctgggcaacatagcaagaccttgtctctacaaaaaaagtttaaaaattgctggatgtgggctgggcatggtggctcatgcctgtaatcccagcactctgggaggccaaggcgggcggatcacatgaggtcaggagttcgagactggcctgaccaacatggcaaaaccctgtctactaaaaatacaaaaattagccaggcatgctgccgtacgcctgtaatcccagctactcaggaggctgagacaggagaagtgcttgaacccaggaggcaaaggttgcagtaagctggagatcccgccactgtactccagcctgggtgacagagcaagactctgtctcaaaaaaaaaaaaaaaatttgcttttacaaatagataattatgatttaccctgcattcaataagaaatttatgtttgtacaatgctttatagttttcaaacactttttttattatttattttgaagtagagaaggcaagtgttatatttccaatttcagaggcaataagaaagctagtgacatggccaggcatggtgacttgcacctgtaatcccagtagtttgggaggccaaagtgggcagatgattccagcctaggagttttagactagcctgggcaacatggtgaaacctggtctctaccggaaaaaaaaaaaaaaagaaaagagaaaaaaaaaataacttgatgcaagagcaattgcggcttttgccattactgtcaatggtaaaaaaccgcaattgcttttgcaccaacctaaaatacaaaaattagctcgggatggtggtgcacccctgtaatcccagctgcttgagagtctgagatgggaggatcacctaaggccaggaggtcaaggccacagtgagctgtaactgtgtcactgcactactgtactccagcctgggcaacagagagagagagaggaaggaagggagggagggagggagtggggaggtggggggcccgtcctgttggctcacacaagtaatcccagcacttgggaggccaaggcgagcagatctctgagttcctgctagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgttgatagaaaatcagacagaagatcagcaaggaaagagaagacttgaatgacactacaaatgaactggccctaacatatatatataaagcatgccacccaatgatacatcagaatacaaattattctcaagtgcatatggaacactttccaggatagactgtgtttgggccacaaaataacactcaataaatttaagaggaatgaaatcatacaaagaatctcctctgatcacattaaatcaaaaatcagtaacagaaggaaaccagaaaattcacaaatatgtggaaattaacatactcttaagtaaccaatgtgtcaaagaataaatcacaagggaaattagaaaatgcaatgaggtgtataaaaataccacagactctggctgggcgcagtggctcatgcctgtaatcccagcactctgtgaggctgaggggggtggatcacctgagggcaggagttcgagaccagcctggccaacatgatgaaaccccatctctactaaaaatacaaatattacccaggtagccaggcacagcggctcacacctgtaatcccagcactttgggaggccgaggcaggcagatcatgaggtcaggagatcgagaccatcctaacacgatgaaaccccagctctactaaaaatacaaaaaaaaaaaattagcctggtgtggtggcacatgcctgtagttccagctactaaggaggctgaggcagaagaatcacttgagcctgggaggcagaggatgcagtgagctgagatcgcaccaccgcactccagcctaggcgacagagcgagactctgtcacaaaaaaaaaaaaaaaaaaaaaaaaaattaccctagtgtggtggtgcacgtctgtaatcccagctacttgggaggctgaggcaggagaattgtttgaacccaggaggcggaggttgcagtgagccaagactgtgccactgcactccaacctgggtgacagagcaaggctctgtctcaaaaaaaaaatacacagactctcatttatgaaatttgtgggataaactacaaatttatgaaatatagttctcaaggaaatttataactgtaaaggcctacattacaaaagaaagaagatctcaaatcaataagcgaatcttccaccttaagaaactagaaaagaggccgggcgcggtggttcacgcctgtaatcccagcactttgggaggccaaggcggatgaatcacctgaggtcaggcgttcgaggccagcctggccaacatggcgaaaccccgtctctattaaaattacaaaaattagccaggcgtggtagcatgcgcctgtaatcccagctactcgggaggctgaggtaggagaattgcttgaacctgggaggcggaggttgcagagagccaagattgcaccattgcactccagcctcggtgacaagagctaaactccatctcaaaaaaaaagaaagaaactagaaaacgaaaagcaaactagacctaaagctaactaacagaaccaaggaaaaaataaggattaaagtggagataaacaaaatggagactaagagaacaacagagagaatcaataaaaccaaaagttggttctttgaagagatcgacaaaattgataaactgttagactgaccaagaaaaaagagacaagactcaaataaccgaagtcagggatgacactggggactttactaacaaccttacaaaagtaaaatggattatacaagaataccatgaacaattctatgcaagaaattagataaaaggtaaaatgaacaaattcctagaaagaccaaactactaaaattgactcaagaaacaggaaatctgaatagacctataacaactaaagagactgaattagtaaccaaaaaaacttccaacaaagaaaagcccagggccagactgcttcactggtgaattttaccaaactttaaaacaattaacaccaatccttctcaaattcttcccagaaaaaggagaagagagaatactttctaactcattttgtggggccactattaccctaatactaaagccaaagaaagatatcacaagaaaaccacagatcaacatcctttatgaatacagatgcaaaaattctcaacaaaatacttgcaaaccaaatccaatagcacgttaaaaggaacatacactatgaccatgtgaaatttactccaggaatgcaaggtagttcaatacacaaatatataaataaaatgaaagaaaaaatcggggctgggcgcagtggctcacgcctgtaatcccagtaccttgggaggcagaggtgggtggatcatgaggccaggagttagagaccagcctgaccaacatggcaaaaccctgtctctactaaaatacaaaaattacttgggcatggtggtgcacacctgtgatcccagctacttgggaagctgaggcacaagaactgcttgaacctgggagacagcctgggagacagaagttgcagtgagccaagactgcaccactgcattccagcctgggcaacagagggacactctatctcaaaaacaaacaaactaaaacccatatgatcaaatcaatcaatgcagaacaacaaaattgacagaatccaatacttttcatgaataaacactaaataaactaggaatgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccatctgttatccaggctggggtgcaatggtatgatcatagctcactgcagcttcaaatttctgggctcaagccatcctcctgccgcagccttccatgtagctaagactacaggtgtacgccaccatgcccagctaatttttgtacttatttttgtagagatgggggtctcactatgttgcccaggctggtctcgaactcctagcttaaagtgatcctcttgccttggcctcccaaagtgttaggattactggtatgagccactgtgcttggctaacgttaattttattttatttttttttgagatgaggtctcagtctgtcacccaggctgtggagtgcagtggtgcgatcttggctccccgcaacttccgcctcccgggctcaagtaatcctcccacctcagcctcctgagtagctgggactacaggcatgcaccaccatgcctaactaattttagtagagatggggtctcaccatgtaacccaggctggtctctaactcctgagctcaagtgatctacctgactcggcctcccaaattgttgggattacaggcgtgagccaccgcatccagccgctggctgactttttatttttaaaacatttttttgtttgtttgtttgtttttgagatggagcctctctctgtcacccagtccagagtggagtggtccgatctcggctcattgcaacctctgcctcccgggttcaagtggttctcatgccaagcctcccgagtagctgggattacaggctactgggattacgcctggaatcccagcactttgggacgccgaggcaggcggatcacgaggtcaggagatcgagaccatcctggataacacagtgaaaccccgtctctactaaaaatacaaaaagaaattagctgggcatggtggcgggcacctgtagttccagctactctggaggctgaggcaggagaatggcgtgaacccgggaagcggagattgcagtgaaccgagatcgcgccactgcactccagcctggcgacagagcgagactccgtctcaaaacaaacaaacaaacaaaaaatttttaaataaaaataaagagtaacaagtcagaattttagcactgcagatgacttaacacatcatctagtacagacctttcattgcgaaggcgattaacccgagataaaaaactgggttgtcgcttgaattacagagctggtttcgaggccaacactagaacctgggggttctgattcccagggtagctcttttgtctcatcgatcacaaatattcttgaatcatggtttttctcattatgcttgattctatttctctttgcagattggccttcttctctttctctacaggcagcaaagaatatgccatctacagccttgcttagcaacctcaggagaaagggagctcttctttctctagagtccatagtgcaatcccagagaagcgttgattagctgtgctagggctccatgcccatccctgtatccagagggacatgttctacaacttcgtgcaaattaaaaacaacacatttttgaggaggacagtagagtatgctgggcaaactaaataaataaaaataaataaaccaaagtccactgcaggttacaaagccgtgcttcctttattaccttggagtgctgctttgaaatgttggtgtaaggaacagcatttatagcagccaatgacccatctataatggcaggtcctccttagtctcctggagacagagactggtgcatcaaagggacttctggctagtttctttcttttctttcttcctttccttcctttcattctctctttgttttctttttctttttcttttttttttttttgagatggagtctcactctcttgcccaggctggagtgcagtggagtgattttggctcactgcaacctctgcctcctgggttcaagcagttctcctgcctcagcctcctgagtagctgggattacaggcatgcgccaccacacccagctcattttttgtatttttagtagagatagggtttcattgtgttggccaggctggtctcgaactcctaacctcaggtgatccacccgccttggcatcccaaagtgtagggattacaggcatgagccaccgtgcccaggcctctttcttttcctccctccctccctccattctttctgtctctctctctccttccttccctccctccctctctctttctctttctctctctctttctttctctttcttctctctctttctttcccctccctccctccgttctttctctctctctttccttccttccctccctccctttctttctctttctctttttttctctttcttctctctttctctctctttctttctttctttctttcttttccctccttccttccctcccttccttccctccttctctctctttctctctctctctccctttctttcattttgatacaatgtctcactgtcacccaggctggagtatagtggcatgctcacagctcactgcagccttgacctcctggactcaagtgattctcccacctcagcctcctagtaactgggaatacaagcacacaccaccatgcctggctatttatttatttttttaatttcttgtagacacagggtcttatcatgttgtccaggctggtcttaaactcctgggctcaagcaatcctcccaccctcggcctcccaagtgctgggactacaggcataagccactgtgcccagccttgggtagtttcttatgacaattgttttcctccacgaggtcaaacacctagtttgtatattcactgctgtactcgcatggacttagcacaatgtctggcatatagtacgtactcaaaaatatttgttgagtgaatgtaaggattctaaaacaaggccactcagaaggtcagaagctttctttagctggcctagagttgaagtttctttagtctgataacagcagcccaatttatgtctgggaagccatccctccatatgagaggtggccctacagggctgaccccaccatcagcttcagagatttgcatgtgactcaagacggccgagctggctancaaccgcaggggccgccttnnncactccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatattgtgaggccggtgtggtggctcacgctgtaatcccagcactttgggaggctaaggcaggtgggttgcttgagcccaggagttcaagaccagcctgggcaacatggtgagaccctgtctctacaaaaaataagttggctgggcatggtggtgcgcccctgtggtcccagctacacaggaggatgaggcgggaagatcacttgagtccaggagttcgaagctgcagtgagccatgatcgttatcactgcactgggtgacagagcaagatcctgtgtcaaaaaaaaagtatcttatgagacacaactacaagccacactccaacttaaagtttcctaatagccacactacaaagtaaaagaaacaagtaaaattttatacagtaacccaaaatattacttcaacatgtaaccaacatacaaaaatcaatgagatattatacattctttttttcataataaatattcagggcccgggcgtggtgactcacgcgtgcaatcccagcactttgggaggctgaggcgggccgatcacgaggtcaggagattgagacaatcctggctaacacatgaaaccttgtctctactaaaaatacaaaaaaaaaaaaaattagacgggcgttgtggcgggccacctgtaatcccagctactctggagcctgaggcaggagaatggcttgaaccccggaggcggagggtgcagtgagccgagatcgcgccactgcactccagcctgggaaacagagcgagactccatctcaaaaaaaaaaaaaaaaaaaggaatggagtactgacacgctgcaacatgcatgaaccttgaaacaacgttatgctaagtgaaagaaatcagatcccaaaggctgcatattgtatgattctatttatagtaaatatcctgaaaaggcaaatccatagagacaagaagcagcctagtgatttccggaggctggggagaagggatgggagaatggggagtcactgctaaagtgcgtgtgttttctttttggggatgatgaaaaagttctggtaccgaataatagtgaaggttgcatatcacagtgaatgtagtaagatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcggctactagtaggtcactagctgctggtgttcttctgtctaacgaacaatggagaaaattggctctagctggcacaattctactcggggtgtacagtgttcagagatacatgaaatcaggaatataatcatccattactcagaataactttaaaatctttgataattatttagttctttcaaaatcatcacattgctgaacatgattcatggttaaatagcaagctgggtttctcatgctcattgaaatgtagagtcattgctggtggatgtaaaatggtgcagccactttggaaaacagtctggcagttcctcaagaagttaaatgtagagttagcatacaacccagaaattccactcctaggtatgtaacccaaagaactgaaaacctatgttcatccaaaaacatatatgtgaatgttcataccatcactattcacaatagccaaaaggtgggaaacagcccaagtgtccatgaactgttgagtggataaacaaaacgtggtctatccatacaatggaatattaggcataaaaagggataaagtcctgatccatgctacggtgtggatgaacctcagaaacatgaagctaaatgaaaagaagccagacacaaaagaccacatactgtataaatccatcagaatggaatttccagaataggtccatctacagagacagaaagtaggttcgtgcttgccaggagttgggggagggagaatagggagtgactgctactgggtatggcgtttctttttagggagatggaaatgttctggaattagatagtggtggtcacaggcttcttttcctggctcctgagtcaccctgatgggttgaactaataggataccccacagggagattggaggacaagggaaaaggagaagcttcagaatttcttgccactttctctctgcctcaggcaacatcctccaacagtggctgtattntacttggcatcacccacttcttctcagnggctctagctgctcaccactttctttgtccatntcgacttgggagtngcacgancttggtaccaattctctctctctctttcttctnctncgnctaaacttcttctncttctttnctcatccncgncttccccttctcttttcttcttncttctgnnctcttcccnncttttggnnnctcacnnnnccttctctcttttgaaaaggccttggtttgttccccgctgggaggggngcaaattggggctactgcccttggctcctggaaccgaatttcctgtnaccctccggntttgggaaacaggggtggccccacccatttttcttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctcctgcctcagcctcccgagtggctgggattacaggtacacaccaccacgcctggctaattttttgtatttttagtagaaacggggtttcaccatgttagccaggctggtctcgaactcctgacctcagatgatccgcctgcctcggcctcccaaagtgctgggattacaggcatgtgacaccatgcccagctaatttttgtatttttagtagagacggggtttcaccatgttggctaggatggtcttgatctcttgacctcatgatctgcccgcctcggcctcccaaagtgctgggattacaggcgtgagccaccatgcccagcccaaacttaaccattttaaagtgaacaattcagtggcatttagtacattttttttgttgtacaaccactacttctgtctagttccagagcattttcatcacccccagaggaaaccttgtacccattaaactgtcactctctcttcccagtgcccctccctgcagcccctggcaaccaccagcctactttctgtctctctggatttgcttgttttggacatttcatataaatagaatcatgtaatatatgacttttgtgtctggcttctttcattcagcatcatgctttcaagactgatccatgccatagtggctgtcagtgcttcattcgcttctgcggcccagtactattccattgtgtggatggaccgcattttgtgtatacattcatccattgatagacatttgggttgtttccaccataaaggcgtcttaaggctactttgtccattcccgtgtctctgtagcccctcagttaatgaacttcttggcataagacatttttttgtcactctgtttggagggagcaggtgatggaagaaaggtttcttgaaatcactcaggaaccagtttcccaacccaaggttttcgggattcccttcatgcacccttacctaccccttgcaagaatcgtggctccccatttaaacccattgctggccaggcacagtggcttacgcctgtaatcccagcactttgggaggccgaagcgggtgaatcacctgaggtcgggagttcaagaccagcctggccaacatggagaaaacctcatctctactaaaaatacaaaattagctgggcgtggtggtgcatgcctgtaatcccagctactcaggaggctgaggcaggagaattgcttgaacccgggagtcggaggttatctgtgagctgagatcgcacattgcactccagcctgggtaacaaaagcgaaactccacctcaaaaaaaaaacttgtgagactgggcgtggtagcccacgcctttaatcccagcactttgggaggctaaggcagatgaatcacttaaggccaggggttcgagatgagctaggccaacatggcgaaaccccatctttacaaaatatacaaaaagcaaacaaacaaaaaagttgggcatggtggtgagcgtctctagtcccagctactcgggaggctgaggtgagaggatcacttgagctccaaaggtggaggctgcagtgagctgagatcgtgccactgcactccaggctcagcaacagagccagaccctatctcaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcttacccctggatggcggaggtgcagcgagccgagatcgctctactgcactccagcctgctaaaaggcaagactccatctcaaaaaaacccaaaaaaccaaaaacaaagagagaaagaaagaaggagagagagagaaaggaaggaaggaaggaagagagagagagaaagaaagaaaaaacagaggccaggcacggtggctcatgcctgtaatcccagcactttgggaggccgtggcgggcggatcatttgaggccaggagttcgagaccaccctggccaacatggtgaaaccccgtctctactaaaaaatccaaaaattagctgggcatggtggtgcacatctgtgatcccagctattcgggacgctgaggcaggagagtcacttgaacctgggaggtggaggctgcagcaggctgagattgcaccactgtgctccagcctgtgtgacagagcaagactctgtctcaaaaaaaaaaaagaaaaaaaaagaaatctggtttctattctgccatgaaagggatgggtgacccccaaggcctcagttccttatcctaaagaactcaaattatttttgagaaggtcaccagccaagaagcttttgttataaaatgcagatgttcatatttttttctagtgtggcagaattcccttaacataaaattcaccattttaacctttttttttttttttttttttttttgagacagtctcactctgtcgcccaggctggagtgcaatggcacgatcttggctcactgcagcctctgcctcctgaattcaagtgattctcctgcctcagcctcccaagtagcctggattacaggcacacaccaccacacctggctaatttttgtatttttagtagagatggggtttcgccatgttggccgggctggtcttgaactcctgacctcgtgatccacccccctcagcctcccaaagtgctgggattacaggcgtgagccaccacgcccggccttaaccattttaaatggtacaattcagtggcatttagtaccttcacatgcaaccatcaccgttatctgttccagaacattatcatctgcatatggattatccggaagagttaaatccatagagacaggaagattggtggttgccaggggctggggagaggggaaagtgggcagtgattgcttaatgggtacagagtgtcttttaggggtgatgaaaatgttttggaactagatggagatgatagttgcccaacattgtaaatgcactaaatgggactgaattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattcactccaccctcgggaacaaacatagactacagtgcaaaaatagataaagtgaataattcagcctgtgcctgtggctgatgtctgtaatcccacgactgtccatacccgagccaagccctcagcctcatgtcacgagtgatgacagacgactctgcccaagatggcaaaaagcctgcctacggaaaatggggggggggggggagactagctgggcgtggtagtgagcacctgtaatcccagctactcgggaggctgaggcaggagaatgacttgaacccaggaggtggaggttgcagtgaggagagattgcaccactgcaatccagcctgggcaacagagtgagactccatcagaataaataaaaattttaaaaataaagtgaataattcagtaatattagtacattcaccatgatgtacaaccaccacctctaccttgtttcaaaacttcttcatcaccgtaaaaggaaaccccgtgtccactaagcaattactccctattcctccactctcctcagcccctggaaaccaccagtgtgctttgtgtctctatggattcatttataccgggcgtttcatacaaatagactcagccaggcatggtgaatcctgcctgtaagcctagcactttgggaagcagaggctggaggatcatttgagggcagaagtttgagactagactgggcaacagagcaagaccctgtccctgcaaaaacaagggggggatgtgatacagtatgtgacctttcgtttctggcttatttgacttagtaaaatgttacccagattcattcatgttgtaacatgtatcagtacttcatttcttatggttgaataatattctgttgtgtatatataccacaatgttttaatccattcatcagttgatggaaatttgggatatatctgtcttttgactcttgtttatagcactgctatgaacattcatgtacaagtatttgttctagtatatgttttcagttcttttgagtatatacttaggagtagaatgctaattcctttnttttctttttttttttttttttttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggataatatacactaaagtattaatagcgttatttctgggtagtgagattgcagaagatttttgttttcttctgtaggttttctatatttttggaataatttttccccatactacacctacataataatttgttttttgttttgttttgttttgtttttttgagactgagtcttgccctgtcacccaggctggagtgcagtggcgtgatttcggctcactgtaatctctgcctcccgagttcaagtgattctcctgcctcagcctcccgagtagctaggattacaggtgtgcgccaccacacccggctaatgttttgtatctttagtagagacagggtttcactatgttggccaggctggtctccaactcctgacctcatgatctgccctcctcggcctcccaaagtgctgggattacaggtgtgagccaccacgcctggccaataattttctataatgacataaattaacaatggaattagaaattatttttactttaaaaaaattttttttaaagaaattattatttttaaatagagatgaggtctcagtatattgcccaggttgttcttgaactcctgggctcaagcgatactcatgcctcagcctctgcctcccaaagtgctgggattacaggcatcaaccaccacaccctgcccttaganattattttacttatagaaaaactcatctaggtaaaattggaggtaagtgtctataacccagttaaatgtaaacatttaatttgtagctaactttctacatattntatataattgttgctgatatcggccatatgaaacaaatagtagagctgggggcagccacctggctcccatagggccccatacaggcactgggaaatacagaaagcaaacacattaccctgcctgggaggagcctacagtctggggtgggggcagattggccattttactatatttgataatgcccaaggggggaatggcaaaggtttatggagcatgaaggctaatagatctcacttctttaaagggcaaaaccagtggcccaagatgaccagcagggcgcggttgctactctggagtattgctgggaggaggtggggctgcgttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcatagaggngnnnagaaacctncactttttctgcaannaacaaaaacaacacctcactgnaactgaacacttaagtttcgtgcattttattataccttaattgcacttcaatttaaaaaaaaaagcagaaaagaaaaaccaaggtagcaaaatagcgattataatacggtatgacagtgagtatcgtgtatgatgtacatgtgtatcagtgtgcctgacaactttatgtattttagagtacagctccttgagaaagtctacagagctggtagctaaaggttgattaaagatagccagtccaggaagccaatgaagcgcttcctctgaacttggaagagatggggaatttacatctcaaaagagcttgcctgtgcaaaggcccagaggtaggagagtatgacccactggggcactgcaagcagttcagtatggttacagtggaggttgtgaggtgagggtggtgggaagtaggcctggaggggtgagcagggaatggacgataaaggaccctgtaacactattttaataaatttggactttttcatgaggccattgggaaaccctaaaggaataaatgtgtgcncccccttgcctccccccnccgttgtggcgcgtgttcgcgcggtgccggctccgggtcccgtgctgttgcgtcgcgttctttccgggtcttctctctcgtccctccgccccgctccgcctctcttttcgcgttcctcttcctgcgctgcgcgcgtcgcccgtccggcgtgtgtcgttcgctcctctcttcctccgccctcttttttgtccgcgtcactcttttccttctcctccctctcccctcctccctctccctcctccgtcgctgtgtcctgccttgctcgtgtgtttagttccctcttgctgctgtctttgtctgttcgcgtactctcctcttcgttcccactgtctccagtcttgatctgtgcgttctcgtcgctgtgtcctggtgtggctctcctcgtcgtcctcacgtgctcgtgcgtcttgttgtcctttctgcacctcatctaactatccacaagcatatacgaacg

SEQ ID NO: 707 - DNA, 196083 bp, Homo sapiens
  misc_feature (1)...(196083): n = A,T,C or G
tggcttccacagttgccaagagccaccttcccgtggaggcactggagcagaacaaggctctgccagagagggtgcttctgggagaccctgagggtgctgaaagacaagagcaggagagacacttttggaagcagagggtctgtcagtcccatgtgtctgcaaatagctgccaaaagctctgcagaggttagcggaaaacatctaccatgtgtcagaggtcagcttagagctgaatactggaaaccccactcaggtnttctttccagtcgtcaaagagggcaaacctggtaactacggagtggggaagggtcagagaggagggctgggtggccaggagtatgttgggagccctgcctatctatcaggcccctggaagaggtggtctgcggggtggactggcccagcctacgtccgccacagccatgttccaacagagaccttcatagaacccatcctcatccatgtctccatagacgtagaggtattttcccgccgtgaggggcagctcagcttcggggttctcgttcggtccatcgaaggggttgtaactgcagagaaaacacagttccttcattagaggctctggaggacacagcccgcacccctgtccgtgcagaacgccagacgggcacatggcttctctcccactcctagggaattacaaacccacataatcgttcggggctgatgagttctctgtacactggaaattcaagccactgccagctcacacacacagatttaaagtaaaaatgcaattcggaaatgaagttatatgctcagaactatttgcatcagataacaggtttatgattctgacattctattcacacttatctcttctgctgtaactatacatctccaaattagcaagcagatgtgaagaaaattaaccctataatctttcaataatacaatttagtgaaaacagaatcatatatactatttagcaacctgcttattcttccaccttgcaagatagcatcctatacttctacctcttgaaatattatcatcatagtctttttaatgggtgtagagtattccactgaacatattaacatactttatttaaccagtttcctaatgttgggcagtgaggtttcttctaacttttggctaatataattagtattgcattatatattcttataaacatatttttgcacacttccacaatttcttcctaatgataaatcctaggaaatatacttatttggtcaaaggcacctacatttttaaggtcttgggtgtggacagtcaaaatgctcagaaaaacagacgcatgattttatgctccccccccccacacccccaggaatataagagtatccatattctccagtcctcaacatattgggattaataattttcaaagccgtgtccaacttggaaaatcaaacacatgaaacaaacccagatgaattggggattctctaaataaaaggcaaattaacttaaaataacagcgaagaactcattaaaaaatgaaaataacattagagttggagaagatagccagacactgtaatattataattatgatatgaaaatgattcatgcatcagtggcactgtgcagtttaccaacactttcatacacgttttattcgatggccattaaatgttaggaaaacagagaagataaggtccccagtctcaatggctgagtgaggtcaggcaacatgcccaaagtcacaagcttatgaatcggtggaaggggaaccagagctgagacctcctgacccgtcctgcgcagttttaaccacaccaggtcacgtggcccctcatggtcagggtgcagaggtccaggaacccaatccaagaccctgacagcacccagcaggtcagcctagagggctgtgcaccaggaactgacatgggccaccctctaacacaaagctcggcagtggaacgggacaagagctctggaagaaggaatagcatgcgccaaggcccagaggcagggaggagagagatgaggttggcagggaccagactggttttaacctgatctcacaagctgtgggatgtcatgaaagagttttaagccagggagcgacaggatcatgtttgcgttttacaaagagacctcgtgggtgctgtgtggatggagcttggtggaggagttccagcaaaggagtttggtcggggagtgacttaggaggctgtggaaatgcgggttgcctggctgcagggatgagggactgaggtgcaggaggaccctcggctttctggcctcagggtgagcaggcggggacacaagtcactgagtgggggttttcagggggatctgcaggggggtctggatgggtagatggccgagacacagaagctggcagagtgttctcggaggaggaggaggaggaggagggagcgagaggaacaggagcccccaggccacgccttcaggagtgcccacacctgacgctcaggaagagaagcttccccagggagcaggtagggaagacacaccctgagagcttgagagggaagccgcggaggccaagagggaaggtgaacaccgagaagggtggaagaaggtccctggctggtaagggcacggagaagaagtgggagatcctacggctgtcgtgacaacctcgtcggtgctcctgcgtgtgggccctggaggccacccgacctcgtgggtgttcagggcagacgctgccacgtactgtgtggatgagaccaggggacacgtcgggaatggggactcaacagagacagaagtaggtcaggggtcacgcagcgctggaggcgggggaggagggacaggtgatcactgatgggaatgggttcttgaggggcgatgggagacgagggacaggtgatcactgatgggaatgggttcttgaggggcgatgggagacccccacatgtggccgtggcatctgtgagcacagcagtggccctgggcggcacactgcaagtgggtgaactgtgcagtgaggaccatctctccgtacagctggcgaaaggaaggatggtgatgaatgtgtcagcctcaccctggacctcgggtgggaaggacccaggagccctcagcaaggcgttccccacggcggaggctgcaccagatggaagggaggagacatggacacagaggcagcccctgcatggagggcggggagaggccgctcggcacccagagtgagcgcccaggtgagcaagaggctttcggtttgcagaaatgtctaagcaggttgctgaataatgacagcaagaggagacactgattagacccggggcagaaaacataaccccctccctacatctacctgcaaagccacctcttaggggctctgagggctttcagaaaactcagaaacagctctctcggggaccagcactatatgcccctcacaatttgacttggtttgagagagggtgggtggttaaaaaaaaaaaaaaggcataaatccatcaccagtaaaataggaataccactgaaagagtgagataaggagaatgtgcgtgggctgtgactggtgatggccacgggagaggcagatgtgctggctcgtcacgcccccgcttctggagccacaccagccgtgggtcagtcctcgggggacattagctctagggcagctccccccagaaaagccatgccctctccatagaagtggcaggaacgcaaacccagtggccctctgaggttggccatcgtaggtcgcatgtggcagcctcgctggaccaggctcatgattgggaaggaaggcgtctgtggcacaccaggcccctgcttggctgggaagccacctcagcatgtgccaggctcagaggacaccagcccagcgctgcccctgtgctggcattgagggttctgtgaatggctgcgcctgggcctgctccacacacagcaagaaccggactgaaggagccaggggtaggactgggtcttcatcctggccccgccaactgtggccctgtgcgtctgcatgcaatagcctctcagcgctgtgatgctgtcctccagcatggtgacagatgagcggatggtgggcctgcccccacctgggtgcagccagcattcacatctgcctgggctggattctaatgggagcccacagcccaggggcatctaccccagtgcttctgctacctgaacctcagaaatgggtttgctttggtggaactggtgtattaccaacgagcggaatgtgatccgctgatcctcttaatggtgttagaaacagctcttgctggagaaagcaaaaggtattcaaggtgtatggactggcttaaatcaagagtcacctcctttgcatgaacagagtttaaggatctagtgagggtggcaactgcactgaagcttggtccctaaacagatcacgggactctggctgcccgatgccagctgaagggcagggatatctgcctttgaaatactgtcaggtcagcctcaggccaagcccacgctcagagctgttggagcatctgtgagacaaaaggctgggtcttcacgagtgctaagaaatgggggtgaactgctctgtcttgggcctgctgcccctggctgatgaattcccaagtgtccgcccatgggcagagttggctgcagcttgctttccttacgatcaggtagtgcagtcctgggggacctctcatccttgcccacgtccgcctctgcggaagctcccgtggaggacctgagaggtgtgcgggacaaaactggctcattacctctcagcgagcacaaacactgaaggcccctgcacgggaagcccactcagcggctgtcatcgcagcgagatgcagcctgcagcgcccagcagagggtgaggatgcgggagatcagggtgctggacacaccccctttcactctcggtggtggggatcggggctctggacatgtcccctttcactctcggtggcgggatgtcccctggaaagacgcactcatggaccaacccctgcacctgtgaatgggaccttatttggaaacagtctttgcaaatgtgatggagttagtcatactgcagcggggcagattccaatccagggaagggtatccttaaaggaagaggggagaacgcacaaagacagggagggcgaggcggccaggcaggatggaggatggaggcagagactggagccacgcagctacaagccagggccgcctggtctcccggcagccagaagaggaaagaaggacccctccttggagccctcggagggcgagaccctgccgatacccccatctcaaacttctgcctccagggttgggagaggagaaacctgtagtttcaggccaccaggtttgtgacctcctgtcatggcagccctgggagacttgcgtgccacccaaactctctccaccgaaccctgctcagcctccaggccaggctgaaatcccaccttctcctcgtgccctgggagaagggaacttctcagaccccagagtgttcccagacccaacatctcatctgccccactcacaggggctcggtggacgccgaggggccgcacttacctatagcgggcaacacagaggtggaccttccccgagtatctctgcttggaggtattggaattccgttcattctccatctgtgaaaaaggcaatgggtgtgtgggttattgaagctggaggtgtcccaccccattcccgcggcacacgggaaagcccctcgcagcttcctgggccccaggagggacggcctgagactgtggcactcccaggaggcactgccacccgcacacccacatgcgagcttggaaaggagggtggtccctcggtgtggaccccttattacataggccccctctgtgtttgtagagaacccagtccccaaacaggaaggtaaggctcaaagactccgcccagtgtctcctacagcaatcccgggagtcagcggcgtggccttttctcataggggtgggggtaaaattaagcagtatgtgcacgaccccccagtgatcccactctcactccccctagtgcattccccacacaagctggaacagtctttaagcaggaattagaccacatcaccccctgccttaacagctttcagtggcttcacctcggactcagacaaaaagccaaacgctgtcctctgcccccgccccctctccagccacaccagccccttcccatcaatgccacaggacaggacgcgcagggccctccccaacctccacaggcccctcccggccagctctgcgtcaacagccttgctgcgtcatccttgcacccctcgatgggatttgcttttctaaacgctgcctcgccagtgttctctctgctcccccttagaacagggacctcacctgtgttcacagaggggcccccccacattccagcacatagtagggcaagggaattaacaggggcaaagggaagaaccaaccagaaggaagacagggaggaagatggggaagaaaaaacaggacaaactggccaacgtccacaccagacacacacagcacaggcagccccggcagcccctgcgggacgggactcacgtctgactcagatctgcatcttgcgctaccggatctcgacaggaaggtgggcttggcggacagaggctccggcctgtcaccaggctgcggaaggggccggatatattcaccgatcgcagagctgcctccaatagcgctctcctgacctggccacgaacattaaaacaagttgaaacaaatatgcgaataacatcgtcaaagcacgttggtcatgcgcctacccggggtgcctttcccctctttgacaacagccactgattttcattttggggtccacccgtctcctgctcgccatctatgtaggctggcggcgcgaccccaccctcagctctgggcccgtccagctggcagagccaccctggcggtaacgctgtttgggggctcaggacgaggatggtcccaggcagagggaactaaaggagagttgatggcaaacaggctgctcctttccttggcttaaaattgagcagctgtgaagctcagggaggccgcaaacctcctgcacctgcgagaggaacgctcacgtgaggacggcgcctgctcacagcgagaccgagagaaagtggatcccggcgatgggcttggagcccctggttcaagatgtccctgaagccacgtcctggctcttcatctactcaggtgacagacagactcctttttgctcacaccagtttaggttggctttgctgtcacttatgaccctgagtcctaactggccaaaggggtgggtttgtggctaaaaaaatactcttgacgagagatttgcaagggctgaaatagttcttatcccgtcctatcctcctggggtctcaggggctgctgagccctgtcctggttgcctggaagggagcattgagcaacgtgactaacgctggcctgggtgtcagacgacagcgcagcactttaaccaggatccgggtgtgaaacatgacgcggctgcttccttcccaagctctccgctgctgggaatgatgacaccccctccctggggtcctcggtccctctgtagctgtcacatcatgacagtcacctcactgatgaatatgaattgctgagtccaaatcagtaagtataaaatgatttaaaaaaccatgaggaatgttccacaacggctgccctaggagccgcccctagcaggccccacaactccaggctggagtgaacagcaggacagcgccaccatggcagggaattggagctggggcagccctgccctggggtcccctgtgagaacatctgatcctggagggcaggaccttgttgtattcactataacatggctcggcgtgtagcaggtgcaaagtgaatatcgaacgattcagcttccagaagcctcggaaacccagccgacagcagagcctgctgcaggctactccccttccaactggcattgctgcctcttctctgctcccagccacgagagtcacctgggccagtgaaccttgaggggagtggcaggctccacttgtgggcaaaagccacttttcctccccacacagtggccagggaactttccagagaggaaacactgtcctccagcgttccgagacctggggggccgcgtgtgactgcagcagaacttggcccttcctgcctgacaccgcgccacagtgaacagcaggggacggcacagctgatgaaggtgatatgaatacagtagtcaccttgtattcacaatttatccaaacccaactctctagggaaaaataacgtaatccccgtggcagcttttacctgccattgtgcctgagaagacaaggtgagattagaaacaaaacgtgcagtgccttcaaatggggctggttcccacgggcccctcgagatgcaaacaccgcgctctctcatgatggtaatgcttcaaaatacgtatgttctagaaaaatataggtcaaaaaaatgttgactcaaaaaacccagctcccatactggaaggaaaactggctgcgccagggataggagaggccacgcctctccccaacacactccttcctaggaggttgccggggacagtgtggcccatgagcaacgcctgccctcacatactgactgcagcgcctcactctgtgtcagaggtgcctccccatacagggcgcgagtccctttgtggcctgccccagccacaggctggaggagccctgggtgaaagtgcaggtgagtgacagcacatccacccgggaccccttctctgtcttgcggccagccctgcaccttccaccatcctctctctcaggtcagtgtgggaagatctgcggcagatgaacaggtaaaaaatacagatttgaacacaatgggatgttatccggcctcaggaaaggaggacacctggccctttgtgacaacacgatgcacctggaggactctctgctacgtggagtaacccaggcacagagatacaaacatggcacggacggcccccactcacgtgggaaacctcaacaaggccaactcgcagaagcagagaacagaacagtggtttccaggggccgggccgggggctgttgatcgaagggcacaagatgaatactctttggggatctcctacacataaacgtgaatgcagctgaaatgctgggttgtaggccaaggcggtggctcacacctgtaatcccagcactttgggagaccgaggcaggtagatcacctgagttcaggagtttaagaccagcctgaacaacatggtgaaaccccatctctactaaaaatacaaaaattagccaggcgcggcggtgcacacctgtaatcccagctacctgggaggctgaggcaggagaatcgcttgaacctgggaggcggggcttgtactgagccgagatcacaccattgcactccagcctgggcgacagagcgagactccaatgcaaaaaacaaaacacaaaaaacaaaatgctggattatagacttgaagtttacaaaggaggcagatcttaagggttttcaccatgaaaagaaaaggtaaccacgtgaggatgtggataggaggtggtatgttaattagcttggctgtggtgattatttcacaattgatttatgttacatcggatcaagttgtataccttaaatatgtatgatttctaattatccactatacctcaaagttggaaaaaatgtacaaaaataagtaaacacattcagagagtgggggaagaaagaataaaacaagaggagaccctaagcagaggcctggaagaggggcctgcgctgtctgcagggaggagtgtcctggtgggatcggggtgctgtggggcagctctctggaggcactggtgtccaccgccgtcataagcgacatgcactgtgaggggagtgccagggcaatgccaggggatatgggcatgggccatgccaggcgacccctggtgggtgaggaaactgtgattaaatgaactggattcattaggagggtgcgtcttccagacagttgttaaacagaagccgtggtgcaaaccttcttctctgccaggcggccctggcttagtaaaggcatggtaccactttgtttttttggttttatgcagtgtgcattttccacagtggttaatcagattcctttttccatgctggccaatccctgttcccgcctccctgtcccgggagctttgcagcgggttccacattcacatgctgtgggcctcggactcaccgggcaggcctgggactgctgtttacagaagggccagcttgcaaggtgggtcactggctagtgtctggaactcagcttctgaaatgtcccctacactggatggaaacatcccctgactgataaaggcaggcctagcttgtgcacaccacacagctcacactgaacacctgctttccttccaggagtctggagcttcggtgggcacggtgcccgcgcaagcagcccccaggaaaagctctggacccaagtctcagtgggtttcccagagcagaagccgtgcgtttcttgtcgcacggagtggggctctgtgtggcccttcacgggagggagagagacagcatggagacacgtgcattctgttttcccctgggaagaacggaaaccgtcttgttttcctccactcttcaggtgtcacagctcaaatgtggtttcttggcagccgccttccaggaccatctagaagagcccaagtcactgtccacctcatcacctggtcttcatgcagcgtctggatcagaggctccccacgtatcgtctgcccgccagcgggagctccgcacggtgccctgtctgtctctcagcgttgcaacctaggcagggcatgcagcctgggtgtcgtgagtgcctggagatgagcggcagagcgctcggaccctggtccctgcctgctggcctcccacagccacgaccacttaccccacccggcattctctctgatgcgtggaccaaaagggaagggcatgggaaggcgtgggacgagcggagaggcaggagaatgttttttagcaagacacaagtggcatctccttattttaatgataaaaagcacccaaggtacttatatattctgataagaactaggggaaatttgcaaattatcttttttacagaattccaaagtgaggttcagacgctcatctcccctaatttttttttaaaccaacttcttaaacaggtgggcagacctggccatgaaacctgtctaacctctgcatcccacttaaccttcagccaggacgtagcacctccaccgaggtctgattaaaggacatctgtgatcgctctgcctgcgaccaagactaaatcccccagcacacacacagggggcttctccccacccggcctctaagcaggactgtgatgggcgagggctcatgttcaccactgcctttgctagaacagaggttccaagcacgtcccaacatcaccaacaagttactgagatgagaaggaaggaaaaacaacgaacacagagaaatgagcttcacagagctttggagtacccagccaagaaatccttgtggagtcgttgccagtgcagactctgcagccagactcctgggttcaaatcccagactgagcctccatcagcatctgtgtgacccacactagtgctttggtttttctcgcctgtaaaatgggcccattttacaggtgagaaaatgtgtgggtcccacatttgtggatgcccgtgaggtgctgagtgtaccgtgtgccccacggctgtgagcagccctgttctcatccttcccattgcagtggcgggtccctgtaccctctgccaggtgtcaccaaaccgatttcacctgtgcacaccctcgcaggcagccaacggccattctctccccaccacagccaaggcggaaggtccaggcgcttacctttgccgagggaggtggctaggccattcatgaactgtgggaaaggcttgctgggggccgtggagatgtccaggggggccaccgcgctgccacccagcaggtcaatcttgccagcgtgctgccggaacttctccaggtcccgggacagcaggttgaactgctcactttgagtccggcatttctcttccagctctcgaaccttggactgcacggcagaagcaggacagggggtcagcggtggcatttggtggtggaaatgtgtgtgcgcctgttcacatgtgttgtacgtgtgcacatgtgcactgtgtgcacgtgtgtacacacgtgttgtgtctgtgaaaatgcatgtgtggttgagtgtgtgcatatgagcatgtatcctgtgtgcacgtgtctgtgtgtgacatgtgcagcaggggccgcctcccactttcacgggagagcagtgcctgataaacccagcttctcctgccacctggctactggccaatgtgagaaaccacaggtgccaagaaatcctgcaaacactcagctcccagccaaccgtagattgttctgggctgtgcgtgcagcccgggcactttgcagttggcaggctttgctagagctgtttggaacttggagtatgaggctgtgatgcggcccagactcaggggagcagctcaggtgctgtcccatggatgcaaggatgcaatcttctcatccagggcgcccgccccctcggactgtagaacccttaagagcaccacttggagcaataaggactctctatctgctatgttcagttagcaacactgctgcatttgcagacaacacgaagccacgtcgggagccctggggaaggcaagcgtctcccccagggacacgcacaggaaaggggtagcccagcaaactccttcctcgggtcaggacaggcctgggctgtgtccagtctcgggacatctctgacccttgtgggcttcctcccaggtcagaggtgcatgggcaaagccccgctccctgctcccctgggacttgagctctacataagacatggcctcctgacataggtttctggcacccatcacagaaggtgcaggacagaggggtctacagaggacccactctaccttctcaccccgcgttcctttctccactgtgctgaccgccccccggcactgcagtagctcctgggctattcgtttcttgtcggtgtccacggctacactctcggccccaagcctctgctttctggctcaaggacacaccttcgatactctgcatggactcagcacccagcaggtgctcaaagagcgtttgctgaatcagtgaaaaaggcgagccctgagctgtgggcaccgtgctcctcgtggggatggcttgtcaggtctgcatgcaaagccgctttcttgccactccttactttaggatggccgggaacatcccatttatggggttattcatgtcatctgtggggctgacgacactgacgtttcccccagtgaaatgtcagccccatgagggcagggctttgtctgcctgtttcctgctgcgtcccggacctgagcaaagggctcagcaacagccccccacctccccctcccctcctccgcccctcctcttcatccatcctctcccccactatccctccacaggcagcaggcttctcagctccttagtccagaatgaagcactatttatggctgagatcatggatttctaaaataaacctaacaaatccaaagcctataattaatttctttgattcattaaaagaaatcagcagtattcttctttaaaaagctgaatgggcttggccaagccggctgtgtctaccaagataggcatagagctaaaaacccaggggctctggggcctgacatggaaagcatcggagggaacccaagcccagggacagctccgaccccaaatgtggggtctgcaggtgggatgacgacttggcttcgcagggcttgcaggggctctgactctgctggttcagcccttaagacagagtgacgggccctgcagggcagccagggtcctggccagggaacagctgccactgcccgctgcaggcaaggccggaccccggaaggccctgagctcaactgtgtgagccaacgaacccccaggcacccatggggcactcgcggagccttcccagggtgtggagaaacaggagacatttaatagtcatgcattcattctaacatgtgacagggaacatgtaactggcacacccattccctaatgtcgtgtctatgaaaatgacctaactaaaataggccaggcacggtggctcacgcctgcaatcccagcactttgagaggccgaggtgggcggatcacctgagctcaggagttcgagaccagcctggccaacatggtgaaactcagtctctactaaaaatacaaaattagccgggcagggagacacgcgcctgtagtcccagctatttgggaggctgaggcaggagaatcacttgaacccgggaggcagaggttgtagtgagctgagatcgagcctctgcactccagcctgggcaacaagagtgacactctgtctcaaaaaaaaaaaaaaacaaaaaaaaagtgaatagacttttcatacaaaaatcttgaaatgataaaattatagcaataaagaacagatcagcggttgtcagggttttgggttaggggagggtgtgacgagggacggtgccatgagggagtttctctgggtgacagagccgtctgtacagctgatggtggtggtggtggtggttacgagaatctgtatataccaccaaatgccatacagctatatacgaaaaaaaaaaaagagtggatataaacactcgagaaagcaagtaaattccccagcatgctacagtgctgctcccacgccagcttcccggctttgagaacacactctggctacagagacaccaccaccgggaagcaggaagaggggccacgggaactccccctgctgtctttgtaaattcccgtgaccctaaaattacttcaaaataaagttttcagaaatgaagagattttaaacaataggaactaagaatacaggtggcatacagagatggtgaagataatgaaaggtaccaccccatcaagggggctaagggcggctgaggtcacaggagcctaaagcgggttctgcatctgatacacacctgccagcagcctgcaggctgcgggctgcctgcttttgtttgcaggaggacaggtcgtcgcaatacagagggaacagggcaggctgtctgctctcacatggttccatgggactcccagaaatgacggggggtggggggccaaggacgagggtgagccgagcagcagctgcatactctctgtggtttggtccccagggcctggcagggccactcccacgcctgtgtcctatgggggccatagtggcgcttcccaaggtcagccccttgccctggcccatcagtccatcctcaaccgttagttcacgacttggcacagggtggacatttaacagatatttgatggatcacaataagctgcgggtaaactaatctacgcacaggaactgtggagtacccttcagttagagatgaaccaggtcacctctgtccaagggagacagaaaacgggtggagaagcagccaccaggtggctcaccaaggaaccctgagacccctgcacaggggccgctgtgtcatcacaggcctgggtgttcatcagggccgggttccctctcccacggggaaccctcagctctaggtatcctgtgagtctgtgctccaggccccactctgtgcacagaggacgcaggcccctcggtaggctggaagtgccgtcagcagcagcaaagcggcgctcgcaggagcagcgtaatcatggtgccagtattggtattgatgagcagtactagtatcagtagtactggtattttcatcacctgcagtagtagaagtcttgctttggtattagagcattaacagcagtggtagcaatagcagtgttttttgtaggaatagcattggtatgagtagtggtatagtaacagtgctgttggtattagtattaatagcagcctagtattagcagcagcagcagcagcaatattggtattatttgtactagtagcaacagtatcattattactacctgcaagcgtactggcgttatccttcacagtcacagtttggtgttagtattagtagcagcagcagatgcaatattagcagcagcaacagcagggatattggtgttcttagagtggcagccagccactgtccttgcttcccccgcagattccccagggcctggcgccggggacatccaccgcgttctgagggggtgtcgggagcaggaggcccacgggcagcagtgacgggggagagccagctcgccttgagccccgtcccacagtcccctcacccaactgggctcactgcacaggagattccatgccctcctgtgacacaaagtcactcccttcttgaagcctgagaaacgcccccaggctcccagctgtcacctcctcccggagggtgtttctcctccaaggggccaccagatagggccagtggttcgccatccacaagggacccatccgcacgacccagctacttcctgccaggctccacccgtgacactaggggtcacatttccacatgagatgtggatgggaggatgccctagccacactgccctgcttctctcgaggcggctgcagagagcctggcccaggggttgtagggacgctggctctgcccagcccattcttgccaactgctccttacacctcggggggtcccggagtggacttgagtgctacagcaaatcaccgtgtggacacagtcctgcacgcagactggcaggggtgccagcaggggcaggggcagggtagacctgcaggaactcaggatggggtggtgagcagggcaaccagctctgtccaaaggggccggtgcctcggcccgggtgcagcccaccaaagacaaagctaaagcttctggtttcccaggagcagcagggcattgtcccctccacatctcatgttgaaaagctaaagcttctggtttcccaggagcagcagggcgtcgtcccctccacatctcatgttgaaatgtgacctccagtgttggaggcggggcctggcgggaggtgtctgggtcctgggggtggatccctcatgaatagcttggcgctgtccttgccataatgagcaggctaagttcacacaaggtctgcttgttgaaaagagcctggcacctcccataccctcctgctctcagcacacgacacgcctgatccccctttgccttctgccatgattgtaagtttcccaaggcctccccagaagccagcacaccccctgtacagcctacaggaccatcagccagtgactccttcataaatcaccttcataaaccttcataaatggcccagcctcaggcattcctttatagcaagaacggcctgacacacccagggaattttcaattcaccggaagtctcacattttaaaccctgctgagtatttcaaggcccatcagcagcctgggctgacaggcatgtctagagatggctgcaggctgtggctgctggccgtggtgctgctctgcacgacagcatggtgacactcccgcatcagcaggttgggtgtgtggggggtcaggttggatcaaatgccctcatggccctgtagatgcccccggctgtacccacataagcctccgacacacaggacgatccctcacttgctcctgggcctggggggttctggaacttagaatttgtgaccctctgcatgcctacatccacctgggcattgaacacgcacttacagacaagctgggcgatgcattgccataattgaggatcccacccaggggtggccagtgcagataccaggaaggccgcgctgccgcaagcctggagacagctgccccgaggatgcctgcccggctgcgtctccaccgaggcccaaggcacgctactcggcgtgaccataagcataagggatgggagaaacgggcattcgttggttaaagtgaagatatgtcacccagctcacacatcttagcactgcctcacctttgaacgagcagggtgtggactagtgaggccctgctcctgcggtctcaggcacagtgctcagagctgggtctctagctggtcctgtgtgtggacgctgactcgaggaatctggttgccctagtccctgtgcagttgacgtgctttccccgaatgagcatcatggggccaaagcgcaagcaccctcctagcagggcagagcgctggcaccacgtggagctcacagaccaggcatggaatgtaccctctcctgcctgcttgtccaccagcacgtgctccgtaaatgcttgtctgatgggagaatctgctgtgagacttgctttccttgtaacctacaatgaaggtgtggaacaggggcacagcctcccccacctcaaattcctaccaaggagaacctaagagtcctgcccgcccacatccagcttgtttgcacctttcctttaggctcctcgcctgagcacagctccctggcgtcttggcagcagggaaggctctcgtgactgccaggggggtccctgctggggctaagagcttccaattgcctatggggaggaattgccagcagcagccgcttccaaagcatgctgagagaaaagagcaacccgtggtcctgccccaggcaggcgcatttacacctcgatatttatttccggatacagagtgctgtcctgtctgggtttgggactgggcctgggtgtcaccccggctgcagggatgcagggacacacccagccccatggtgctgctcctccccatcccgaggccacctgctcggcgctagggtctgcagggcactgctcagaagcaactgagtccggaccaggcaggaacagatggcagagtcatcaggcaagtcaactgtaattggaacaaacagcagaggctcgcaaatgtggatgtggctatttctaaagacaagggggaagcatccaaagacacccccacagctcccccagctcctggctcagtgccctcctctggcttcccggcctctgtgaagaggggtgataagcaggcgctgtgctggcggctggcatccaaacggggtggttctgagagcaaggggccagatgcataatcactccagaatcataggcagaacccagggacggtccaggctcaccgggtcacttgacttagtgtcagaggcgttcaaaccacagcgactccatcttgaataggggctgggaaagatgaggctgagacctactgggctgcgttcccagatggtgaaggcattctaagtcacaggatgagataggagctcagcacaagatacaggtctcaaagaccctgctgataaaacagggcgcagtaaaggagccaccgagacccaccaaaaccaagatggcaaagagagtgaccgctggttgtcctcacagcacattacacgctcattataatgcattggctgctaaaagacactcccctcagcgccatgacagtttacagacgccaaggcagcatcaggaagttcccctacatggcttgaaaagggtggagccctcagttccgggaactgcccaccctcccccgacaaaaactcatgaacaatctaccccttttcagcatataatcaagaaacaaccacgaatagcccacactgctgctctgcctatggagtggccatccattcgtttcttcacttctctcacatactggctttcgccttcctctacggactcacccaaattctttcttgcgcaagatccaagaaccctctcttggggtctggatcgaggctgctttccggtaacattaggaaaatttggaaacaaattgtcccatgtgctgtctttatgtgatttcattgatcactggctgaatacctactatgtgccaggccctacgtgatttcattgatcactggctgaatacctgctatgtgccaggccctctgatttcatagctcactggctgaatacctactatgtgccaggccctacgtgatttcattgatcactggctgaatacctactatgtggcaggccctgcgtgatttcattgctcactggctgaatacctactatgtgcttggccctgcctgggggagtcatgcattgctgctgactcagagagacctccccggtaagttggtgttaggccattgcaccagggcagaagacgaggccaagagggacttgcggtcacacccccagtgggcagtaggacccacccaggtctctctggcctctgagtctctctgtccagggcccacctaagcccaagcctgtgccctcactcacccacacattcccctaacacactcactggcccaggggtcacccagcctctgaacaagagccaggcagggctggttccctgcaggccgagcaggcccagcgcctgggaccacagccctttagcttcaggggcccacagacatggttccattttagtttcttttaaaatcagaaaagaagtgaaaaagggtgagacatacatcatgcatccagcctgtgtaatactcatctttattccacaatagacgcaaaacacaactgttaggattattttatggaggaagggacgacccctaaaggcaaaggccacacagcccacaatcatccactgcaggcctgaggccagacgcctgcggggaggtagacctcagcctgcctgggaagcaagcacgctggccaccccgaaagtctcccagggaggaaggggggctgttcaggaaaaatagccgggctcctctgaggccgagacgaaccagggctgacatcacctgaggttcaatgcctcgctccaggaggagacacccaaggcgctgtggagagaaggcgagggactcccatcagggtgccctgaagaaccaccacagagctgccgacacgcacacgccaagcacacagcactggcacaggctcctcatgacgttcccctgaccaggaagcccagatcctcatctcttagcccagccacatggtgacaagcacaccagcccctagacttttctcaaagcacctgagagggtgttaccaggctgacttcctgcccttggggccatgccctggcacttgggagctgtgtgtcctcgggtaagtggctcattgtctctgtgccccgattgcctaatcagcaaaatgaggtgacagagaacctcaggcagtggtttcaggggttaaatatgactgtatttctcaagagcctggggtaaagcgacttcctgcattcctgccctctgctactgctgcgcacccagggaataccagcgggtgaagatggcccggccggcgcttcctcagtctggagctgccaacactgacttatgattcagcctccagtacgctctacaggcaggaccagggtcgctgtcccctctgcccccacccagcacctgcagggaggtcagagttctgagctgacaggaagctgtgctgtgcagcagccgtggaaggcctggactccggagccaaactcctgaggcttgaatgggattctgctcatgactatctgagaccctcaggcaggtcattcattaacctccctgtgtcttggtttcccccagacatgaagaagatcaagtgaaatgggcattatcttgtggatgtctcgatgtctctcctatgcactctcaggacacggcccagcacagggcacctgtttgaggtggtggtgttgctctcattgttttcttttgcttctctgttttgataggacgctaagtgccaaaggaattatttaactcctagcagctggaatctccctgctctcaggttcttaggtttacaaaaagaactgtcttgacaggcaagttcctgaaaacctctgttctgtgtttaaatcctgatgcacatctttgctaaaccccaaaactagctcagggtactcctgggacctcaggacttcacgcagagcaaccaagaaaaaagacacttccccattgccaccaaaacctcctggccattcattctttagagaacagggcccagaagtgtccatggcactggagttgtgtatgtggggaccgtgaaaggaaaataaatctcaggaccccacaatcaccaagccaaagggaagcatgaagctgggaaccgtgtcagcaaacctggcttccattgtgcttctaaataagatagccgcaaagattaaaaagctacctacctccctcagaatttgcacacacagagattccttgtggacctcaagatctttatcctaaaacagttccgctgaagttcacccaggcaatgtaaattgatcgtttatcttcacagggatgggacaaagaactcagctcctaaccctctgctcacccgagacaaaggtatatctgattgtttcttctgccctattatttatgcaaaaatgcagattcaatgagccagactaaggcacaaatgacaattcctctgcctccctctcacatggaaattgtgtattcagtgaaaggctcatcagagactcaaaagaatgcaaccctttgtctcttctctacctattgaaaccaccattgcaaaatgataactgagacagtgaaagagatctgacctaactccatcgtgcttctaacctccaagctgtccttgttcattcctgggtgtaggctgaacgaactctgtgaggagcttagtgtgtagtttagctttgaaacaaagaagataacagccctttcccaaaacaagcctccttccctgcctggaaataagactgcctttgcaggactaacaaattggccacaagactataaattattgtttaagagccatgcagctagaggctgaaagattctgaccctccccaaattgctcctggagataacatcactattgtaaaacctaagatcagttattgagatattttgtagaccctgccctctatggatgaactagctcatctggtcttgtggtccccacccaggaactgactcagtgcaagaggacagcttcgaccccctatgatttcatctccaacccagccaatcagcactcccaactcactggccccctagccaccacattatccttaaaaactccagtctccaaattctcaggaagactgattgagtagtaataaaactctggtttcctgtacagccagctctgcatgaattactctttctctattgcaacatccctgtcttaataaattggctgtatctaggcaacgggcaaggtgaacccactaggcggttacactatgacccagaagcccccgcttcaagttgtctcacctttccagaccgaaccaatgtacatcttatacttattgatgactcacatctctctaaaatgtataaaagcaagctgtacccagacagccttgggcacatgtcatcaagacctcccgaggctgtgtcacaggtgcgtccttaacattggccatgtcctgaattgattgagacccatctcagacacctttggttctccgtgtgctcaggcattttatgtaacatgtgttctggggtgtatcctatctaggcgccctctattgtatctggctgagcatggaagcaggctgcccagtggaatgttctgtctacagaaagtcacgaatatgccccattctccaaggacacaaacacctagacatgaaacccccactgcacaccacaggtggttctttgatgggtgagtgggtgggacttgacagccatggtttcttggtcaacagctgcagtgttgggatcaggttcccaaagtgctcaccctgcaaaggccagggcttcccagggaacgcactgctgaaaatactctctgcttcccaggagctggcctcacaggctccctaaacaatgcttctcagacctcagtggcatgagaaacatctggaagggtgattacagccaaccttgggcccctccctgaggggtttggattcagcaggtccgaggccgggcctgagaagccactttgctcacaagctcctgggcgctgctgctgccccggggaacccacttagagaaccacttgtccagaagtgggaaaggccgttccttccacgaactcaccatccaactcagaggcgtggaaaactttcaaaggcctgtctcgggggcaacccagcctctcctccaccccaggggaatagcaagggggtggtctttgacagagaggagcgcaggcagcctccctggcctgtgggaaggagcttgctgtccacacaacgcagaggcagaacggaaggttgtgaggctcaggcgtgcagcttgaattctgatgaccagtaaccgaattaaccgaattcagggttatccgctaggctctctcaacaactctggcccaaggatagaatcaacccacaatttctctcctctgcggtcatctgaaccccaggactgctctcccagcctgacagtcacagccttggcaggacgggaagagccatgtgtctgggcctgcgcagcacctcagcgagcatggcgttgcatttgacgcccggatgagggggaggccctgcttgtggagctcctcggagcagctcctcagctcccccaggctgaggaaccccgaccaccccccacctgcgtcagaagctgcagttcaggaagcagaggcaggtcagagcaggcccaggactcatggccgcgtccactcacgggaaaagcatcgccaagcacgccgggcagggaagatgctattctctagaatacctgcatgctgtccaaggtgttctgcgcgaagagcaaagcaagacagttacagaaagacgccgtaaataaaagacacaattcccagcacatccgaattgccttgtttttcgaaccaaagcacgctgcgttgcgaccgtcaccacatttgaaagcatgcaccaccagcagcacggggtgacaggtgacagcgggatcatggtggagcagtccctcagaggcggattgaagccacacagggtcatgtcaatgggctccggggcaactggggagaggcaactaccttttctgccaggagacgatgcaaattaaagtgcggtggataactcaggccagggaaagtgaattattttccagggagataaatggccatttggaggtctgtttctattctcccaggttatatattttcctatttgctattcatcacactcctccctccagatagtcattaactaatggaggctttcagaaaatccattttaatatataggatgataatgatgaaaccttttcctgtgggaggaatagactttaaaaggcaacgtaagagatgcacatagcccgttttaagtggctgctgctcccccagggacacaggacaaggtcattctgaagagggcagcctcatccaatattggcctcacttaagggaacattaccgggaggacgccaccccagggcagatcccctccgaggtaaatctctccttgagggggtggtgaattacacgatccttgacttcggcaggtgggggccccagctcactgtagcccagccactgtgcatgatggatgcagacagcagaggcctgagggggaccccatagccctccctgtctgcctggctactcactcccaaggaggctggcattggaccaggagccagggacaggggtggtcactcccaatacgccactcacgcaggtgggacgtagccgttgtttccttcccaaggccccagtgggaaacatctctgggaggcaggagaaggccactcatgtcgtgtttgcgaggaccacacccggggaagtgcctcagatggcgctgaggactctgattccccaggccctcctttctctgatcctacaaatgcctccccaggatgggtgtcataccttaaaaaggtaccccaaggcagttcatcagagaccaggatggcctccggaaggtccaccggcctttacccctggggaaattaattcacaagcaagcgagtgagccacgccccctcactttccacccaagaggagccaccagaggacagcagaccacatctgagacacacagttctgggtctggatgtgtggccaagggaaagctgcttaacctctctgtgcctcagtttccctgtaagaacggacctggtcctggcacctgtagtactggttgcttgtgaggatgacatgagaagacacatgaatggcatctagtaactggtgcaccaggcgcacttcataaacatcatctattatttctagcaggcatcagggcaactctccccaacgtcccccacccccgggcagaaagcaggggcacgctccttacctctagcagccgcactgcgccttcatgctccttcttagcctcaacctgagccttttttatgatgaaaagagagaaaagagtaaatgtccaaaggggaaagaagacaatcggatcaatgtctgaatcactgggggtgggggatcatttatttttattcctctaatagaggaattaaaattattcctacattcattatttaacttttatttgagtttcagaaatacatgtgcaggtttgctgtacagataaattgcacatccagggggtctgggacacagattatttcttcacccaggtgataagcttagtagcagaagcatccctccaatgcctctgacagcaccttcatctgcccaaacatccgacgaactgctttggaaacaaaacctaatcctgcagacttgactcccagtcagctctaggttccctgagacctcaccaggccctggaggaggggccggggctgggtcctgagcatgcaacaggccttggcacctgcagcctgtggcagggccgccctcttcaaagcactggcggcaaagccatctgggccccacagaataacttcacatgtttcactacagaaatgtctcgggatggctgctgcccaggcaaagggcagattcaagcacatctgagatggaacactatcatttcttgtcctcacaggcctggaagtcccagcatcaaacaccgttatttcttgtcctcacaggcccggaagtcccagcatcatcatgatggtaaggacctgtcgtgtttcaatggctttgatgttttgaaggtccttgtagccctcggcatagttccttgagtctcactaacttttctgcagacctaacgtttcaaaagacccatggaggcccctcactctgctccatctaagccaatgcccgttgtcccgtcacagtcgccaggggcctggacggcttattgctctgtgccccatctgacccagctagatgcccagcacttcggccacagggaatctgccctcccttctgtgagcgccatccccccagatgctcctgctgctcctgctgcagggcctgcccacctcctggatagcggatcctctgggtaacaggcctgttcctcaggcctcttcctccagcgtcaggagctcctctcctgggaagaacctctggactggctggggtctggacctcccctgtgccaagcacagtctgaaccctcagcgactggtgacctgggtggtgtggggcctacggagggcaatgggcctctgcctgagaatgctgcgggagagggaagcccctttctattggactttggcttgggaggaggtgaggctgcagccactttgccaccaggagggtcagggctggagtggctgggggtctccacagggaaaccaaggctgaagctgatccagaggagggcagagagcagccaagtcctggtgatgtcggggaggccttggattctactgggtctgaggccagcagatttgagccctggatctagccatgtctgaagccacattttcagtgatgggcacaaaaacaatttcctgtttgggttttctgtcgcttgaaaccaagagtgctaacgaacgtcatcgtcaactgtgaaagcatgggacacttcctaaagtgcggacactggaggttggttttctgaggctgtaatgagacagagaagaaaagacgaaccaggctcccgcctgcagcacagtccacactgtgcacccctcacactgacatcagcatctcccaaacattccccgtggagcaggaaaatgggggtttttaagaagcattattttctgacaccagagtgcacctagctcttaaaacgtggaacactaataaagaatccatatgctacgctgtgacttacatttacaattctcagtttctagagaaatatttcctctagctgcctggagaataattagtgatggacgattcaacatcataaataagcaagtgaacattatcttaacagtttctacttctcattctcaaaattccgtgcgctgaaaacagggaagagcttggcttccccagccaaggggaaatctgccattccctgggctaaaaatgaagagtcgtctgaggtttctgtagagttcattcatatgagttccattctcacatatttccaatgagagttttaagagctgggcaagtgactggaacacagcatgttaattacaccattctcaagttcagctcaaccgtcgaaggccgaaaactgttcctttcaaagcaaaaaccagcaagagcaacaataaatagcaaaatagaaaaagagacaaacaagcagggaacatacagggattatataaatgatgccaccattgactcagttgaatcaaagatagttttcaactggcaggattgaaaaaaaagacaaaacaaaaaatattccagcaggctgttaaaactcagccaagctggcagtacaacttcgcttccagcttcagatgaaaaccagtgcatttttgcaggtgcaaactgggccatttgggcaatcagaatagactgttgaaattggcagcgctgaattcttacaaaatccaagcaacagcttaagcgaggctcatttaggggccaacacagggaaagtgcgacctttacggagagtggttcctgcagagcagggagactggagctcccgacgctggaggaagaggcctgaggaacaggcctgttacccagaggatctgctctccgggaggtgggcaggccctgcggcaggagcagcagcagcatctggggggatggcgctcacagaagggagggcagattccctgtggccgaagtgctgggcatctagctaggttggatggggcacagagcaataggccgtccaggcccccggcgactgtgacgggacaacgggcattggcttagatggagcagagtgagggaggggcctccgtgggcgttatgaaacgttagctctgcagaaaagtcagtgagactcaaggaactatgccgagggctacaaggaccttcaaaacaggagttccgcagagctgagggctgatggacattttctaatactccaggagcacacaggattagggcagacactgcctgaaactaacacagagggtcagctatgacccaccgcagccatccacacacaactgaggccgacaatctgagggcagcacagcaaattcagtcaaagcattaactatgcatcgggcggtgagctcagcttctcttagtatcacacgttacataatagccttaagactgaaagcggtcattctaccagtaagaggaactgtagaccgaagtaaaatcggtcaagtctgcggatgaattataaatacggaaaagccctttagctcacaccactggattatcataattgccacttgtcacaagacaaggatgtaacctacacaagaaactgaaagtctgaagcaacggagcgcagccggaccccaggctgaccattcacctggagaggaagcctcagggtttcagaatcgggtctcaagtggaccacgggcatgttagcctcagcctccttatccgtcacatggagaaaacaatggtgcctccgccccgcaggttacacgagggctgactattcattgattccctccacaggcatttactgaatgttaatgagaatttatcctcggtcatcttatctgcgggattttgaccctactgccccgactgacggaacctcgtcacatctccaattccttctgtgcccttgagcacctccgcccatccaggatttgctggggagctcctaggtgtcaggcgatgtcctacgagtccgacgcgcctttcacggagctgaagtgccaacaggtggaggtgggcagtcggcaaacagccacatgagcgagcaggcatgttttggcatcagtaaatggggcgacatgccctctgtctgggcatggagtggcgtctggtctgagggagactcagtgagagaaatgaaccagttctgcaacaacctggggaccaggcattgtcgataagggtccccaagaggggactggctttggcacggtccagggagaggaggaagcagctgcagcatggggagcgggaggagtggcagaggtggcacagctcaaaggaggccacgactgcactccgggtcccagcccggacacgctgcaccagcagatttgtgcccagagtcgcttctaccatcgtcatgaccattcacagcctgttctcacaccgtcccactccttgctgtgttgctgggacttcactgacatgagacgctccgtaaacgtctgttgagtgaatggacgcagggatttgtgaatgagctcttgctcccggtctccaggaagcacgcgtctcccgggagagcctgaggttaccagcagacagcgtgggtcctggcttggctgccttttgcctttttaaactgtgtctctgctcaggtcccagagacgagggctgcagcatgagctcattgtccctggattccgggaggagagccctgggcactttcatcactcattcgtcattcacccatttgtttatttctccgatttaacaaatgctttccctttcacatgatcttacgtgcttctcccgaccgccatgcagggcaggaggacaggtggagctgcctgggagaaaggtgcctctggacaaggtgctgggatgcaggcccctgatattagacgcctgaatgtccagcaccctctcaagggtggtcaggtctgggggtgaagctgatcccaccaaggaatctctaagtactgcacaatgtggcacaatccacctgtatttcaggaaaaataaactcctgcctcacattgcacatcaagaaaaacaacattataggatggaggaagctgaggatgaaagcacaaagaggcagggaggagacccgcagacggtggggaggggcatttccaggacctggactgaaggaagaggccaggggctccaggcgggcgtctccaaggggaaaatggaatcagaagccccccagaggactgagactctcttgagaggaattttacagcttcagcagggtattggggaacaaaggaatgatgggtacacagagaagtaagacaacaagcaaacaaaaaaggcaattaactccagggaaaggaagagctgtacaaaaacgggagatgctgccgtttacggagctcaaggagttcagcagaagtgcaggtgttggtgaggacagaggggagttctgtgtgggacgtggcgtccgaggccccccaagcagtggtgtcaagcagagggtgagtaaaggaattggggcacagtggcatcgtctggcttccgggtctaaacccgggagttaccacgcagaggtggtgctgaaacccatgcatctatgtgaggtcatgagacagtgagtatagactgagaagggatgtgacttcaggactgagtcttagagtcacctgtgatgtgtagaggggctggtgtggagaaggaaaccaggagagggtggtatccttggaggccataagctcaaactgggcctccgggtcaaagaaaacgaggacagagaactacccactggaccgtaagctcatgcatgggtgacactaacaaaagccacttgttgggggtggggtcccgtgacggcaagttcaagaaagagctggggttgcagaaagagagaagagggtcactcctttgagatggctccacagccctctcatcagaatcacctttgggccttggagagtccaaagacgactggtgacttctatcttggtagggggatgagggccagtcttcagctaatccgtgcctcatggtgcaggcaccactgcctggtggggtaagcactccagctctgtgcctcaggcccaaattcaacccctgttccctccctggctgcaccccagctacccggccttcttcctcttccctggatgcgctgggctggttcccaagggggcctgtgtgtgctgctccctaacccttgcacactcctgccccagccctcggcgtggtgggtgtcatctgctccttgaactgtcacctgtatctaaagtcacggccccgtcaatccgccactcaagcctctcaactcccttcaccccttgccatcatctgggcttactcgctttttcactgacttgttcgtcttccttttttagcctgggagggcagagccgtgtcccactcgcagctgtgttcctgcttctggaacagcagctgagtggctgcttggaggggcagacggccgacccctgctgaatgacggtacgacggagctggtcacaagtgcagtgcaacgaccacccacgtggaaactgaatgcaaagatgagctctggaaagaagtcccggatctcattccactcaagagtcagacttcctcttctcatgcttaaaaactacatcaaagcctctagaaattacaaaattggcccattcatatttcatccagtttctctccctctgcccctcgccccactagtgaagcatcagtgtgtccaaaacagagacaatggtgagtgcggggggataaagaacgccaagagaactggacagcacacagaagagatcgtggacgcggaataacagagtcagttccaggtcattctccttggcatcaaatgcttagtaaatctaactccaggcttctagagaatgttctgttgagaggagacatcctttccccttcctggacagtctctgtgtttctacagacttatatctgtctcagacggtccccgcctggggacgtggcttctggagtgtgacgaataagtgcaggtgccatcaggcgtcacccggccacgggaaaggtccttgagacatggcaggagaacataagagtaatattcctgcccgtgtcccagcaatatcccttgcggataacatctaatgaaatattgctgctccgggtgcctgccaccttattatgacaggtaataagggctgtgaagttcccatcagcgctggcttaatgaaatctatccttaatacgatctcatgctaaatgcttagagaaatggcatcagaacttatctacctgtttccacaagctctgctaataaactctggaggagaaacgctgctccggcagattcctatcgccccccaggctgggtgaatgactgtgagccctttattttgagatccaagacctggataagctgtcggatggatcgaggggccacctagggcagaggagtggcccatcccagccagcaccgggcgggaggctgcagaccagccagctgcactctggccacaggggtggctgccctgccaggaggaggagagggcagggctgggtggggacactgggctctggaaggaaatgagatgagacctgttcacaggtccccaccttctgatttcttcctgggggcaccccaagcccataggctccgggagcaccaccctcctacctatctggagagagacagcaggaccgtggctgaggactggagtggggtgaggttacctttctcagtccccagacccatcacaggtgcccaggaggtaaaaatcccaaatcactcagtccttccttccctccttccctggtgcctctctcctttctctcctgatttcttttcctttctgtcttactcatcttgcctttttcctttcttactgggatccggctataaatattgctctgcaactcagttttctcacttgataacacatcatgcaacagcctcaagacagcagaatcaaaccaccatgatccttttcgctgacatcacacggcgcctggtgtggatggaccatggtgcacacagccatcacccttaggtgggcatcaattgggtccagtccctgtccccactgccacacagcagcactgcaagaaaacaaaactccttttgaactggttcctgtactccttgcagggcatcgtccaggatgggggtggcagggtcaccttctgtgtgcccttttagtttaaacggatgctgcacactgctttttccagaagcggaagcaattcacaccctgccagccatctctacgcatgtgtttttcccgacaacctcaccagcatcagaggttagagctttgcatctgctttcgcgttataaaacatgaacacaggtctacttaagaaacaccacagcaggaaagcagaaatgactctgaattcttctgtgcaagcagagagagggagcggcctgggagccaaggccgcaggtcggccgctccaccacaccagggatccccggcccacccgtggactccctgcctcgcacgccgcgcccggctgcccgccgcttaccttctgcagaaggtcaatttcctgctgcttggcactgagaacagccagggcctggtcatgctccaactgcagctgctgccgccgttcagccgcctctcgcatatgctgtggggacagagagaggcctggctgagcagggcagcctgtgcccatgggcgtgcatcctataccctgcaccaagctggctctgactcagcccggtcactccagagcagcccctcaccgccccacagggcacccacctccgtgctgccaacagggctcctccagaggcggcactcccaatgcgggagctatgacataaacaagccccccacctgccacttctcctctgcaggttccaaatgcagcgagcatttgagcagaactctgtcctcatgcaaatgtgactttcgtctttttgcttgttttgaaaaagtgaatctccctcctgtgccttttttgcccaggtcctttgtatataacagcaaaggcttattgatgctgccctgtgtgcccagcactggttcagggttttatctgcatttaagtcatatcatccccatcataagcctaggaggtaggttctagaagtagcctcattctacagagagggaaactgaggcacaggatgtcatccttgcccatcgggcagctgggaagtggacgcctgttcagaatgcaaacccagagtccgcaccctcccgggagcttcccggcctcgggccgagtccgcaccctcccgggagcttcccgacctcgggctctggtcctgactgccgactccagtgaaccagcgcactcagacccaggagtccaaattccttcacttacccctctgggaaagtcgcaaggtggcccccatcagccaggcccattttctgcagcagagaggacagagccgggttcctggctctgtcctctccccctgacaatccgtctgtcctgcttggaggggcggtgcttaatccccagtgctcagggtttaactctcacctatttgccctctgcgggcccttccctcccctctgacgggtctcacgagcccagagtcaccactgggaccctgacagtgaggaccaggcccccagacccatgaagctcacagcagtgaccagccacgaaccctggcagcctgcaggaggaaacacatgggaaatgacattgggtagaaatggccacagcgggcgggtgggtagtcacactgggaacagtcacagaaaacatttcctggggtccccaagccactcctgggggcttggaaaaccagctgcaaaatgctagaatttcattgtcatttcctttcatacacacacacacacacacacacacacacacacacacacctgtggtaacttcgtggtcaacattttaaaatctgggtcttttatataaaagaccagattccttcaaaaatgggaagagttggccacgcatgcctccaggaaaggactgagaagggagtgggagctgccccttccgatggcatatacccccgatgtctgcggccccacgggcctgccccccatgtcccctgacatccgagggccacacagatgacccaggtcctaaagcaagtgggtgtcttggccccagcgagccatgggggacccacacgccttcctcctgggctggaactggttggtcatttattttttattattttattattttacaattccattgatttttagccttttactcatttttatttatttttatttttttgagatggagtcttgctctgtcacccaggctggagtacagtggcaggatcttggctcactgcagcctccacctcctgggttcaagctactctcgtgcttcagcctccctagtagctgggattacaggtgcccaccaccatgctgggctaatttttgtatttttagtagatacagggttttgccatgttggccaggctggtctggaactcctgacctcaggcgatccgcctgcctcggcctcccaaagtgctgggattacaggcgtgagccaccgcgcccgaccaccttttactcatttttatttagttttggagtcttaaaggcctgtagccttcgcaagtcatgaggtcggacacacgcgtccaagagaaggttaacgtggtttcctgaggccgctgccaactcagcctgagctggaaagaggagcctggcaggggggaggcgagggagtccctgctgagactggcaagctgtgagggcggggggcacccaggctcagggggaggggtgtggcccctcgggaggaggcaggtggtgagggcgggggcacccaggctcagggggaggggtgtggccccgcaggaggaggcagacaggctgattacattcttcttgccagttttccaaaggtagccctactgctaccttttttgctgcctctgaaagctcctttcttctgggaaagatcttgaaacagaaccactttaactgagggtggggaaagcctccacttttcattctgcaaagcgctgtggttggtgggatattttgtttgtgtttaaaaagtgaagtcttcctcccggcccgtgtttcaggcacggcaacctcacgtgctggttcatctacatttttaagctgaataaactcggcatcctctctgctgtctccagaagaggctcccagtgaactcagaagctggaattaccctgcacccccacagacatctgggggtttcactgttgctatgggaactctcacaagaacccgggatccggagaaaatggagttccccaaaacatgaacaaaaccccatgaaacacgggtgtcgcggtcagtggccctcgccagttcactctggggccagatgggccccagggaaacaccatgcttgtatcttcccacgtttactccagctctgagcctgggcaggcctggccctcctgggaagaagccctgggtatttgctgcacagccctcccgagatccgccctgacacactgctccccccgccccgctgggctgtcagcccatttgggcctcgccatttctaacggtctctttccaagagcctcagtttccccccgaccccccaagccgccaccaccaccaccacccaccgcccaccaccagttcactgtgagtgcaaaccagctgcatacattgcagggcatttttaggaggacggggacaagccaccaagacaaactgacagagccctgggggatgcaggggattccccgagctcctgagacgctttgggaactcttctccaaaccctggctgccacctcagtgcggtgtggctttgctctggtgtcaggtttccccatgagggtcccagaggtcctcaggacggacagtctctgcagaccctcatgaggccctccgtgtggggcttccagctccagagaggactatttctactccatttattcattcattgcttcttctggatattggttcatcggactggatttattgagcacctactaggtgccaagaagctggggacacagaacaggacaaacgtgtcttcatgagagaacaccccagagtgggggcacagtgtgaaggcagatcgatgaaacgagaagggcccgagtgtggcacggagcaggatggaggcacctaaatgacatctgtggtcctggacttcaggagtggccatttcctacatcctaacaccagcctcaatctgatacgaggaggagatttcagccagattccaccaggagaactcgctcactcaactcactcaacaaatacttacccaagcacttgttttgtgccaggcaccctgctggcttctgaaggctacagcaacgcaaaacaaagcaaaacaaaaccagctctcttggagctcacattctgcaggggagggggcacacctcatcccaatacacccattgtgtgtgtacatgtgtcagattctgcaggggagggggcagacctcatcccaatacacccattgtgtgtgtacatgtgtcagattctgcaggggagggggcagacctcatccaaatacacccattgtgtgtgtacatgtgtcagattctgcaggggagggggcacacctcatccaaatacacccattgtgtgtgtacatgtgtcagattctgcaggggagggggcagacctcatccaattacacccattgtgtgtgtacatgtgtcagattctgcaggggagggggcagacctcatccaaatacacccactgtgtgtgtacatgtgtcagattctgcaggggagggggcacacctcatccaaatacacccattgtgtgtgtacatgtgtcagattctgcaggggagggggcagacctcatccaaatacacccactgtgtgtgtacatgtgtcagattctgcaggggagggggcagacctcatccaaatacacccactgtgtgtgtacatgtgtcagattctgcaggggagggggcagacctcatccaaatacgccgattgtgtgtgtacacgggtcagcagtcctaagcaccatggggtcaggcggtcctaagtccacaaatgcacgcacctactatgcagccacaaaaattgtaaaaaattaaaaataaataaataaaaggggagaaacagaaaaaataaactgctaaaaatatacttttactttttataaacaaaggggatgggagctgcagtcctgctgggggctggcctgtcggctgagaaggccaaggaagccccccaccaagatggtgctaaacaaaggctcacaccagagacagagccccacgcggctgtgggtggaaggcgggatacacagtgcccagagcccccaccctcacctacacacagtgcccagagcccccgtccccacctagacacagtgcccggagcccccatccctcacctacacacagtgcccagagcccccgtccccacctagacacagtgcccggagcccccatccctcacctacacacagtgcccggagcccccgtccccacctagatacggtgcccggagccccgaccctcacctacacacggtgcccggagcccccaccctcacctacacacagtgcccggagcccccgtccccacctagacacggtgcccggagcccctgtccccgcctagatgtgtccctgagccatgccactaacaggggctgcgagggcttccgcggctcctggaaaggccccagaagttcccccaggcactggcttgctggcatggacaatgtcccatgggaaggatagactggaggcgaaacatctctccagagtctgccggcgactgtcacttaggtgtccttggccggaaggagcccgatgccccccgaagtggacccctggccccatgtcgcatcccagctgaaagcccctcggtggggagtaaagcggcatgctgtcacagggccacctgactgcctcttgcctcctgatgccgctgccaccaccatctgcctgcctctcatgccctgctgtaacaccctggctttcgcgctgtttctaaagagcagaccagtgcccgcctctggaccttcacacgtgttgctctccctgctagcctgactctcacgttccagcctttgcccagatgccacttcgcactgaagcctggtggccgcccggcccctcctggatacaccatgttctccacctgccttattttcctcctgagcatcctcatccccagtgcactggccggctcccttgcctgctatctgctccttcccctggaacatgagcaggcaccttgccccactgtgtccctgtccccacaatgggtcactcggcacagatgccaaataatcaaactgccgccttcatggcctcttggagctcagtcccactgctgtccccaccacccccttctccagccacatgggcctcctcccagcccctggagctctccacgctgcccacatcaggggctggcagggaaggttgggggaaaagtgcttccagcatttcaggccagcaaaagccattaaagagcctgaacacctgggctcaaatcccagctctgatactggcccgctgtgtggtcttagagtagttacttaacctctctgttctccatgttcttcttttggattaatttttcaacactattctttttcaattggttagtgattagtgaaataactaatgttgattattaattaacacccacttcatagaggtgttttgaattttccttggcatctattaagttctctgtgttatgttttagtcccaagaggagaaaaccctttcccactggacgtgtgtagccctgtgtgatgtcacttaaacaccaggtacagggtgggagggagggactcatgaggcaaccagggctgcaccaacaggatgatggacagctaccgccgcattggtaaaatgacggtgagaaatcggaatgtggctgctgtcatttattaagcacctactatatgcagggcactatgcttgcccaggcactgtgtcatttgaggctgagggttgggtgctgtggtcactgcatcccagcagagcaacagactcagggaagctgagcaagggctaaaagccacagctggaacatggccgatgagaatgtcagaactcacagccagtctgctcccggccactgccccacttctgggttgagatgacttacaccagccactgccatcttggagcactacgggggccagggcagagaagcagctttcgacttcctcgcggcccacctggcctgggtggccgattgtgcagctgcttaattctgccattttggcttaattctggctaattttgtgcttctctttattttggaagggggcactgccaaaggcagactgtatcatctttatttagttctgggaaggaagttgttagcgagaggagggtgccaccttccctaccaggactcgctaggtagattcaccaggcaccgaaacagctccgggcgtggtcctgcggcctcagagtcactgaggataaaggggtggcggatgctatgctgggctcttgcttcggggtgccagtgagatgagggtttatagatcagatggatggaaacaagtacagggaagaagtctttgcatttctacggttaatgaaccaagtccgtacaaagcagctgtcagaaaggcgtgagcgggagaagcactcggccctcgaagacagcctcagtttcatcacagatgccatggctgggaggacaaggtttgctggggcttgttttggcttcagcatctatctctccaaatcttacctgtttctgcaaagccctcatccccctccagccactgcccatgtatctgcctcccatctcacacgctcttccagcccttccagtcagcctccctcctgtcactcggctgagattctcccactaaggcagccgaggagtccctgcagcccgaacccatggccactttcgtgccctgactggaccaaatccctcagcagcacccgacaccagggctgctcctcctggacatgccctggactctggcccccgtggggcgcgctgacctggtctctccccctgacctctgcaatgacctcccgctgatctctaaatcctggaggggccacggctctatttataccattccttaggtgatcttagccagctttgaggttttaattgccacataattccaaatgaacccttcatccccgtcccccgcccccccgccactcatacccaactgcctactcattatccccacatggatgtacaggaggaagctcaaatttagcctgtccgaaatagaattcttgattttcttcctcaaacaagttccctccccaagctgtgccatctcggccaaggacaccatcatcccctcagctcctccagatgcaaagctgacagtcattcttgacttcctgccccctttcccgccttgttcaacatccagatctttgagaaaaaaaaaaacctcccaatttaaaaaaatgtgcacccaaactccccccacccatgtctgccgttctctcctgtgtccaacgctgccacctcatctctcccctagactatggtagactacggcagaagagccctttctgccccgagacagctcctcctctcccctggaccataaccagctcctcagagccctttctgccccgagacagctcctccagagccactggctgcaccagagattgccccacagccattctccttcaagagcacaaaggctgccaactgcaccgggaacaaaatccagactcctggctgcagccaacaggctcctctgtgatccagcctcttctctgccctcacctctcacctctgccccttcctcactgtgcttttgccacactggcttcgctcagttccatgatcacgtcaaggtcatccccaactccaggtcttagcgagtgccattcctgctgtccgacatgcttgtccctgcatcaccacgtggccagcccttcacggcgtgatggggtttaggatgtgttccctccaaacctcaggttgaaatgtgacccctgtgttggaggtggggcctggtgggaggtgtctgggtcacgggggcatagccctcatgaatagcttggtgccctccccatagcgataagtgagttcttgctctgagttcactcgagagctggttgtttaagggagcctggctcctcctccctgtctcttgctacctttctcaccatgtgatgcacctgctcccactttgccttctgccatgtttggaagcttcctgaggcctcaccagaagctgagcagatgctggtgccatgcttgtacagcctgcagaactgtgagataaattcgcttcttttctttacaaaatacccagtctcaggtatttctttataacaacacaaaacggacaaagacatggcaagtgtcctgaccagtgaccagagattattttatttacgtgtttattctatgtcatcctttccatcccactccctacccttgtccatgagaaccacaggatcacaggacttgtttccctgtctactggtgcacccccggcccagaacagtctctgacacatggtgaggcagaatcaatgacagcaaaggtgaggcctctcgcctaaaacatctgtcccacgcccccagcccacactcccctctccatccctcacagcctcccacatgactctgcagcaatgctgtaacctgcttggtaccgttctaattccatgtaattctcactttctcaactggactagaaatggctccatttccgtgtgtgcactccacaggcaacaggagtctaattaacattttctaagtggaattaaagcaatgattttgagtggaggattcatcctgtggctgtctagaaactagactttaacacttgaggagcctagagaagattggatcctcactaccaaagattccacatttcaccaaacccacagtcaaaactgtgaaccagagacataagctggttctcctggaggccatcacactggcggagttagtcacgcagctataataaaacatctctcggagatgggctttgagactgatgagggtagagtgaagtggatggcgaaaaaaaagtttaagccaaaaataggagagatattggctgcaaaggctgaaattcgtggtgttaggtggatggtaggggaaaagatagctcagtcagggggtggtgggggccgtaagtttaatattagtgaggtctacgaaccagccaaaaaaaagagaaatggacaaggctcacaaacacacggacatgctaaatatatccatccatcctggcatgaggacatactgattcattctgcacagcgttacttttctaaatgtagccagtgtgcatgtctctgttgaaacatctatagaaaaatcagtgttgcaaggctgagatattaatcaatgtttctttctatcactaaccctctatttctcctccattcccctcccacttcccatcctgagggctccattccatgctcactgcctcagggaggatgagagatgggtcagggaagagcagaaactggggactcccctgggctttggtctgcagagataaggggaatcaagaagacagcatacagaggggttactgtgagaaactgagactagatttcccttctaatctgcagaaatatattgcttcaccagaggcagacaaattagctgagaagaaccgatgcatgtatagacactggtggatgggctcttggctctgctttctggaaagttccagagagctgactcctacagaattcacggctagcatggggagttgagaaaatggagcttaaacagcctggcagggatttctgaacgaccctgggatagctaagagcccacgtgaatgcatacaactaaacaattaaattctttcatgtcttatattttacaatgtcttcaagtaacttttacccttgtctctgaaataatggaaacaactggtagacggtggcttgtctacttttacagcctacatataagcaatacgcatcggatagaatggtgggaatctgtgtgtgtacgcctggatgagggcaggatggaatcccacaacatcttggctttgggtcaccctgcaccccagcctagatctcaccttggtgtgccaatcaactgcctcaggtctctcagatctactctctctccttctcttgttttgctctgtatcagaaagagctacacttcccagacgccctcgccctctgcttctgggtggtcagtcaacaggcagcatcggcgggagggaagccagggatttctacccctctctctgcctctcgagctgtctcctgtagaggctccgtctcctgtagaggctccatctcctgtctctaacccacggtctctgctcctgactctgagatcatcatcacccccactgtcccttcagccttagaggtgatgccaggttcacaatgcagccatctggcttcttagttcttccaccctgtgtgtcacaatcccctgtattaatgtccctccatttgaaataccttggctggctcctgctttttgactgaagtctgaccggtagactgaaggaaaaggatgaagccaactccaaattgatgacacatttctatcactctttcaaaatgcgtgtcttaaaagtgaattaagcactttgggaggccaaggagggtggatcacaaggtcaggagatcgagaccatcctggccaacatggtgaaaccccgtctctactaaaatacaaaaaattagccaggcatggtggcaggcacctgtagttccagctattcgggaggctgaggcaagagaatcgcttgaacccgggaggcggaggttgcagtgagccgagactgcaccactgcactccagcctgggtgacagagcgagactctgtctcaaaaaaaaaaaaaaaaaaagataaaaaagaaaagtgaattaagtaatgttgagggggttgttctgtttctttcacttgagttgttgcaactggactcaaacctgcttcacagacttactgtgacaattctaagttaaaaaaaaaactcacggaaatgttgattttgctgaccacctacaaagcagaaaataaatctgtccaggaaaatgtacaatctgataatgtttttgtttacttatctacaatttagcttggattttttactatcccttagtttgcttgaaattttcctattaaaaaataaatggttttgatgcttcttcccaactaggaaagcttgttctggtcccagctgtcagacaatcccgggctgatagctactttaatgaatcagcagcagaagtataaatcggggtacagggagatgggggtgaagatagaggtgcttggtttacctcaagagttataacatcacggggcaaaggcaggttcggtaagttccagctgccatttctctccaagggccaggaaacaacatcttaagataaaagtcactggccataaacaaccttattcaaggaaaataatctcgtctgcagggcacctgtggtgtgaaggctgagacctgtgagttcagcaacagaatcggccaagtgggggctgcagtaaacccctcggcttaccggccagtccacaggactaaaagagaggccaaatgccaactcaccccggaactcagccacaccataaaagagggagatgtggtcagagttcagtgggagggtggggagcgaagtgggaagcggtctacacagcagctcccgagccccctgtgtgtagcaacaatcaaaacccacgttagtgtttatcacagatcaccacctacaaatggtgggaaaatggtgttcttattccggtatgcacattgctggcacagttttcccagagaacctgcctgagacccagcccagctccagacatcagcctccacatgctcacctaaacacatctgaggattactaagttctagaagtactgttatgctaagtactgaacacacatcacccatttaatcggcacaacaacgcttgaagcaggtgatatttttattcccatttacagagaaggaaaccaaggcccagagcggttaagcaacgtgttcaagtttgcccagctaggccaggctcaagccaggatttgcacctagcgagcccagctcactctccctccactgtctctgctctctgctgtctaagaggcctcctccaggacctctctcatatttgcgggatgtgctgatgtttgctgggactctcttcaaggcagtacacatgagaaccttttctgcagtgccctgaagtcactccgcctccttccttccagagttctcaggccaccacgcacactgttcgtgcctctgtcacagagccatctgcacttctggggggcaatcgcactttccttctcacaacttccacaagcagctaggagtctctcggttcctgggagtgcaaggggcccaaggattcccaaagggagtctgaaaacctcgggtttcgcccagagacagaatcccaccacaccctgacaccgggcttccgcctccccgcgcagagaccttcccagggcacgtgctgtcattcatgggaaggcttcacatctgaaaagtactcaggattatgcgccacggccaaaactgcctgtctgaaacgctctgcctgtggcaggatttatttttaaagcagcgatatttatagctgactgtcgacattcacgccagcacttaagctgcctacaaatgtcagggtgccgctatcccagggaaaagctcggatgtgacacggaacgaacgaacctgaagcaaactgaattatctcctcaacgtcagatcaaacgtggacttgtcctgtgcttggatgctgccttgcctgagcgaagaaattaaggaaaaaccaatttccccaaataggagctaacggtgacactttgaatgtcacattagtgggatctgctacgcgtggtagaaataatgaagcatttatgtacacacgatttgctttcacccagcacctggcagaaggaatgcaagcactcacagaacccacgtcttcaaaagcaagaaagacaaggtctttaaagctgtttgttttcatggcatcacgactgtctgtcctagtcacagaagtcacactcattaagaatgagaatgtgtgtgaaaaacattcatgtgaattcagtgaggtctatttcagcccaagtattttagtttctcaaactgggaaaaaaaatggatccttaggagttcctttgggggaaaaaaaaagagagagagagagagaaagattttcctgagtgttgattggtctttgatcctaaagcctccttccttctcctctggccctgatgaatcctagagatgcaggggtggcaacattcatccatgctgctttgggagggttatttttctcacacacagtttctgtcctgccccagtggctcccggctgtgagcccgggattttggccagccaagtagaggggatcttatcagctggacctgtgttcaatgccatttccaacacgtacaggctgtgtgccctggggtgagttaggtacctctctgaacctcaggttccacgtttattgaatggcaacaaaaaataccgtccttcctaggttgtcgcaagaatgagattaaatgttagattcaaagggatctgcacagaaccaggtgcggcagctcacgcctgtaatcccagcactttgggaggccgaggcgggtggattgcttgagtccagaagtttgagaccagcctaggcaatatggcaaaaccccatatctgctaaaaatacaaaaaattagccaaatgtggtggcaaacacctgtagtcccagctattcaggggactggggctcaggcaggaggatggcttgggcgcaggaggcggaggctgcagtgagcctagataacgcactgcactccagcctgggtgagagagtgagatcgtagctcaaaaaaccaaaacaaaacaaaaaaacaaagtgacctgcacaggaattaagtttcatgtaaatatcactaagttttatttaggtctgccactcgatttggcttctgttagttccctcccattttcattatttgatctcccctttcctgccttctttttgttttttgttgtttctttttgttcgttttgttttgtttttgagatggaatctcgctctgttgcccaggctggagtgcaatggcgtgatctcggctcactgcaacctccacctcctgagttcaagcaattctcatgcttcagcttcctgagtagctgggattacaggcgtgtaccaccacgcctggttaatttttgtatttttagtagagacggggtttcagcatgttggccaggctggtctcaaactcctgacctcaggtgatctgcctgcctcaacctcccaaagtgctgggattccaggcgggagccaccatgcccagcctggttttcaattttaatgtctccatggagtgctgttctgtatgtttttatgtcactcctagtggttgccccagggaactcaatatacatatttaaatttaaacaatctactcagaattaaaacttgccattccaagtggaattcttacatgctccatctatatacctgaaaccccatcacagtgttctacattttcgttgaagtgtcatttatgtacatgaaagagtctaccaggagaaaaacagcctggtctagcctgttacatttacccggatatccgccctttctgtttctctcctctgtccagtgtttcctgagcaccaactacgtccaggtggcccgacaggcactggagacacagtggacacaaagctgagaggccctggcttgtgtggggctgacatcccagtgggaaagacaagcgttgatcgggtgaggatataaaaatgcaagcttgtgatgcatgggtaaactgaggctcacggagatgactcagccccttgtgagtacatcccacactctgggacagagcgctcattctgtatcactgcgctggggacagggacagagcggttcagaaggacagaccccgccctggccctcctggagcccactccacaccccagcaagcatcaggcctagaagttggcacctccccgccaccacggttctccctgcactgctctgcccccgcctccacagtctcacggtaagatggtggatgcaaacgtgctttgaaagatgcaaagcacagtggctcatacctgtaatcccagcactttaggaggccaaggcaggcagatcacccgaggtcaagagttcgagaccagcctggccaacatgctgaaaccccgtctctactcaaaatacaaaaattagccaggcatggtggcaggcacctgtaatcccagctactcaggaagctgaagagggagaatcgcttgaacccaggaggcagagtttgcagtgaactgagattgccccactgcactccagcctgggcaacagagtgaaaccctgtctcaaaaaaaaaaaaagaaagaaaagaaaagaaagagcaaagtaggagtcaggtaacccacggaggcctccaggaccctgcactccagccctgtgtgctggttactcaggacacaccctcttccctgctgtccagagcacttggccttatgtgggaaaaggatgcatttgtgaccgctgggtcacaaagtaccacaactggcacttctgcttaagacaatggaaagtgtcctctcacagccctggagcacagaaggctgaaatccaggtgtcggcagggccggatcctctcgtggaacctctgagggagaagccgccccatgccccgctccagctgctggcgtggccacgatgcttggtgatctttgaccagaagacacctcactcccatccccttgggtgtctctgtgcctcttcttcttataaggacaacagtccttgggtttagggcctgccctactccaagatgaccttatattaatgacatctggacagactcattttcaaataaggtcatattcacagatacatagatttaggacttgggcgtcatttgggggaacacagctggccctctacatgccctgaaatgatgaggggggctgcttcacttgctccccatctgcctggattcatgcctctggacacctgccccagaccaagccatcagccacgctggtacatgccctagtggctcccgcctcagtgctgcccgttgtctcctcttgcccctgtgagatttccccagggatgttgcttggtcaggccactgtcatcacgtgggcctcagctgaagtgtcaccccctaacagacatgtgcagggtgccctgcgctcccctctccctccaggtcaccctggctcatcaccgtcttcctccgtctctgaaattcttatctatttgctggatgacctgattttttttctgagctcctcccaccccagtagaaggtaagtttcatgaaaacaaaaataaccttggacttgctcctcgttttactccaagcatctggcatggtacctggctatccttctgtctattctagtagattcctttgagggtgtatatcaatgaaattgctcacggtattagcaattcttgatcactaacctctccagcaccagccactatgttagatcactgggcacattctatgctttgaacccttacatctagaaaggtactttatggccactttaaagatgagagaacaccccggttctcagaaattagttagcttgatcacacgtaaacaactagttaatcatcaaattcaaatttgaactcagactggtctaactaaaagcccaaagtctttgaattaggtcatgctactgagatcaacgggaacgtccccctagggtgggtgatgattctgccgctgactcattggacctaaactgtaaagcattgtggaccacggcagagagtacgtccgtgcctgtagccatgtgatacggtttggctgtgccccacccaaatctcatcttgaatagtaactccagtaattcccatgtcttgtgggagggacctggtgggagataattggatcatgggggcggtgtcccccacactgttctgtggtagttaataaatctcacaagatctgaaggttttatcagtggaaacccctttctcttgattctcattcccttctcttctcttgcctgctcccacgtgacacatgactttcacctaccaccatgattgtgaggcctccccagccacatagaatggtgagtccattaaacctctttcctgtataaattacccagtctcgagtatgtctttattagcagcatgaaaaaggactaaaccaccatctcactgtcctcactccggtctcagcagccctgctgagcagctctggggtagaggaggctgcgaggggtgaggctccatccacttcctgcaggagggatgcttctgtccacgggagaccagcacacagtgatacctcatgaaaggccacgttcccatcaccctgagcccccttctatgtcgggcccccagcagctatggcgctgggcaggcccgctccccagaaagtgaccacatgatggtttcctgcctgtgatggcctccttcaggcacacctttctctcacctgcaggccacccagaggagccaaggaggaccgcacacttctctgcacactgggactgctgtcctctccctgaggagtgggaccctcaagttgttctgcccaggccatcagaccatgactgccccgatgtcactgagcagagtacagagagactgggatgtgtatacactgggggcttaaaacaacagcaacccatcctctcatgccctggaggccggaagtcttcagtcgaggtgtggacagggccatgtaccctccgaaagctccagggcaggctcttccccatcttgccaggctcctgggcgctccatggctctgatctctgcctccatccacacgtggcttcctccctgagcgtctgtgtctctatccaaactcccctctcctttctttccaaagcctgtcactgaacgagggccctccctgatgtgcgaccgcaccttcacctagttacatctccaaacacactatttccaaattaggccccgcgccccagttctgggtggacatgactgtggggaggctgattgaatctacccctctgtccagaagcttctcacctgccttctgctccctgggctccgtaatcactgattctgctcacagcctctggtgggtccaccagtccctgcctctaactgcttctagattgagctctctgaatctagaaaccttgtgagtgtgaagttaaaccgtccttccctgccaggactctaaaataaaagcagctgtcgctctaccgcatccgacgaacagaactgtctcacgggccatgggagaaggggctggagagatgcgttctggccgtggctgtgagcgaagcaccaccggttgcagtccctttacccaggagctggggagaggctgaggacccagaatgtcttgtgtatcaggcagtagaaactcacatgaaaaacacatgaggctttttttgttttgtttttttgcagtgagtaaaaaagcccaatgcgttttttatttgaatctgagaagctggagaataaaaagcattttgtttattttatcacaatgcactcacttctgacaggcaccctgcttcagaggagtgctgggtgttttgatcagactcctgtgccaggacctaagaggaggactgactctgggttaaatgcaacaaggagtgcgcggtggggagatccttgtctgacaccagcctgggctgaggagatgccggaaatcaccaactctcctgtgtttattccccttggagagtctctgtctattccagaaaggaactgcagattgatctgtagatgtgactttatacagtcacctgtgagccccagagaagcacctctgcagagaagcaccctgactccaggcctcctgctgctcggtcattctccatgaaggcagcactgactccaggcctccggctgccccgtcattctccatgaaggcagcactgactccaggcctccggctgcccagtcattctccatgaaggcagcactgactccaggcctctggctgcttagtcattctccatgaaggcagcaagtgtctgcagtgccggtcggttcagcgaggcaatctgtcaacccctcactcattcatgcgtgcacttgctccgttactaattcatcaatcaatcagtatttatcgagtgtctactatatgccagattttgtgctgggcactagaacaaaggctgtcttgaggatgttacattttggtagggaagacaaatacacaggcagacagttaaagcagacaagatgagtgcgctgaagaaatggaacccagtgatgtgcaagtgaccagcaagggggcctctggtcctttagaccaggtggccacgaaagcaacatgaaactgagacccaataagccaggaatcagaaatacaaagtgctgagggaaacagcattcaaaaaaaaaaaaaaaaaacactcagtgcaggaaatccgagctagcctgtggagaggccacatgaggagagaaatgtctggcctgccccctctcttccagccatcccaggagaggacaacatgcaggcaaagagccagccaaggctgcagatgattgcaacttcagttgccatctgagcgtaactacccaagtggaggccccacgtgagaaccatgtagctgcccagtcaacccacacagccatgagacatcaacacaaatcactaatctcagccactcaattttggggttgcattagtccattctcacactgctataaagacatacctaaaactgagtaatttgtgaagaaaagaggtttaactgactcacagttcctcaagctgtacaggaggcatggctggggaaacctcaggaaacttacaattacagtggaaggcaaaggaaacgcaggcacatcttcacatggcaacaggaaagagcatgaagcaggaggggctacacacttttaaaccaacagatcttgtgagaactcactcaccatcacaacagcaagggagaaatctgcccccatgatccaatcatctcccaccaggtctcttccccaacattgagaactacaattcaacatgagatttgggtggggacatagagccaaaccatatcagggtgctttgtgatacagcaatagctaacttgtatacctctgtgcggtctccctgcatctcctcttgcgtactacgtctctacagagttgcagatataattccttaaaaattcaggttagatcacatcattctactgttgaaaaccctctaatggcttcccatctcgctcaggaaggaaagagccaaagtccttatcttggccttcaaaagctttaagtgatctgctccaagtcatctccctcatctgacctcatcttctaactatttccccgtgttcattctactcctgcacctcgggcttccacacacttctcagacacagcaggcattcaccctctgccccaggacctttgcacctctgcacagctccctccctggcttcatccaggtctcttttcaaaggactcacccacagtgaggtctccccaaccactaaatgtaaaccagctcttccatgactatcactcttcgcctcttttcacttccccacctgacctgcacattaatttatcaactctctaccagaaccaagggcatggatttagatcactttttccagaaactagaaagcgtttgatgcaaagtggttgctcaatatttttgaatgaatatatctttaggtgtgggttcaattagatttctttatttttaacttttattttaggttcaggggcacatgtgcaagtttgttatataggttttaatcagggcaaggactgtaggctttgaaattcttcaggaagccagtgcctgaggtaaacaaatccatttccctttaaaatctgtatatctggacatactcttctgactcttcaagtgaaaattacttggcagcccccataatacggtcaaaaagggctctgtaaagaaccatgtgggctggatgcagtggctcatacttgtaatcccagcactttgggaggctaagacaggcagatcacaaggtcaggagttcgagaccagcctgaccaacacggggaaaccccatctctactaaaaatacaaaaattagctgggcgtggtggcaggcccctgtaatcccagctactcaggaagctgaggcaggagtatcgcttgaacctggcaggcggaggttgcagtgagcccagatcacgccactgcactccagcctgggtgactgagcgagactccttctcaaagaaaaaacaaacaacaaaaaataaataaataagccatgtgttgctgtgcataaccaatcacaggctgcagggaagcagggcacgttgtctttagctaaattgaatgatcactattaagacaggcggcacatcagtgatatttggaaacaaaaaagccagcatatgaatgtgaccagtgggctaattttcagttcagacaggccctgaatgcacattggcacagctccacagctgtaactacccccgttaacacaggacgggcagtcttaattcacaggccgcatgtcccctcttacccctcagtcactttaggacatggaagacacaagacgcgtcaggtgctagatgagaacggtggccacaggatttgggaacaaaggccgtggtgatggctgcctgagcttcatgctttaacccaagtgagccgcttctatcactctaccacacgcgtcatctaataatggaacaacatgggtttcttgaggatcagcagggaggtccgtagagtgggaacccggagctctcccacccgagcatccaggggtcacgacacactccatctcccacacgtggtgacgccctgaccctgaaccgcacatccccaggcttccctgtcacagcagatgacaccattgctgccccagaaattaacgtcctgactccttcctgcctctcacactccacgtccagtctatcagcaaaccctgttgattccaccttgaagacacaccccgagcctgtgcacttctccccaccctgccttgctggaagcccccatcatctcgcatcaggacatggctcccagtggggtccctgcttccactcctgttttttttctgtgcggccactggagtgaccctctacaaaccaaagccagatgcacctcctctctcaattccagtggcatctgacataaactgattgaaaactatgccacagtcactccctgcatctgaggtaggagggtaagagatgggggttggactctggaccacacagcactagctaaattaggtcccaggtagaagcaccttcccatgagacgcaccgcagtgccatgtcagtttaccattgccatggcaacgtccagaagttatcgcccctttccatgtcagtgacccagccatccagaagttaccaccattttccaataattttctgcataacctgccccttaatttgcatgtaattaaaacctggtttaaatacgacttcggagctgcctttgagccacaactctaggcgcacagcctgtgaggtagccttgctctgcaaggagcaggacctctgctgctgctatgcacagacacttcagtaaaagcagctaaccccaccagcttgcccttgaattcttccctgggcaaagccaagaaccctcccatcctaagccctgatttgggggctccctgccccgcaccacatctacattcttgctgacgtaatttcttggctcctcatagctggagacagagtcagcttccccatcccctcaaaccaggcagactctgagccttgctttggccaacggaattcgagaagtgccttgccccattcaagcctgggccttatgaggtcttccatgcctctgcctcattcacggcccaactgtaccctggccagaagccctgtcttgcctgatggaggaggggagagcaaggagcaaggcagtcaccccagcccaaccaaccaagaccctccagtggccacccaggtgcatgaagccccggctggaccggaggagctgttcagtccagtccggtcaagctgagaagctccatgcagccaatcagaggtttgggagcaatgatggactgtgaccgcttcaagccccaggcttcgggacggtttgttatgcagtcttattgggacgggggtaatacatacagttctacagttcttggaattctaccttggcctgtaagactctggccaatttattcccaatccgggtttcattttttacttccctgcccctccccattcactgtccggcccactttcttctccttggacatgtcaagcatccatacatcccaggccctctgcactccccctgcctggaatgctcctccctgaacactgacagggctgcttcctccctctgctcaacatgtaggtctagggaagcctcctggaccactcttttaaagtgccaccatcagcaggaactgatttcctcctcgtttacccaatttatttttctgcaaagcacttatcactgcctgacagtgtatcacacgcatttgactttttcttcatcgggcagttgaatgttgaggtctattttgctaactgctatacccctggtgcctgcaacagtgcctggtacatagtgctcaatcaatccttgtgaatgaatgaacagtcatgcaataagcagctcatggcccagggatgccacgtgtgtctcactatatagatccctgtttaggtgcaccgatgtacccctttcccttggtagggatggaggggacagggaaattccccaaaagacagggtggacttgcaggcggagtctagttagaccaccccacttggttcagactccagtgcttttccatctcttggtattttaaattccatagaccaggaatgaagggctccagaatactacattttctcttgtacaagtcccatcaaaaagaacacagctgggcatggtggctcatgcctgtaatcctagcactttgggaggccaaggtgaatggatcacttaaagtcaggagttcaaaaccagccaacatcgcaaaaccctgtctccactaaaaatacaaaaaaaaaaaatattatccgggtgtggtggtgtgtgtctgtaatcccagctactcgggaggctaaggcaggagaatctcttgaacccgggaagtggaggttgcagtgagttgagatcatgccactccactccagcctgggtgacagagtaagactccatctaaaaagaaaaaacaaaaaacaaaaaaaacaccaaagaactcttcttgagttcttcccatatatggggcaatccagccttagcgttcctccccaatcctccttgctaacgatgcaaaaaaggcttgaaaactccatatgccattaggctcttcttctccaaaggaagagacttggaaaaattgctcctccattgctatgaaaatgttcctgacaaccatttcttctgtatttttctgcatcctctaacataacattccgagtaagaaaaccatgtccagcacgccatgctttgttttgctggggaagcagtgagctcccttccccgaaggagtgagaattatgcaattgttcatattttcttttctgtccagcctccctggaaactcggagccaaatgagaatcttggagtaactatgttcagcctctgaggtggtatatcttagttctttcttctctttatgcaaacattccacttccttcatatcacttcattatatttaatgattttggtaattaggccatatgcttggaaagaagcataataaaaacacattcacagataatgaagtcatcaattatcattttttaagtaagaaaatcaggagggactcaaatcaggttaaatatcactgtgtgatccatgctgggagcaggggggggtgtctagtcagtttcagtattgttctcccatgattgttttaggaaacattcagccccaatttcagtcttttctatttcactgaaagcttttatatttggaaggaaaactacatcccgttcacaattcagtaaaacccagtggtgggtgtgatttggtggcccggtcaccaggctcttcaccaggctggcacttcagtgtctttgttctgtgcaggcaaaggggaggggctgtgagccggccctcaggcacacttagctgggaatcctgcaccccctgactcctcccaggatgggtctctgatcccagtagaatcctcttcagctctcagcaaatcaggttgattgaaactctgttgaggttccaattccactcacatcactgacaacaaaagaaaaaatgccaccaactcaaagggtgtgaggtcagaaaggagggaagatgctgcatcgccggctttgaaggtggagcgcgaggccctgagcagcccttgcagctggaaaggcaaggaatgaattctccccaaagctcagaaaggcacgcagtcctgccaacaccagatcgtagccctgtgaggctcatctcagacttctgacccccagaactgtaagagaatatgactacgtcgctttaagccaccgagacactgtgggatcacttgctacagcagcgataagaaacagacacacggtttctgagctcagtaccactgacacgtgggaccaggtgataatctgctgtaggagactgatctgcacggatctgcgcgtgggagagggttttacatccctggcctccccttccccagtcatatcaatcaaacgtgtcctcagacattgccaaatatcccctggagggcaagttggcctcactgagaaccatctttcatggctttttaatccaacagactctccgctaagctccttcctcccagggattcacggcacaccctccattaaattcactaagccctgaacctgtgtcccaggcactaaaggcagagggttggataagtcacggtgtgtgccctcagaaaactcacagtcatcgaggcagctgcttaaagaattatgtggtagcacctcctctcttgagggttacatcctgaaaacttagagcacacagtgagaagcaggatggtgagcttgctgagaaccgcaggaccagcttggttcacattcagggccggtagtcagagaatagggcatctttctttgctaatcgagatggcatcattcttttctaattgagatggaatccacatgccatgaaggtcaccattttagtgtgcagtgccccatggttttggcactttcacaaagttctgcagccatcattaccatctaactcaagaacattttcatcactccaaaaagaacctcataccccttagtggtcactcctcatccccatcccccccatcccccaccccctccactccccccaccaccatccctggaggggtcactcctcatccccaccccccaccccctccactccccccaccactatccctggaggggtcactcctcatccccaacccccactccctccactccccaccatcatccctggaggggtcactcatccccatcccccaccccctccactcccctcccactatccctggaggggtcactcctcgcccccatcccccacccactccgctccccccaccactatccctggaggggtcactcctcatccccaccccccaccccctccactccccccaccaccatccctggaggggtcactcctcatccccaccccccacccccagcacccccccatcatccctggcaactatccagaggctcccctcagagctccaaacgcttccccaaagaggctacagatggaggtaaaatcacttcttgatttaaagagtatttgcggatgcagcctaatcctgttttctgcaattgtgaaatgcaaatgaccctggtaatatatgtactggatcatagaactggagatgattatttttttatttttgtaaaaaaatgttttccagaatgataatccaatcaaattttaacacttggtgaaaaaattcattcagcttaactcagtggcatcaatagcaaatcaacccactggctaaatattgaaggagagctcagctcatcaggaatgcatgaggaacatccagttacctgtaccccctgatagagcaaggttctggtttagctatcctctttataacaaaggtcattaaacgtctgaggagcagcttaaaattcctgaagtttgaaacccactgtagccacctctggtctttaacgtaggcagactccatttccattcaggagcggtgtgcctgccactgcacagctcagctgtgtttaacatcctaaaaaatggaaatgcataattggctttacgggattgcttccagaaacactggaattttgttatttattgctttttataccacaaaaaggggaaaaacagccccaacatctctgaatgtggatgatggcttccaaaggagctttacataccttctgctcggggtcctgcagcccctccttcctcacaccgacctcacaaagagcagaagcggtcccaaatgcagaaagccagcttaccttcaggacctgttctaggttctccagcttggcttggagctggtgtttctccttcacggccaaatcgcgctctctggtcacgagggtgagcggatggttgagatgcacatactctgccttcacctgcaagcggaagggatggagacaaggaggttatcacaacatgcctaagagttggtatccgttgcttcctctttaggagcaaaatcttcaatttcctcctagagaatccttccctccctccttctccatcatggactgggtccactcctactaggggtcactacacatgaccaagggctggccaatcagcagacgacctccatcttcctccctcccacctccaccacagcctcagtgattggttcagggttgcaaatgtgtcacaggtctggccaatcagtgtaatctcatcccctggatgtggtgattggttggggaagtcacatgacccagttgcattctgggggaatgagatcttgcacttgtataggaacccggaagaactctcccttttgcccactggactcggaaagttaaagacaaacagctggaactactgtggcctttgccatcacgagggaagaacccatctgagaacagagccaatgagataaacacagagagatgcagagggaaaagcaggatccccatggcatcatttgagcacccaaatcaagctgagcctgaagctaattgtcttttccttttcagtcacttggaccaatagattctccttgtttgcttacaccaatttgaatcgtctgtcccctgtaactatgagagccctaacagatacaagtgttttcccactgtctaagcatatttattcttgtctaaaaattttatctcatcttaaaagtgaataaaaatgccaatgaaattccacatgaactagaatgcattcccccaataaacccaaaaaccacataaattccattctcaggccacaacccccagggccaagctacaagcttattgggaaggcaagcgccatgttcagtctctctcctcttcgaaacaagtaaggggatgctgtcaacgaaagaagtcaccatggttcctttcccattcattttcattgtggaggcaacatgttttaacccaacggcagccttgtaatttcttttcctcctcctcaagtgttatgatgtgaattatggcttcaataacagactaacataatgtcacgcttttcagctgcagaagtcctttctatttcaaatacattctgtactgagtgttagtttaacctgacaacttctggggcaccaaaagaaagggaggcacccacttggcattcccaaatgggaacagggttacaggaaagctgttattaagaggtcgtagagaggtctcattcgaaggaatattttaatgccattttgctgcaacgtgatgttatcaggcaacgaacttagagaaataatccaaatgcccccggagaaaatgtcacgacctatttgaattaaaccaccctcacttctgaacctcaataccctggggtgcaggtttgcagaaagcatcacttcttgcatcctagctgttcaagaacattaggacttgggggtcatgcttgaatgcccctaaattcagtctcacacggtgaccagcaccatctttctgaaatacctgccagatcttgcctctccctgcttgaaaccttctgtggtttccacagaaattagaataaaatccaaactccttggtggtctaaaagtcctacccacctgctaccctgttgccactatgctggggacaccctggcctccttctgtcccttaaacaggtcaagcttcttcccaccccggggcccctgcacctgctgattccattgcctgcagatctctacccggccctgccccagtctgctcaggtctggctccttctcattaggtgtcacctcagacaggccttcccaacccttgcaaggtgacgaaacccttgccttcaccccctgcctccatgcccctccctcccacaccaccatgctttggtgtccacgtgtgctcagcactgtcctctgcggctgtttgccttcttcctgtggctgctcctcattggaacagaagtgtcaccagacagaagttttcttctgccttgcaatttcccatcatcagcgcccagaggaccgcctggcagggagtcagtggtcgagcaagatttttgtactgaatggaatggtgttgaggaaatttccaagagtggaaaggtggccctggctcctgggtggactattgctgtcagccctcccagacacaggccccactgtcatcaatccccctttgtgtcctgagaggctcatcctcatggcctgcaccccccgtaccatccggcttctaatcaggcttgcccagtggaagacatgatcaagaaatgatggatcagcatgacccccggcccccggccctccccaccagcctgcagggattaccctgagctgctccccttagaaaggctgctggcgagcctggcccttggctggaggcctgggaagcaggatttggggagaattcctaccttccctaattgattagggcggcttaccacatctaggccacttgaacaggacagtttatgctgaacacctttccttctgggagtcggaatttcagtatgtgccggacagagagtgcccatgccaccaggtccccataaaaactctggctgctgaggctttaatgggcttccctgacagatgacatttcacacacatcacagcttgcagctgcaggtcctctaagcatcctgtgtgattcttgggaatcctcttgggagacgacctggagagcctgtacctggtctaccccggcttcattctgtgtgcctctccctttgccacctgtgctatgtgtccttttgctgtaataagtcacagccctaagggcagctgcacactgagccctgcgagtcctcccactgggtggtggaactggggtaacccccaacagtgtccttctacagggagggcctctcccacacccttctccctgtacccatagcaggtggccatggcccccggcctctgctggtctcagactcccaacctcctttgcaggtgtcctgcccatgccctctgcccccccgccccggcaacagcacccacacctttgttagtactttcttttctaaactctgctccatcctccagtttgcaagtgctgtgtatttgctattgtgaccctgatgggtaaaatctccaaaggaaaaaacattagcagcccagaagcaccatgatggctcagaggctccctacataaggagtttctagtttggggaggaatcgattcagattcgtgtttcacagagaagccaacttgggtttcaggctccatgtgcagaacccagcatgaagatgcatttattatccagctttttataagagcactggacagtcaggaattgccttctaagggtcagcatccagtgctttggtcaagaacagacaacctccaacctgcggacaggctgccgttccagtgtgaacctggaaagaaatcaccgggcaccggaacgcattctcccacaggtgtgttacaaacggcgccagaagctagagtccagctggcccctaaatcctatttgtcccacagtagagctagaagggagctaaatttaatacggtagagtggaaacactgtgtttctgcagtggacaatatggtggcaattgcagtgacttaaggcaataatgttgggggaacgaatgggtgtgttgacctcgaggtgatgctcataagcaaagtaaaaggaaagatcttggaggaaggtgaagagtccagacagagtccatggaggacctcggggcaagccaatgacatttactctttctttttttttgagatggagtctcgctctgtcacccaggctggagtgcagtgatgcaatctcggctcactgcaacctccacctcctgagttcaagggattctcatgcctcagcctcccaagtagctggggttacaggtgcacaccaccatgcctggctaatttttgcattttaaggagagacaaggttttgtcatgttggccaggctggtcttgaactcctgacctcaagtgatctgcccacttcggcctcccgaagtgctggaattacagatgtgaaccacctcacccggctgatatttactctttcatggacctcgtctcatgccacaattatggttttgcatttctttgacttaaaattccccatagtgtcatctttttgtttaccagaatgatgaaggccatggctctggttcgcaacaaggaggagagggtgtgtggacaaggagggggagggagaaccgaaaagactgatttcctggatgtataatggctgaataacggccccacacaaagatgtccacatccaaattcctaaagtctgtgaatatatcactttttgtggcagaacggaccctgaagatgggattgcatggagcatcctgagagtgggagagcaccggggttatccagatgggctctacgtagtcacagagcccttatcaggaaaagcagagtcagagacaaaaaagagagagcttaggtgatgctctgctgccagctttgaagatcagggaaggaagccaaaaaaaggcaagaggagagactgtcccccagagcctcaggaaagcacaccggcctgctgacatcttgactttaggactgaagacctccagagcggtgagacacggtggtgtgtgtgcttgtaggaatttgtcacagcagcaataggcaactgatgcggaaatcagctaaacagcagtcctcgttaccgcgagcacgcgtcgaattgtcactctacaccaacaactggcatctgtccctggaaagccctaagccccagtgagctgggtcccacccctccctattcccccaagtcaaggtttgtcacttcctctactggtacagcccccagggcttcagtcaccccagtggctcccctaaccctgcctgcacctccttaagaatgcttagcaaccctcaattgcttttggagtatgcgccatctctctcctgctgggaccagactgagaccgtctgtgacacggttctgatgagcctggagcagaaatctctagaggacaatgacctttcatgaaacagagcttcgtgagaaaagcttcagcccctcttcctcccaccacagtggggatgcgacccttcgagatggaataccacctgtctcggtgtcaaggaagccaccctccacacacgtctctgctggacaggagcccctgggccctggctccttctccaggcagctgcctctggccagggtcaccacctctgggcttcctgagcacaacagtgcccttcgtatgaaacccaccaagctcaggcttctgtgaggggcagctggaaataaccccagctgataaacctggagaagggggcgttctctaattcagcagccgctgatcccacctggatagaggactgatgccactaaattaaaacacgataaatattggctcccacgggccactcaaatgctggcgcctggggccggtagcccagaagacagcctggcagtttcttctctgcctggttgggctttgcagcccagctcgtgccagggagtcttggtggatgggtccttggttgacaaatgccctggcctctggctgagcacaatataggggtgctgggatccccgctgcatcaaggtctctgcctcaaagtccattgctttcttttttttttcttgagagagcctcactctgtcgcccaggctggagtgcagtggcatgatcttggctcactgcaaccttcacctcctgggttcaagtgatgattatgccttagcctcccaagtagctgggattacaggtgcactccaccatgcccagccaatttttgtatttttagtagagacagggtttctccatgttggccaggctggtgccaaactcctgacctcaggtgatccacccgccttggcctcccaaagtgctgggattacaggcgtgagccaccgcacccggcctgggtccctgtcccattgctcctggactagaacagtctcctggatgttctcaagggccaaatcagtctcctactaaaggagaaagtggactcagagtgacaaagatgactcagagattttcactaagacacacaaccaaagaaaaaacatcccagatgttccaggttaggagcccagacgattcttcctttgtcctgatgaaatgcaagatgaacaacagttccctcttatgcgattttttttagagaataatattcagctgcaaccctgggctggacactcacctttcagtcaaaaactaagcctcacgaatcccaaatgtctatgtgtgtcatccttttaaactttcataatttttttactaggaaaaaaaatgtttaaagagggaaattgctagtaagttgcatggttgccatctcataccagtgtttcctagctgtgcctatacttctacaaccttttgggtttctggccagcaggtaagaggattccctaggttgtaggaaattctgacccatgctacagcatgtgctcatgggtcatgaacttaatgacctactagtgcccagctccagaatgtcaggtactaacagggtttgagtgattctccaagacctgctcaccacacacaaacacaacagcacattagcaaccctgggcatcagatccagacactggactggattttattctctaaaaaaatctcataagagtgaactgttcttcacttagatccagacactggactcatttctgtttcaaaatagattcttgtggcagcaacggtggcaccaggtggaagagaagcttggaatatttggcatcagctactcaatgtgacgaaaaccttgaacctcagacctgctacaggaacagtggcccagtgcggggaggagggagctttaacaggcacctcctaacccaaacagagaagaaatttgaattatttttctgaaatcaacaaaaggttagttttgcagcttcaaaggcatcaagcatattctttgcactatgtcttggatcccagctcatcggtttcctcccacaaggctgcctgcctaagagaatccaattcaacactccagacagcccaacatcacagtttgcacctaagaaccaatcatttccgcacagggaaaaatgctgacactgcagtctctttgcattcataattaagagctctgagaattaatttccatctcttaatcagtgctactgaaaagcattttgcaattccaagcaagaatcagataggggaattgctgatccccaagtgtctccagggatccagaaggacactgttgtttctgcaggtttgcattgacaagcctacccatgagtctggagggacagttgaatacttccatcagcacaaagtcacccccacaccttcagcctccccagctaccacaaagatgctcagcccaagagacagtctctggggactgccactccctcaatgcctcccatgcaggtagccagcccaggcacttggaaggaaagccaagctccgcaaagcaggctgcaggacagatctggggtgcccctgctgcctctctcaaagcactgctattcctgtccatgccgggtgagctgctgggctccctcagacacccataagaagcagaagcaaaggccagctcatttcctgtgccttgcagccttgtttaaaaggccaagctgagaagacagcagggggagaaattcaaacctcaagcaaacaaacaaagtggtttgaatcctgcgggagcagggatgtcaagctgcactaccagccatccaggaaaggaggcctttgcctctgttgtgagggctgagcgctgggacccccacctccgccggcccttgctggcctggtcaatgcctgcagggctcagctccagcacccccatccccccacagctggcattgcctctccaggtgcaggagcccagctcaggagtggaacgtgtacacatgcagctattttagtcgtaggaagaaagccatcccaggatccgacctccctgtgcccagctccccaccagccctgtcgtcagcctgcgctggaggcctgaagcacccccatcttttttatatttttcctcctatttgaagaaaaatactcctgtcctaagaaagtcactaagccttatgatgcattcagacctcagtgtgagtgagtttagcagagcctttcctgcaagtgtaggtttggaaagtgggggctggtggaaaaatggggaaagcatactaattggagggtcaggatatattaagacactttttttttgagacagagtcttgctctgtcgcccaggctggagtgcagtggcgtgatctccgctcactgcaagctctgcctcccgggttcatgccattctcctgcctcagcctccagagtagctgggactacaggcaccggccaccacgcccggctaattttttgtatttttagtagagacggggtttcaccgtgttagccaggatggtctcaatctcctgacctcgtgatccgcccgcctcggcctcccaaagtgctgggattacaggagagagtcactgtgcccagcctaaaacacacctttttaagaaaaattatgataaaatacacattacataaaatttaccatcttaactattttacatgtaggtatttcagtggcattaaggacattcgcactgttttacaactgtcactaccacccatctctagaactctcttcctcttccccaactgaaactctgtcttcattaaacagcatctccctatcccccctctacccagcccctggcacctccattctactgtttgtctctatggctctgatgactctaggaacctcatataagtggaatcaaacagtgtttgccctttgggactggcttattcacttagcaaaatgtccccaaggttcatccatgcagtagcgtgtgtcagagtttccttccttttcaagggtcagtaatattccattggacacatatgtcacatgttgtttattcactcgtccatcagtggaaatgtgggttatttccaccttttggctactataaatttgtaacatgtacatatatctatttgagaccctccttttcaattttttttttcttgagactgagttttgctctgttgcccaggctggagtgcaatggcatgatctcggctcactgcaacctcaacctcccaggttcaagcgattctcctgcctcagcctcccaagtagctgggattccaggcgtgcaccaccacacctagctaatttttgtatttttagtagagatggggttttgccatgttagccaggctggtctccaacttctgacctcaggtgatccactcacctcagcctctcaaagggctgggattacaggtgtgagccaccacacgtgactgccttttcaattcttataccaggattgggattgctagatcatatgcaattttatttttaattttttgagcaaattccatactgttttctatagtggttgcaccattttacattcccagcaacaatgtgcaggattccagtttccctacatcctcatcaacacttgtaatttcctaaaaaacatacctttaaaaaatggccagacaggaaggcaagaaaataagtgtcaaatcaagacaactctaatttttatatttaatcactagagctcagttattccttgaaatatgcatgggcaaagctgcaaaattaacagcttaaaacaacccatcattcaatagatgttgactgagcacccgctatgcatcctttgaaggtacaggagagacagtcatggatgtaacagcaaagctctctgcaatcccaagcccacattctcgtaggagacagacaaacacataagtgaagacccgtgatagactaagatagcaagaaaagatacaaagaacatgaaaacaggtgttgtcacatagagaaaaaagggatggagggagggctgttagagtggacgttagagccacgaatccttaccaggagggacgcgtaacctgagggttgaaaggcaagaagctcccagctgttgaagatgatggagtggagtgttctaagcagagacaaccatcaaatgctgagacaagcttagggatccaaggaacaaaagtaagtcagaggtggacgagaggtagcaagatggacaggatggcagccacagggagaagcctcagttttatttatggaaggcattggaagggtcagaggattgcatgatccagagggcatcacaagatcactccagttgccatagggaaaagaccacaggatgacaagggagctagacaggccagttaggaaatggctttggcatctgggaaagagaagatgaccacagtggagaggagggggaggagagctggggcacgtctggtgctgagatgagtggttggtgcgctccatggtttgaatgcatcccccaaattccatgtgtgggaaacttaatcctcaacagggcagtactgagaggtggggcctttaagaggtgactgaatcatgagcactctgccctcatgaatggataggtccattcatggattaatggatcaatgtgttaatggaccagtgggttatcaggggagtggaactgctggcttaataagaagaggaagagagccctgagctggtatgtgagcacactcagtccccttgccgcggggcaccctataccaccttgggaccctacagagtcctcatcagcaagaaggtcctcaccagatgcagcccctcaaccttagattctcagcctccatagcttaagaaatagattccttttctttataaagtaccaagtttcaggtattctgttataagcaacagaaaacagacttgagcagggagttagattcggatgaagaaagagcagcgcccaggaggccccatcatggaggctcaggcaaccaggagtggccacaccattcactggggagaaagtggtttgggagagtgggcaccaatgggtttgttctgccttgctgttaaagatacaggtgcctaatagacttccaagcagagataaccagcagatagtggatgagacatcactgggtgcctcacgtgctggtcatgtgaagaagtgagagagacctggctcagcctctcaggccaccttcacactgatgttcagtgattcttccctgccccttcccagttgttcctccctggcccagcccgctccctccagggccccagatggtctgtggacagtggtatcagctaccttgtcatgctgccgggcccttgtgggaaggcctgcatgatgggatctcaggagatactctccctgggtggcatccttcagttcattttcctaggacaaaaggaaaggacatgtgagatggtgcccccatgtttagagacttggtagagtgcagtggttaggagctccaatgtggtaatgagacccaaggttgggcactgattctgcaatccataagctgtgtatgagttgggactgatttctctcttttttccaaaccataagtttccaaatctacaaaaggcaatcatgttatattatacgatgattagaatataatacaataatacatattaatcacttagtgtctgtgtcctaaaaaagcaacggaacttctcgccaattggagttgttaataagctttgacccatcctttttcccgtgaacactgctccaaacatacagccacaataaacaatagacagagaaagtttagaaatatttagccactcaaaaataagataaagcattctaaggactaaatggctagaccacaatgtggtgagcggaacttctggaaccttctagattcagagtccaaaaataggcagggagaattaagagtccagctttttcaagatatccaagattcaatgtattccacataagacaagagacatgaactaaggtcaccacatgacctgaggcaacagttaagcccccaaagaaagctgaaaataatccatcacctccacctagagccagagcttttatggggtcatgcacctagagaggcaagagggagaaaactcatttttaggctcagttttaggacttgtcttactctctactatcaccatggcacaggaactcggagctgccaataataaaatctaattcaagactgagatcacctagggtgtggtacagtaactacaaataagtaagacagggagagtgagcacagagatgggattaagaatctctcattcaagatgagtctgaaaagagaaattccagaacacataaagagaactaaccctactaaagagatctcataaacttaataatcaggataaatttactccagaggaaataaaaataataaagcaacctgaaaaggacttcaataagtttagaatcctaaaagaaggaatggcatccattccaaaaggaagagaagcagaagggataatcaatgactcacagtggaaggcagctggaaccacaccagctaccagctgtcaggctgagaacttctctttttcccaattgttcaagtttgttctctgttcacaccctaaataaattaatactggtgggacacccacatcttgaattgatctggttcatctctgttacaatatttcgagtgctcagagtctaggctccattcacacatcagaaaagcagcaagaaatcacgtggtttcaacacttcccactaggagagaggctcctcctggccattttcagcttccatttttcagtcaaccttccttttttcttagccacagtcataatgagctccgctactctgtggtagctacattttcacagcaataaaacacagcgaaggaacccaaacataaaagacggtggtgctttgttccgggaaacaatgattacccaaccttagggaaagtgattgataatggagcaattcccttctgtcttctgagatggtctggatggcataacatttattgttgcctttctcaagtaaagcagatcataatgtagtcccacactggttgcttgagagaactgcagcctcttcagcatgtcccacatgggggaatccctggaggtcttaaggggatgggatgggtgtactaatcaaaatacctggctgctgacctcagagaccaacatgccccaaggtaaactaaggcagcaatagctcagagaatttgagaacaagagacatttgaaataggggttagattatgggttctgaggtcaaattgcctaaatacaaatgggagctctccttaaatgtgaccttggacaagctgcctggcctctctgcactctctgtgacttaaggaggtaaaagctgcaaccctagcagatgttgtgaggattcaaggacatcaatctcacggaacacagagcacatcttactgcacagggtcaaggctcaaacaagtggccccttccctcctgaaggcattgcaatgactgcctgcctcttccacgttctgccaccacacagccacctggttcatgccatccgcctctctctgcatcgcatttaggaagagtgaattgcaagaaaggagcacagggaagataaacaaggctggtctttcacccaattttctggtggttatagaaatgcttacatctatttattttatttatattccatctcagtgattcaaggtcagttgcttatcctgatgaaatgaaatcagtcttttcaggaaaaaagctcaggatctaaatcctgtccaggaaacaccaacccatgatatcccaatgcaaagggagagaaacatcttcgtctctttccaatgtagcttcccaaattggtccaagcgtgaacaggcacttcagataccacttactatactgggcacaccctaccctaaaaaagccagtccagcactctggaaagccaaggagggcagatcacctgaggtcaggagttcaagaccagcctggtcatggtgaaaccccgcctctactaaaaacacacacacacacaaaaattagccaggcgtggtggtgggcacctgtaatcccagctactcaggaggctgaggcaggagaatcacttgaacccgggaggcagaggttgcagtgagctgagatcacgccattgtactccagcctgggcaacaagagtgaaactccatctcaaaaaaaaaaaaaaaaaaaaaagccagtcacagggagatctacttgaaactaacgaccccctacctcacacttcaagaatcacaaaaaacttagccaagtgccaaagcccttcctaccatgatggtaaaggaaacccattcagtgacacagacagccaggtaaaggcacaaagaaaacagcaaaggtaccagcttgagccttctcatactatgagactttatttgccagattatgagcatcccacgttgtccatgcttaccctgaagaagcccagaggtgggcatggggacgtgtggttccacaagcagctcagcagggaagccggcattggtccccactgtcccctgcagtggcaggcatggataccaccctgacatgcatgtgtttgcaggccttgggggggaaatcagaaaatgcctacctctcacccttctgatcctgtgaagatgctgaaaggcaagatggcttaacctggaaggcctcataactgaccctgtgtgctaccagagctgtccacacagggaggtggacactaccccaatcaaatcaagcctttctgaatcaatcagcaccactgaagaaattttgcaggaataccaagaaatgcagatcacctatgtgctggttgcacgcttgagatcagaaggcctccaaatgtgggcctggaatcgcaacacaacaaaacgagagtcccccagcagccggcaccagtggcactagccgtgacagttcccaggaggaggaagaggaggattgggggtgtggggggtctaatataatctgacactctgattaacaagcttttctacagcctagggggaggcaccagcacgtcagtcagatcacacaaacgcacgcgtggtcccacaccacaatgtaactgacacacttgctgggttcccccatagtggggctttgacgctgttgagtactgaccacatctgagtgctagtggtcgagtgtgatgcctcatgccccctgcctagtgacaggaagcccatgactcccacactgctgggaccctgacggggagaactttctgagctccagctgtaggcaccacccccgtcttagctttgtgacctgaaataacaattgtgaaaagagaaaacccagcttccagatatcttcttgcttcttcagaaatgtaatggctttttttccagggaaggacatgtaagcattgcaatggaatcgtttcagtctctaatcctttgaggttaaagccacacaaaagagggtttagggtttcccagccagtggatgccctcatgagacagagcctaccctgtaagaatcaaaacacacagtctgtggaatttaattgtctgcagccacaaaaaggaagggcacttccttacctccacttatgcccatcagagcattctgggattggatgtgaggactcctagggccacatgtccctgaaatccccctcccagggcagctacagaacgtgccagttaaggagatattttaatccattaatatccactaacacattaaacaggaatagccttatttgattttctagctgctgtgttgcaaaatcatgggcaaaaagtgaattctaatgaggatgagggaggaaggaaaagggccaaggcaagcctttcaaacgccactgcccacagggagagccgtgtaacacactcagtggacagggccagaggtgctagaggttcggggaacatggcaaccggccagcccaggccccagtcttagagggcagctgcgaccctgtccctcctgcgggtgccacgtggggacgggaactggccctgacagctgtctgtgtctttaggagctgggacactgggtttccatccaaaacatccctgtttggatatggtggctactaactcaaaacacacataccatgggctccttcccaaaatagacacatctacaggcggaattcgacttcaaggcggggcgctgcgtaaaagcagctggacttgtgcagagtccaagtgcaggtggggtgaggggaggtgcagggagccccagggaggcacggacttcctgtgcgcagggagaggaggaggaggtgggtttccacggaggatggcccacagtgcctgaggctgtctccctgcctgctgtggactgaattgcatctccccaaattcgtactttgaagccctagcccccagggtgactctatttggagatgggactcttaggaggtaaggaaggttacatgaggtcatgagatcctaatccaacagggaccggggctttctaagaggaggacgatctcggtctcgctgcctgcctctctttccccctctctctcagtctcactctgcctcggttttagtttttctttctgcctctatgtctatctctctgttcatttttctggctctgtctctatgtctctctgcctctctgtctctgtctccacgtctctgtttctctgcttcttctgtctctcccagtctcactctgcctctctctctctctctgcctccatgtctgtctgtgtctctgtttctctgcctctctgtctctatttctctgtgttggggggggtttctctgcctccatctctctctgtcccctacccactacctggccgtgtgaggacacagtgagaaaacagccatctgcaagtcaagaagcggctcgcaccaggaaccgaatcagccagcaccttggtcttagacttccagcctccaggactgagagagaggagagctctgtcatttaagctgcccggtctgtgggatcctgctatggcagcctgagctagtgtatagcctctgctaaagcaacgagacatggacaggagccttcacagtgtctcccgaggcagctcaagggctcgtcaaggaagaaactgggtcttctgaagacacccccttccccatcaggagctccagttaaatccccatttcaatggacaaggtggccgcttctctgggggagaaactgacaagagaaaggaaaaagcacgttctttcaataaacttgtcaattttattcatttcaataatccctccaccaccaccactgagtgtgtatgtgtcagtaccgggctcagcagggggccctgagtgagtgggtgaggagcaccctctgcccccagccttgtgggtgcagcagacagcgcagggcattctgggttgagatgtcaggaacgccagttgctatggggagaggtgagaggaattctcggtatctcctgatacaggtctggtctcagaggtggggaagagggtccacccagcacaaatacataacaaaggcatgtaagggcacagcaaggtctctggctctcaggatctggtatccacgctacaggattcaaaaccatgaacatccaatctcctggccacactggacaggccccagcaagatgcttcctcgcagcctctgctctgctggcctcaaagaggttgcctccagatgccggggtggtgctcccagccctggagatggacactgctcctgagtagggcaggatttggacacgggaagctcctcagtgagagtggacatggtaattaacccaccacgtctttctgatcacatgaatgcaattaattcttgtgtaaatgagatgcaacctcccaagagtacagaagcttcttctctgctcttctttgtcctctacctgtggttccagaggcatgagccaggccagattcccagtggcctcaagcagagccgagccaggccagattcccggtggcctcaagcagagcccagccaggctgcagtgagcaggggatacacctcatgagtgaccagccccatgcacagacccacagtggagaggacacaccacatgcagagagctacagacagctgggctctggctggacaggcactgggggtagcagacgtgaagaggcaagaagggttgggtggcgaggacttcatgaacctcactgaggagtttgtactttatttagaatgaaatgcagaagctgtcaaaggtgtttaagtgaaataatagaaaaataatatctgcacttgggaaatactgtcctgggtgttaaggggattgaagaagggtcaggctggagtcaaagagaccaatttgcactcatttaggggacaagtgccagtggccagaattgagattatggcagcagaaagcagaaagaggaaggcgggtacaggagttattaaagcaagtgaaatagcatggcttggtgacgagaaaagaaggtgccacattctggcttggggctgcagaggcagggaggagggagaaagtgcaggtttaagggatggggcacgttcggttgcgctggggcttggtgagtgtgagaccccacgtgaggcccggtgggaatgctcaggggacaggtccccacatggcccagagctcaggaaggagagcctgacccagacccagatgtgaaagttgcactgataccgacaccactttgagtcacaggaggggaggagctctcagcaagattaaggagcaggagacagagctgggagaagcccaagcatcacaaatgggcatgagccgttcctgtagagtgcagggcagaagcaatgggaagccagctccaggcttttctaggagctgagtgaccagagccttgagagtggggaccggcaggtcagctactgcccagaagccaagcagcattgcgggcatctccgtgacctccaggagaggctctggtgatgggataagcagagggcagcatcaatgggtgggagataaagaggaagagggaggagatgcttttttgcagagtgctgggtgagaagaggcgcagagagacaaggtcatgcttagagcctcctaggggcatggatgactaaggaaggtagagaatgccctggaggcagtcacagagtcagtaactcctccttcctcccacaggcgagtggaatgtgggtagctgccgggaacagcagccctccaggaagcccagtcaaggctgagggtggtaacgttcatgggggcattggcaggtgcagatggacacatggggaaggcatgagggcagcagagagaaggacggggcacttggggatgagatcgtatggggggagatgacccaaggggctcatgttggatgatgcagcagctttgatcccctgggcttctacgctgggccaagaaccaacataagctctttgctttcctcctcttctttgtgaaatctcatccagtcctctcagcactgccatgtggcagacattcttgctatcctgcttgtcaagggaagaaattcaagctcaaggaggttaagtaactgagcgagcagcctcccccgagcatgtggaggggtgggactcaagcccgggctgtgcagctgtcaggtttgagaccccctcctccctgccccaatttgcctcttattctcctgaggaagagcatcatccagccactcccttggtcccaaggcccagaggaaggttcagaaatgcctccagttggcaggggtggggggttctggaaagcctggggtatcttcccttgcactagagactacagatacagtcttgggggcctacaaaaatatttcctggtatttttagttccatgaaatctaaaagaatatataaaggaacaattttgtaccctattcaggacgaaagccaacatctacatttgggtttgtgggccctcctgtgccggcctgaagaatcaccgtattgactgtcctgagatgctgaaagacaatgaaaggtaactccaatggtgcttttgtgctcgatgaaagccagatgacttctacaggctcaggcatcaaagatcttgcaagagtttgaaagagatcagtggtaggaattgagtcaacttccagccaactgtacaaaggcattaactttacttataagaggaaatgtgatttaagttaaatatcatatgacacattaagtcacagcgagtttgggttttgaattttattggtgtcttaaagttgtttctctttgatctgctcattcattttggccttatgttttagaaaagccataaaaattttataaccagttttatctctggacacatgtaattacattatgaattataaatatataaccatattatgctcaaacatagactatatagttataatatacaagtctggtagaataatattatataagaatgatgtaattatcaattataataacgtaaaataaaaataatctaagtcaacactggagtgtgcttggtaatattttttctttctgaaaaggcttcataagtggttctagcctaaaggcatgggtgggagagtaaagtgaaggaagggaagggaagaaaagccgctggtgggaagcctggagagggagcctgaactaaggagagaaggagaaaccacagggtggaaggcgagtggttgctgctgtccagggtcctgatggtcactgagccctactcccgcccgccccttgaggttaaggccgagggcagtcagctaagtcatcccagggtgtggagggaccgttgggacttggaggacctgggtttgaagcctatcctaacactgaccagatgtaatttggggaaaattattaagcctaagtattcttggcaatttaaatgagataattcatataaatgtattcttcaagtcgtaaaggacaatttgaatgtgaaatactatgctaataaagggactggcactaaaacaattgcttctggtttcccagtgtcgggggagggttctgggggaggctggagagagcaactccaaacttctcagttcccttctattttcagaaatttgcttcaaccatgactgatacatgctattcctgatctgtttgatatttcagcattgcacatatgccaataatgcaattgcagggaagcacatggtgctatttaaaaactgtgttcctaacacaagttagagacaagctcaagtggaaaaatataatacatgaagcagattctcaggtgagtttatgacatttacattcaccttttaaataaggcttctctcagcttctgcacagcaaaagaaactatcatcagagcaaacagacaacctgcagaatgggaggaaatttttgcaatctatccatttgacacgagtctgatatccagaatctacaaggaacttaaacagacttacaagagaaaaaaaaaaaaacattaaaaagtgggcaaagaacatgaacagaaacttctcaaaagaagacatttatgtggccaacaaacatatgcaaaaaagctcaacatcactgatcattacagaaatgcaaattaaaaccacaatgagataccatctcataacagtcagaatggcgattactaaaaagtcagtcaagaaacaacagatgctagcaaggctgtggagaaatacaaacacttttacactgttgatggggatgtaaattagttcaactgttgtggaagacagtgtgatgattccttgaagacctagaaccagaaatatcatttgacccagcaatctcattactggttatatacccaaagaaatataaatcattctattataaagatacatgcaagcatatgttcactgcagcaccattcacaatagcaaagacatggaatcaacccaaatgcccatcagtgatagacttgataaagaaaacatggtacgtatacaccatggaatactatgcagccataaaaaggaatgagatcatgtcctttgcagggacatggatggagctggaagccattatcttcagtaaattaatgcaggaacaaaaaactaaacaccacatgttctcacttagaagtgggagctgaatgatgagaagagaacacatggacatagggaggggaacaacacacactggggcctgttggaggttgagggtaggggaagggagagaatcaggaaaaatagctaatgcatgctgggcttaatacctaggtgatgagttgataggtgcagcaaaccaccatggcacatgtttacctatgtaacaaacctgcatgtcctgcacatgtaccccataacttaaaataaaaatgtctctcaataattgtacttcatcaacttacatgtatctgcaatgcatactctgacttccaagtggaaaagaaacatagttaaatttatatttgcttcatattggtcagtataatcagaacacaggcagccccaaagggaactcttttctaccaaaacaatggggttgaacttaggagagaacaattatgccacacagctgaggaggtcaaaaatgggaaccctcatatatttccagtggagatgtaaaatggtgcagccactgcagaaaacagtttagtggttccctaaaaagttcaacagactcactacattacccagcaattcactcccaggcttatgcccagagcattggaaacaggtattcaaatacttatatacaaatgtcacggcagcattattcataataaccaaaattcagaaacaacccaagtgtcgattgatggatgaatggataagccaaatgtggtctgtccataaagtggaagattcttcagcctacagaaggaatgacgtgctgattcacaccacaacagggatgaacctcaaaaaatgacatgctgattcatgccacaacagggatgaacctcaaaaaatgacatgctgattcatgccacaacaggaatgaacctcaaaaaatgacatgctgattcacgctacaacagggatgaacctcagaatgacatcctgattcacgctacaacagggatgaacctcaaaaacatcacactaggtagacaaagccagacacaaatgttcacatgtatgattccacatacatgagatattcaagataggcaaatctgcagagacagaaagcagattcgtggctgtcagggctggaaggaggaaggaaagaggaggggctacctggctggtacagggtttcctttgggatgatgaagatgttttggaactagatagaggtgatggccacacaatgttgcaaatgtactaaatgccactgaattgttcactataaatggttaattttatgttatgtcaattttacgtcaatttctttttaaaagataccacccaacctcccagcaaaagagtctgaagggctataaggcatcagtccccaacattttgggcaccagtgaccagcttcacggaagacaagttttccacagactggggtggggggaatggttttgggatgaaacttctatctcagatcatcaggcattaggttctcataaggagtgtgcaaactagatccctcacatgtgcagttcactctcctatgagaatcttatgccgccgctgatctgatagaaggcagagctcaagcgatcatgcttattcgcctgctgttcacctcctgctgtgcagcccagttcctaacaggccacagacctgtgctggtccatggcccaggggttggtgacccacactataagggaaaagagacaaacctatatcccaacagtatgtttccctgggtgtctcctgttgaaagaatctcacctgagtgccactctggtgtgtaaggacatccattcttgggacagtggaacctctaaacacaaccagccactgcatttggttctctaccaatcaacaacaatctgcgccaatactagagggaaaacttcgccaggggaacttaccgagacttgatatgttcaatatggctccttccctagggatttgcaagggtaatttttttctatatgtgattttggtataatgtgttgactttagaactaaacccctgcacaaaatgtgactctaccaaatgcttgttcagactatacaatgcatagtaatttataagctattttcccctaactcccaaaaaatgacttaagaatgcttatactaaaaatatttatacaataaggcagctaagaataacaatttttaaaagaaaaaggggacaatatatagaaaaccttataccaggaaatcacataaaaagggtttttacctattgactgaacattacatttatgctctgagcttgccagctgctagtgcctgagggaaaacctatcaattataactttattaacatgaaggatgtgcctcctaggattctgccacaaatgacaaagcaatgaaaaatatttgattgcctttttttaaaaaatcacttgctttttcaagagctgatttatgagaactgctgcaatatggtactgctccctaaagagcttctgtcttctcaccttctccttccaacctaggggtttttcttcaccacacttcaaattcttgagcaaggccacattcagttatatgagcaactgaaactggtggttctgcaagctggtccatggtgcagattcaggctgtgaacttggacaaattgagcagctcttcatgttgcctgctcattcaagatgaccatgcttctctccccaaggactgatcactttgattgatgaccgattgaatttgccttatgtacagggtgactcagagacctccaagtattagaaaatgtgtccttagtttagatccaaatctatcttctgctcatcaagtgatatatctatggccatagaaatcagacaaaattcctttccagatggattttttcagatatttttgttaacttgttaaattgaggtaaaacatacatgaaatgcacaaatcataggtgtacaactccattaacgtttacaaagtacacatacctgtataaccatgacccagatgaagaagtaggacattcgctgccacctcaaaacctctcccctgcctcctcccagctgagagtccccaaaaggtaaccactgttctgatttctagtcccatgcatgtgttttgcctgtttttctattctatgtaaatgtaataaaatatagatttttaatgtctggatatttatctcaacattttatctaggacgcacccacatctgtgaaatagcagcccttcattactgtgtagtatcctcttgtataaataatctgagatttatctatttatgttcaactattattaaacattaggatgattccagtttgagaccattaaaaataatgctgcaaagaacattcttgagcacgttttcttggaggcacatgtacatgtttctcataattactcacctaggaatagaacagtggtgcctgcagaggtatgaacagagcaaagttcacccatgtcatagattttgtcttctaaaagccaaatggtggtgctttcagagattctagtaggtgtcccttccatgagagtcaaaacccagatgcctctaggagttacgtctaatgagatgcgtatgtttagcctctaggagttacgtctaatgagatgcgtatgtttagcctctaggagttacgtctaatgagatgcgtatgtttagcctctaggaggtacgtctaatgagatgcgtatgtttagcctctaggaggtacgtctaatgagatgcgtatgtttagcctctaggagggacgtctaatgagatgcgtatgtttagcctctaggaggtacgtctaatgagatgcgtatgtttagcctctaggagggacgtctaatgagatgcgtgtgtgtagcctctaggagttacgtctaatgagatgcgtgtgtttagcctctaggaggtacgtctaatgagatgcgtgtgtgtagcctctaggagttacgtctaatgagatgcgtgtgtttagcctctaggaggtacgtctaatgagatgcgtatgtttagcctctaggaggtacatctaatgagatgcgtgtgtttagcctctaggaggtacgtctaatgagatgcgtgtgtgtagcctctaggagttacgtctaatgagatgcgtgtgtttagcctctaggagttacgtctaatgagatgcgtgtgttcagcctctaggagggacgtctaatgagatgcgtgtgttcagcctctaggagttacgtctaatgagatgcgtgtgttcagcctctaggagttacgtctaatgagatgcgtgtgtgtagcctctaggagttacgtctaatgagatgcgtatgtttagcctctaggagttacgtctaatgagatgcgtatgcttagcctctaggaggtacgtctaatgagatgcatgtgttcagcctctaggagggacgtctaatgagatgcgtgtgttcagcctctaggagttacgtctaatgagatgtgtgtgttcagcctctaggagttacatctaatgagatgcgtgtgttcagcctctaggagttacgtctaatgagatgcgtgtgtgtagcctctaggagttacgtctaatgagatgcgtgtgtttagcctctaggagggacgtctaatgagatgcgtatgtttagcctctaggagttacgtctaatgagatgcgtgtgtttagcctctaggagggacgtctaatgagatgcgtgtgtgtagcctctaggagttacgtctaatgagatgcgtatgtttagcctctaggatggacgtctaatgagatgcgtgtgtgtagcctctaggagttacatctaatgagatgcgtatgtttagcctctaggagggacatctaatgagatgcgtgtgtttagcctctaggagggacgtctaatgagatgcgtgtgtttagcctctaggagttacgtctaatgagatgcgtgtgtttagcctctaggagttacgtctaatgagatgcatgtgtttagcttttgctaaatagcttttagaaaagtggggagtgtcaaaagaagacatacaaatggccagcaggtatacgaaaaaatgcccatcatcactaatcagagaaatgcaaactaaaaccacaatgagatatcttcttaccccagtcagaatggctatgatgaaaaagtcaaaaaataacagatactggcaaggatatggacaaaagggaactcttacacactgatttggaatataaattagtataacctttacagaaaacactatggatgtttcccaaggaacaaaaaatagaacaattaataccattccatccagtaattccactactggtatccacccaaaggaaaacaaatcattgtatcaaaaagacacctgcgctcatgtgttcaccataacactattcacaatagcaaagctagagaatcaacctaaatgtccatcagtggataattggataaagaaaatatggtatacatacaccatgaaatactgtccagccataaaaagaatgaaattatgtcttttacagcaacatggatgaaactagaggccattatcttaagtgaaacaactcagaaagtcaaatactgcatgttctcagtcacaagtaggagctaaacagtgtctccacgtggacacagaaagtggaatgataggctgggtgcggtggctcatgcctgtaatcccagcactttgggaggctgaggcaggcagatcacttgaggttaggagttcgagaccagcctggccaacatggtgaaaccccatctctgctaaaaatacaaaaattagccaggcatggtggtgcatatctgtaatcccagctactctggaggctgaagcaggataatcgcttgaacacagaaggcagaggttgcagtgagcagagatcacacccctgcacttcagcctggatgacagagcaaaactccatcttacaaaaaaaaaaacaaagagagagagagttgaatgatagacactggaaccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaggcactgttgtcaacttagggggtggccccaggttgcccctgctcattccctcgaggtctcctctccaaatttgaaatcatctgaaaggccccaccttttgttgcctttttagcttgagaataaacatgtaacagcaccagcagcccataaatcaacgttctaaaggatttgattccctaattccctacatgtttcaactgccctggacaaatagcgtggtcttggtttcttcctcttccccctgagcagaaggaatcttgcttgctaagctagcaggtttctctttcgtgacctcatgctgttttctcggagctgatggaagccccaggtgcttttcctgggtgtttacttggggtgaggtcgggtcacttctagaggtgtccatgagcaggagcccagcagtcgagctgcctcactcaccactcgctcaccactctctcaccagctgttcttggctctggatggtccagccaagaactctcaccacagttggtagcaaagcagtttgaattcttcccataagtccacattatcaccactgattttcacataagcacagaaatatgtgcccaaggcagctgccagaaaacctgtgttgaaatctctggaactttctcaccacacatggagcccacagaagcattccaggagcctctttgcaggcagggatcaaaactcagggctccattgtctgtgtgacagcaggaaacttccttcacctcgctgtgcctcagcttcctctgctatagaatggagatagtaatagtacccacctcatagagggtctgaggagaaatgagataatagatacgacggtcttcggatagagcttagcacatagtaattgttcaataaatagtagctatcaccatcaccaccagcattataatcatcttcataaccatcaccaccatcatcatcatcaccgtcaccatcatcaccatcacctccatctcctcctatgccaaactaaggatttttaaatagcatatcctcagtgcaaaggattggctcctgcagacccacaccctaggtggaggtttggaacggaatccaagtccttcttatttattttattagcatccaggactaactaaatggttgacatgtcttcccctgggccacaacacatcacatgctcccctgaggcagggggtcttctgggcgcagaatccaatgctcagcatttcccagcccctctctgtgggtctgtgggtaccttgtgatgaattggtggaaacggtccattctgggtctgtgctggaagattacccaaactgcctcatctttgaagctctgaacacttctccgttttctggccgtctgctgttagcagccttgtgagccctactaatgaagaaagcacgtagaagttagactttcacaaaatacagcggtccccactatgtccactcttaaccacaagagctactttgacttttttttttttttttgccacacaacttgtggttctgacaccaaattgatagttttgtttcacatcaaattggacacattgtgcattcattaagatgtgcccagtgcttttcaagggggccaggaaatcaccttttaattcttaatcaaaaatcatagtaagatgtttattttcttaatctccaaaagccactgatttgactgactcgtccttctaacaaatctttcctgtgcactgttgtgggccagctgtcactctagggctgggcattcaatagtcgtgtggtccctgctgtccctgagtgttgttcgtgttgggagggggtagtcagtgtacgtacacggatacacaaacatgatggtttcaggttgcgataagtatcatggagaaaagaagactgggccacggggatggaggagctggctctttagatggtgggtgtggagctggccccagcatggactcctgggaacagcggaggagccccagggcaaccctgttgctctgccttatggtcctggtgggggaggtgggagtacactgggggcctcgaggcccctgctgtgttggctgggtgataactctgtccttgtacccaacaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggtgagccctgtgtccttccgtgggtcccccagggagagaacgccaggatgtcaccctgctagtggggagggaaggtggggcaggcagaagcaggaatccccatcctgacaacatgaccctggaaaatcccttaggtcaccggcgaagcacagaacgtgtgtgcgtgtgcacaagagtccttggaacatgttagggaccatgttggcaatttttctttgagcatttatatcaacaagaggctcatcctacaaaagacaggagggaagtgagtccccccaggggacacggttacatcttccgtgtcacatgcacccctggacacatactcactgagttggatactgcctggaagtgcttacgtgcctttcagaatcattccttctttctcgtccttgtaaattattattattattattattattattattattattattattattatttgagatggagtctcgctctgtcacccagtttggagtgcagtggtgcaatctcagctcactgcaacctctgcctcccaatttcaagcgattctcctgcctcagcctcctgagtagctgggattataggcacctgccgccacgctcggctaatttttgtatttttagtagagacagggtttcaccatgttggtcaggctcgtctcaaactcttgacctcgtgatctgcctgcctcagcctctcaaagtgtcggaattacaggcacaagcctctaagcatgcatacgtggcttgtataaaagagatgcagtttcatcacagaagctattttcgccgcgatgtgaactccagtgttcttttctgctatctccgctcaaacagggagtgtgatgtgcccccttcctttcctggggagatggtagggaggtggggtgagtgtggacactttcttcgtcttcttgctctccgactcgccagggtcccagtgctgctgagttactgggcagccagcacccccacctccggaagcctccactgcccgctctgatattcatgaaacctttggtcagctagagcctgacagagcagtggtgtcaggggtaggtgggacagacgctgcctgagggggacagcacgtccaggtagcagctaacgtaggcagggtcagttcatctgttacacgacgacattttatttcctccccaactgcccggagttgatcaagaatgctgggataatgaggccacccacttttcactgacgcctcccgcgatgccttctgatgagtgcgggggtgaagaacgagaaacaccagacacgggcactccgtggggagtcaggaggtgaagggcacctctctcggggccttcaggagaggctcccctggacactaactttgagatggagagattcaggtagaggaggggcccttagcacagaggtgggtccccaggctcaccccagtgactgggaatgaggtctcagagtgggaagtaaactggagggacgtgtctgtgttggaggaagaaggtgtagttgggacaatcacatgtaggtcagcatttctcagaattcatgcttcaaccacaccccatgtatcatccccccatggtcttgggtatggccagggttagccatgcccggggatggtggtgcaggtacggccagggttagccatgcccggggacggtggtgcaggtacggccagggttagccatgcccggggacggtggtgcaggtacggccagggttagccatgcccggggacggtggtgcaggtacggccagggttagccatgcccggggacggtggtgcaggtacggccagggttagccatgcccggggatggtggtgcaaggttggtgttcttcagagtaacacagctggtgggagatacggatgtgcttatactcacacacaccccacacacacacatccctacagacccacatacatgaatacatgtacacacacccacagacacccccacagactcacatagacagatacacatacacatacccacatacacacacccacagacacccccacagactcacagatacacatacacacacacacagacacccccacagactcacatagacagatacacatacacatacccacatacacacacacacagacacccccacagacccacatacacacacccacaaacacccccaccgacacccccacagacccacgtacacaaaaacacatacaccccccacacaaaaaaacacatcccccccacacacacccacagacacccccacacacccacatacacaaaaacacacccccacacacatacccccacagacccacatacacccatggacacccccaccgacacccctacagacccacacacacccacacatacccacccacagacacgcacacacacatacacacacatacacaaatacatacacacccacacacccacacccacacacccacatacacatatacccatatacacatatatacatacacatgcatccacatacacacacccacatacacacatacgcatgcccacacatctacacacatacatacacttacacacatctatacacacccacacacacacccacatatacacacacaatgtacatacacacatacacatgtacatatacatacatacatatacatctacacacaaacacatccacatatacacatatatgcacacattacacacatacacccatacatacacatttacacacacatacacacatatacacacacacgcagaaatggattctcaggttcaacgatgtcatcagacctggtctcttcatctttcagttttgctcagtttcatggggtggtaagatggggaatatgcggtccgggcagagggtagagggagagaaaagagagaagaaaaggtgagaggatgaggggcgggcggggggatgaggggattgccttctgccaagatctctcttccattcgatctgccaaacgccggcgtctcgttggcccctctctgagctaatcgtgtggctgcctggccaggcctgagacccctggacagaggtagctctgccgggtcacagagactgaggacaggtaaggaggtggttccacagacagtttaggtttgcatttcccagaagatggtgactaaatgccgaatttaaaggaaaagggcagctgtgcatcctggtacctgactgtaccccggccccaccctcccacctcaccacagtttctgatgtgctttcaacactgtcttctctttttccctggcgactttaccgaatgatctcgtttccaggtgagatgggcagagcccagtcacggctcacctgccagggctggtccctgaacgcctccgttcccttctgtcccctcccaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtgagttttcgttgggtgggtggggagggtttgttaggccctaacgcagcagggaccggcccggtatttgctcagtggaggaggcagggtctgctcttccagccctgatcactggaggcaccctcaaccccgaagactccatcagcgtgaaccccaggaccccttcctcacttccagcactccccccatctcgctcccctcactcatcccctgccctgctctgctctggattaaaaatgcaggggccagagaggggacccctagtgtcagaacattcttgattgatgactgccttattaatttcaacaaactgagtcttagcacgatgatacccatggccgaaggcgcgtcccgccttaagatactgctgggtctgcacgtgaacaggtgaccaggccttgactccaagaaatgggtatatccctggtgcctggtgtggggaaccaaggacaccagccccctatccctgcctggggtgaagtagaagcatctgccctcagggagggcttgggaaagcagctgctcctcaccgtccccagctccgccctgcaggagcaggggtgacttgggaacagaggcagtgcgtctgcctgagccgcttcctgcagactcctgtgctctgaggcgggaagtccccagcatgggccctggcccctgcagaggaggccctcagccctgttctctcccagcagtcggaagcccacgttggcctctgcctgagcccctctcttccctccagctgtggtggtaataaacctgacactcactcccctctctggcccctgcatctactcagaatgggtccagaggatgggagataaatggttgacgtcactggcctgacggaaccctctaccactgattgggtcctggggcctgaggtctgtgaacctgccccgccccctccccgcaagacttcctggagcttccatacctggcgggtggttggagtcggaggtcgctgggcatgatcctttgcacctggcctctgggcagaggactggtcggctccccattgcaggaccgcggggctcacctcgggcagcccgcgagccagctctgcttgtccacaggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcagggtaaggctggggctcccgcctcggtggctcctcagtccccaaaccccacgggacggggccctgtaatctccccagcccatggagggggacccgcatcccagcttgcagggaggggggccgcgctcagcccaccgctttgctggtggactctgtcatgtgcctgatcctgactgagttaaatggtgttttttatttgctaatatgtagccacataactaaggaaatgccaggcacttgcctggcttagaaagcaggctcagaagaatccagacatggccttggtgtgcgacaaggggtctgagagttgcccggtggaagttggccaggacccactttcctgaaccaggctcttcctggttttgctggctgcagagtcctaggttctgtgtgtgtgtgcatgtaaatatatacacacacatgcacatatgtgtctatacatatatggacatgcacccatagatacacgtatctgtatgcaccctcatgtatatacatacatctgtacctatgtgtagaaacgcatacggacatatagacccctgcatacatatttgcatgcctgctaactgaacttttctgggtccaggagagagcatgtggattgtggtagggcatgttccggatgatacacacaacgggacgtgcgtttttgagaaatcacctgcagagcaatgccccccgtgcagggctaggggaagagatgtggggctgggagccagaacgtgtgcccgcatccccacccagaacccgctctcatctctcctgttgtgttgagcccgtttccacctgaggtggcagcacagccctggtcaggaccctcggccctgctgggtcagcctgtggggtctcaccgggaccctacactgtcctcctgtgagtgttcctctgggctgggggccgggccagggaaaccgaggcggggcacgcactgtgagaggtcaatgctgagcagctcaggtgtgtctaggaggacagaaaggacgatggtgacactgggcagggagctaccttccgcccccaccccgtcctcctgagtggggctgccccggcagcacctcagcacctcctgaaaaactggaaattttctgtgaaatttgctaattcgttcgacattggccactaataaaaatactaaacatgaatttgtggcctttctataaaggaagcccttcagaatatgtgaattcaccatggctctgattggttcacaggcaggagcccaagccctgagcttgggaggtggtgcttctggggaggccgtgggcaggacggggtagcagctgccctgtgggatgcggctccacttctgctccaggtccccaagaaggctgtgaaggcagggaagcctggggcgggagagaaagcaaatacttccaagtcctatgtttcagacaaatgtgaattgatcaaattattaataaaagctgggcagaggagaccaatggagggaatgaggagtcatctgtgtatccaaatgttacctcaaaggttaaaaagaggctggacgcggtggctcatgcctgtaatcccagtagtttgggaggccgaggtgggcagatcacctgagctcaggagtttgagaccagcctgaccaacagtgaaactctgtctctactaaaaatacaaaacttagccaggcatggtggtgcatgcttgtagtctcagctactcgggaggctgtggcaggagaattgcttgaacctgggagacagaggtttcagtgagctatgatcatgccactgcactccagcctgggcgacagagtgagactctgtctcaaaaaaaaaaaaagattctggtgggtctggggcagcgagagggcggcagagctgggcccaaagcactgtgtggggggtgcctggccaggctctgaggggctgaaggtttggtgaatgcaggtggggctgagcgtagctgaaggtggccctgcctcacccgtgtgcctcctttttctttccaagttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcaggtgagagcgggccgggccccacaccatcctcctggtgggcgcgggctcggagcgggccccgtggagatcaagagacatgggcactttccccgctacccttgggtccctgagagagatggagacgcccagctggggtcctaagtcgtgctaggtttctgaagtttatatttaatgcctgtcacataccctcattggggataattgaaaaagtcgaagtgcagggcttccaccctcccccgctgcaccatcctggtattcggtcataggggtggttttgcaggtccgggtagggttaggctcagttcaggcagaacctgccattcgctcattcacctccgttaactgggcagatgtttgttggccatctgtgtgctagggaggcatcatgggagccaaaaataacacagtcagtgttcgtccttcagaacagcaaaacggcagagctgggctcatgaggaagacattcagccagtttggggtttctgtctaatttccgatcgtgcatattctaatggaaatgccctcagatgctgtaaagaacaaaacttggacaacaggagggactggaaataaccgagggcctggggaatgctaaatagtgggagctcgaagacgctgcagttatcagatcacacagtatcctctgaacccactcccacagcaaaacagccccatacccggagagggggactggcatctctcaggcctgggtttatgtcccggctggttacagaccacaggtgaacaagtcccccgactcctccggccatgacgttcttcatctggaagatccaaatcgttcagaaacggaatgcccaactaatcacggctaagacaacaaagtcgtttaattaccccacatcacagggagtctgcagtagaggctgcgaggtggatttttggctctcagtgtgtcaggggtctgagttctgtctcgtccattctcttggcctttctctcgtggttacaaagtggctgccatagctccaataatcacaccgtcctatgagaacaccccaagaaggaaaaaagggatggacggaagccagacttccttccagtcagactttctatgacatctcgctgagcagactgaggtcacatggccaccacccaggcaggaactggcttccaatgaatggcttatcagtgatgtgtcatccgaaagcccaccaggaaggctcagaggtagaaaggagagctttattggtgacatcagtttgcagaccaggaagagagaggctctggcatgtgctgagggtgctctctctgaagagggaagggcagggtgatttttatgcctcacagggtccacattacacagaaccatatgcattcaggttggggaaaggctgtgcatccatccgagaggagtcacacgcacatgcagtgagtagacatatctgtagcatcctctgtgtgcaccgcacatggggcgggttttagtgttagaatgaggtggaattggctctttccaccaaaaggtaaaccccacgactcaaagcctaagctaaaatgggcttaagcctctttaagctgaaaccggcttaatgtctacagtcgcttatcagaaaagagtgtgtgtaaggccggtcctctgcccagttggagttgcgtggtctgggttgtaaatgagagttaggaggagtcccatagcgcctgttgttctggagtttagcaagagtgtgggttttcttgcagcgtaggaatttacagagcagccatgccagccaggccttgacccctcggccccaggtaccttttatttccctaaccttaggggccatctcagttgagaaagaggtatctgttttggtctcttgggtcacagatgattccttttcttggtgctgggccctgggtgagttctggagataggatttctgttgactgttgtactcgtctgctggggctgccgtcacagaataccatagatcaggtggctcaaacaacagaagtctgtttctcacagtgctgggggctggaagtccagggccgaggcaccagcagggctggtttctttcccctgaggcctccccgaggcctgcagatggtgccttctccctgagtcctcacgtggccttttctctgtacatccctagtatcttgtcctctttttataaggaaaatagtcctattggattaggaccctaccatcatgatgtcatttaatcttaatcacttctttaaatagctcatctccaaataaagtcacactgggggttaaggtttcaacttctgaatagggtggggtggggaaatacaacttagtccatagcaaatgtcgagccagcaacacctgccacgatagcacaggttttatgaggctttctgtgtattacatgacacgcaaaacacaactggcaagtagtaagtgctcagtaaacgtaagctcttattttatgtatacagggaaactgaggcccacagaattgagaatttttgtccatgattacgcagatggtctcctaacagagctggaattagattgaaccgaggcctgaagaagacctgtttccacgcctttccccatgtgccacgttctcctcacctatccaggagtgaatcatcaccttccctgcaatctgctcagattacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaatatttagcagcattgttttatgttgtattcataacataataatataacaatatattaattgttaatatatattgttaataatataataatataacataaaataagtgatacttattttccatttacagttgagatattttctttaaaagtaacgttaaatattgattcaattcaaagaatacattcattaatcatacagatggcgtctggctaggtgacgcatcatgacagtggtagggagtgactgaagttgagctggtgcacagactgccagttttacaacccgggaagtgttccctgaccatccgcttccccatgctgcccgccccgtcacatgagcccttaccccctggcgctatcccatctgctccaagacaccgatgttctagtgggtggaagcctccacttttagttgactacggtatctctagcatttcacacatagtaggtgctcaatgaatgtttgtcgaatgaatgaatgaaagaagggaggctgagagtagctgggacatttgctctgaaaaaatcacctccattctcccaatattacaaaagcattttcattaagtccacaatgagaaatgctcactgtaccaataaataatatctttagttatctatttttaaaagtatttcattgacaaagattgtctatgttccgggtgtacgtcttgatgaccggatgtgggtacacattacgtaaagactgtcagcatggctgagtgtggtggctcaagcctgtattcccagcactttgggaggccaaggcgggtggatcacttgaggtcaggagtttgagaccagccaggccaacatggtgaaactccgtctccactaaaaatataaaaattagctgggcgtggtggcaggtgcctgtaatcccagctactcaggaggctgaggcacgagaattgcttgaacctgggaggtggaggttgcagtgaaccgagatggtgataccacactccagtctgggcaacagggtgagactccatctcaaaaaaaaaaaaaaaaaaaaaaatgactgtcccagtcaagttaattagtacatccgtcattgcccatgctgaatactaggcccccagaacctgctccacatgtaaccgaaagtctgtacccttattaaatctaaggaaagaggcttttaagaggaatttgtgatttttagtttggcgagagaaaaggtggtttgccgagtgataagactgaagtttgctatagtgatgatccaaatcctgtctcgtggaggctttacctcagcctctttataagtgaaatttatagccacaggcctcctgctggatgcggggctcagcacctcccctatccccagggagggccatctgcctgctggcattctccactgaggactggagggtaaagctgcgtgtccccctaggagaaggcacccaccaagtagagtgtctaaggttatgttctctgtcagcagaggcaagggcagacctggaccctggtcccagccctgtcgtttacttgctgagcgccttcagccagtcactagacatctcactgaaatgctggtgacctttgcttagaacactattccaagaatggagagagggctgacctcaagcatctggcgaatgccagacacctccttccgtcccaggagttgacccctagctcactgctggggttgaataaagtgagactgtgcggtggtgcaggcagtccctccccagaggccttgggagggcctcgttagacccagtctcaccttttaaatccatttaaacccagttcgctttcgtgccttccgcttggagcctggttggaagcattagggctggcgcagctgagaggctggtgttgcagactgcccggccgaggcccttcccgtcctccctctcacgggcttggggcagggaaccttccgcccgcagccccacgcagcttccctcagcaggccaggaactgaccgtgacgccaatgcatacacatcttcatctgggttaggaattgaaaccagatttttttttagataaatacgtcacagaatgctattgaatacctttgtcttgccacacctccgcaaaataaactgttcttaatcgataccatgtagcaaaaacagaatatctttatggatgtattacattcatcaatctgagtgcatcagaacgtgtagttcgagttgtcgaaggtttactttgctttgaataccgttaccacgtgactaggtgctttctctgtgagtggaaacccagcggctgctgctggcaccatcactgggagagaccaccagggctgtcgctgtctccaagctggcatgttaccaggtagcctcttcatttaaacacactttttttgttgaagcctttctgctgtccgcagcctccgcccagtgcccctactatctgcacaatcttcgtctcatgctgaggctgagctgggcccggagtaagcacacagtctgtgcggtggctccacctcctgccaggccaggctgtctgccagtgtctgcgcgtgtgtgttagacaacgtggcatgttttaaaaacctaagtgtcttttgttttgtttgttttttgagatggagtctcgctctgtggcccaggctggagtgcagtggggcaatctcggctcactgcgagctccgcctcccgggctcacgccattctcctgcctcagcctcccgagtagctgagactacaggcgcccgccaccacacccggctaattttttgcatttttagtagagatgggttttcaccgtgttagccaggatggtctcgatctcctgaccttgtgatctgcccacctcggcctcccaaagtgctgggattacaggcgtgagccactgcgccccgcctaagtgtctttttatggtacatatacacctcaccttaccactatccccctgcctctctgacacaatgctggatccagggtacacctggtgtgcactgatccccaccgtcaccagagtttggagcctttgtccagccaataagttggagaagctgagggtgcccagaaatggacattctgcccgcgtgtcttgtaagccccagtgggttttctatcttgtccagagctcaggtgtttctgtacctgttggagctgagagacctgcgctgatcccatctgtgccacttcaacagagagagtgggtgtgtcctctctccagcctcactttccagaacgagtaacacacaccctgtgcccgtctctaggcctgtgagccccgtgagtcagcgaagcagggaaagggttggcaagctcaatctggcctcttgtaggatgcgggaggagccacccgctcagtagccccttttcttggcccccagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaaggtgagtggctggggaagggggaccctgcactccgtccccagagtagctccatccacgtccctttgctggggctggtgaggcaggctccagaggggccttgccctacaaccagtagccctcggatttggattcgcttctttctcactattgaatctgcatttgggaattacctacactcctgtcttgctcttggccaaaaggtctgggtaaaggagtttagaggaatctatttggcaccctccagggggcacccagctctgtgccaggaactgaagtggggggaatagaacaaagaagaaccccctccacagccttaagtctcatctcgagagaatcggcagccgagagagcgtgcatcaacctctaaatgtaaagcggaggccaggacggtgtggtcagcagggagctccttaaaggagggcactatggtggccctgcctggtggtgggcaggggtcaagcacagtgaggtcggaagagatgggtgtcccacatctgatcacaccggcctcaaagacaggctggaggctccatgcacctgctcagaccacctcccgctagaccctctcccttctgctctggcagaggccatcagcaaggggtcgacgggcagttacctgcaggaatattgagctcgaggcaccctagagccaaggagggtgggtttcccatccacgtggctttcccttggtcctggccttggggagatgtttgtcattgctgctgcggttgctggccagtgcgtccgactcccgcattcatgtgctctgcagggcagtgcgggatgaccagctctatgcaccaggccctgtgctaggctaaggggtgccctcttcaggtcccaacctaatggggagacagacaaaggcaagccattggtaggagctttgtgggttttccaaatgaaaaaggccttggagaggaaatcccccgggacgaagcttcccagcactgctttctccaggaacagagggcgtgcattttgaatggtggacagaagactcatccaaatctggcctgccaactcggtgcctacttgcatagacaagactgacttatgttctcctggcaaaggcccctggcagggccttgggggatgtcctgtcaccaaagaacatgccagatccctatgcaaaccctgcatggtgcagcacgtgctatccccggcagctcctccgtccccgctcccaggtgacaccacggagcagattcacactggcctttgcggagtggtccagtctgaccccacgacccctctgtgtgccccagagccaggagctccgaaaaagtgcccatgagtcaggcccggtgaggcgggcagctggtcttcccccgccccctgatgcctttccttttgatggaggaagagcccgggaattgctcagtagagaaataatgtcaccttctctcctcagaaggtggcccagggtcaagcgagttcatcataaagttcctgggctgagccccacccccacaggcacagccccactccctccacctcttagcaacagggggatcgccggggctggagcttggccaggatggcagcagcctccctctcccatccacaaggtgttgtctggttttagaaatcatgtaggaggctgggctcggtggctcatgcctgtaatcccagcactttgggaagccgaggcgggcagatcatgaggtcaagagatcgagaacatccttaccaacatattgaaaccccgtctctactaaaaatacaaaaattagctgggcgtggtggcacgcgcctgtaatcccagctattcgggaggctgaggcaggagaatcacttgaacctgggaggcagaagttgcagtgagctgagattgcgccattgcactccagactgggcaatagagtgagacactgtctcaaaaaaaaaaaaaaaatagaaatcatgtaggcaggtctggatttctgggttctctttagaaattacaagatgtggtacagagatctggccactcagcgcacacgttctcacgtggcagtgaggagctgtagcggagccggatccctgatgggcacggcagatgttcggcccccgctggcccggttcactcattcccgcctgccttggaaagtgcctggggttgccatccctgtcctctaaggatggtttgttttcgatgtccttattcgctccaatattagctgatgtgctcccgaatctgcaaagtgaagggagagagctatcagctgcacagtgtgtgccccgatgcctcctcacctggcttgtggcaagtcccaggcccatggcagaccctgtgttaggcaaatcccacatggtccccaagatcaaggggcccacagcaagaggggggacagacaagtggccctgttccgtgcccatgtggctcatctctactgagcatcccgagggccgacggccaggacccaggggcacgctttgcctgggcggtcagccaagcccccttgaaggagagaccagtcaggagtccttcatgctctttgggtagagggtgagttgagggctgtccccggcagagagtgatggcgtgcagacgggcagtataaaagtcatggacactggtctggttaagcagctcccggtgtggccagctctgtgccacccactggagactgtgatggctcaagtgtggctctcagggacttgatgcaggatgcagaggagacaggcggaccccagtcctttgctgacacagactctgcacgatggtgtgcgggcgctgttggtggggccggggatggcgtggtttcacgcagcttgtatcttagggagaagggtgacacgtcagcctaactagaaagtcctgcagagggtgccgagcgctggaagggaagttggcccagtggatggacagggacgggtcaggctccgtgtctggtgaactgtctccagtcacacacggcctccagtggcagctgccctcagggtttctgaggatgtagcccccgggcagtctcccctggcaccgtggccacacccaccatctacagcagcggtaccgtgggcactgtggggcctgatgtgccgccgggatctcacctgccctctccttggctggatgcatggcgctggctcctgcccggcccgctggctctgcgtgtgctctgcctcagcctccaccccgccccagccccgtaacccattctgttttcattgcagagccctccacggcatgcccccggcctgagtagacgcatgcttcccccccctcggtgcctccaggactaattctgtctgtattttctttcctcccctggcccccacttcatgctgaccacacactctttcccgcgcctgttcttgacacaccaccccgtaaggactgcactgaccataggacctcggaaggcactttctgggagcagcccgagtttccccaccagccccacaggaagagacttttcagtatccccgaagtagcggaagaggacggagagtgctgtgggctgctacacaagcagggtgcagggccgtcccccagggccaggacggggctggccagagagcccaggcccggcaggccctacaggggcgacgaggcccctcggggctcctggttcccggtgaagcacaggggctcgggggccgtcccccacgtggaggacttccttctggaagacaggggctgtcggttcagccgctcggccacccggagcccggacagcggcctggactgtgggagtgaagaggacgagtcgcggtttggcttcggaaacaccgtggccgcgtgcagcccaggccctggtcactgtccctgcaggaggggcccgaggccgctgctggcccggcggcggacgctgacccggcagagcagcgtggaggaggactttggggagcaggtgggccctggtggcctcctcaggaacgacgacccccagcccggcccggagaggccgccccccaggaagcacggctggggcgagcccaccgagcaccaagattttcggggtgtctggaagaaaagcataaccatgcccgacagtagggcagctgccccccacgcaaagccacctcccagagtcgcacaaggccccctggtgtgtgacctaaacttccttttcacagccgcttgccaaaccaatctgtcccatcctttcactggttttctgtttgttctggtgtccatccctggggactctcttgctggctgtctttcgttttccctgcatttttgatttctcaagtccgatttgcttcccaaccttttgaccatgctgaagatttctttactgtgcttagagtaatgatttccaccccccagaatcagtaatgagtatggctgcttgaattaaaggacaactgaatctaaattttaattaagggttagctgaagtgtgattatctgaaagtttggcaacatgtttgtgttcacagggatccttagggatttatttatgactactagtattgtcgagggttttttttccttgttattttggagtttttttcattgctttctgacatttataaccaaaaaaaaaaaaaaagattgaagaaatctattttttttttttttttttttgcatattgtttccaaagttcttgtttttttcccatttcttttctgtgcccacagtttccagaacaaattttccatgatcagccttctccccgccggccctgccgtctgggcttgttgttggttttgagcatagggattcattgaaggcttcattcatctctatattgtgtcctcttttcggaacatttgctcctgtcatgctgaccttttcattgaaaacacaggtgagccatccacatggcgccaggccttgggtctgaggccgtgtgcttgcgatgggcccacccaggagaggtgcgagatccgtgcctcagtgactcagccgcccacggcagcccgcagcctcccctgccctgccacaggttctgcagcagacacgcctcatccccggactcccttcccaccattcatgcctgtgttcctgagaacttcctcactccatttacttactagcaagaagaaggttttgctgtgattgtctttagtcaatcctaaccctgatctaaaggtgaatttagaggtgaacttagccagaaaggagacccgtctgagtcctagaatgttaccagcattttcagattaggagtagaatgttgagttttgaagctgataaaatgtagaaacttccgtctttcagttttttgaaacctcacatacgacttttatccaagcaggacaggaggaactgcaacatcttccccactttcgtgacagctgggaggggggcatgtggagactaagagggactcaggtgctccaaggagccaaggcggggtgggatgtattcaagccattgtctctttggtcccaaaacatttgtcttcagcaccagcagcagcaaccaaaagagacccccccacaaggaattatttttgccctcaccccaccatgcgcccagcagcggctccgagtagacagtggggtgctggtgcccggctttgttctctcccaggccattcagctaacctttcagttaaaagctaagtttagttgcctttacagattctgcttttcaacccgcttgatttggctaactgaattcttcagttcccaatgctggcgagacttacgactttgttgttgttttgtctttagattttagggaacccagcctctgcaggacgggtggatcacatgggccggaggtttccccgtggcagcgctggtcctcagaggtcccggcccgtgacagtcccatccatcggttagtggccccatcatcgctgttgtgtctttcagccgcggagcatgtggctgcttactccatctaagcatgaacaaaactttaggagtagcattttccgctaagcaaagaacactgttattcatggcaaaaagaaggcaggaacagcacaagataaatgaaagctatttgtaagtattcttgaaatatcaaattggccttctacatccatgttctcccagctgattttttcctggagagcttcacagggtaagcactgaaggggggaccactttgtgtcacctccctcatcctggcatgggctccctgggacactcagggtcacagtccatggcaggtgcagaagctggatgtcagcgtgcctcaggggtctgtgagccccacccgagggaatgctgcctgtctgcagaagacacgctggcagcagagctaaatcctgggggacaccgtgcagctgagtgtgcccctgaaatgtgtgctccccacatccatctgggcacctcccttgctcatgagtcgtcatctggcattccgtttccattctcttcctgactttttggaattcagccagccatgctgaaagctatcgttttagtcatcctaatcaatccatggagggggatacttctattattggaatcaatcatggcaaggagaattccaaaaagtattatgcacaagataatggaagctggtcatcagcacagaggaaccaggcttctatgaaaacacacacacacacacacacacacacacacacatataaatgcagggagaactcttgatacagcagaaatagatgaggagaaaccgtcttggtttggcatgacagggctcaaggaggataacttctggatagtctaggccactgaaaagccacctggaatctcgttgaaatagctgaagtttaaaaggccattggtcttttccatcaattcaaaatgaagaaaggcttcataaagcaaaacagattctttgaaattgtgtcctgccagactttttcttccttgtacaattcaaacaataagaaaaaaattccatcttcacagcttttagattgtgtttatgtttctctggtaaaaatttcatgcaatgttaaagatccttaggaaaccgtattttcagttaactgagtaataaaagatgcagtcaggctcacagaacattgatggcacttattacagatcagctagcagggttagtggagcccagattcctttcgggtattctaaacctagtgtgtgtctctcaaatcttcattcaattcgtgtgtcgttccctctggagggactatggagcttaataaatcggttctcctggctttcatgttaaatgacctgtccgagatgtcctgccttgagaaacgatgtggggaaaaggccaatccccctgttcaaggctctcattctctctctgtggttagggtgagatttcgagtcttcatttgactgtaactttaatgagtgaagactgcaagcatggctcaggaagtgacctggggatggtgtagccgctgagaagttaatgctgtaggcgctcagaaaggacgtcctttggaagaggcatggtaggtcttctactccagtctcctaggactgagaactgaaaattgtgctgtgacaaatcagcacttgagccaggaagtccaagaaaaccaaccctgggcctgcagtcttgccagggtgaccctcgctgtcagagtctggtttaaatctactgtcctgggttgtcttgttgcttggacttagactcaatattggcttaaataattattttttgtctccgctttggtttgctattttcctagatcagtattgcttttcaaatggctgtatattgttgagactttttttttaaaactgcattcatcagcagtgagaagctttaaagttttattagtatcataaaaacccttcccaaatgaaactacttttgatgaatgtggttggatttttctgaagccgtagaattccaaaggctgcatgcgtgtcttaatttcagtagcacacttgttaaattgggtgaaagagcaaatctatgtcaacaccttaacaaggaaaaagcctctgaacataactcagaaaagagttaactgacaaacctatgataggtttgctttaattgtgctgacttcttatcatgtagcaagccgggacaccacataaaataactctaaccagatactttacacacaaatacacatctcagcacctattatggtttcaaaaggaaacagaagcggagggtgcttatcacccacctgaggaggaggaggactcggcaaagagctttgggaaatgaacatcagtgacagctgaacagacaggatattcctctagttgtcatttacttctatttttcttgtgaaaatactagaaaacaatattttagaaatctatatttcaaaggattacttatctttttcagaggaaattaagtctgtaaaccatacacttcctatttttaataagcagtggacctacaatgaaaaataatataaattttaatattttctggatttccaaaatttaaaaaatgtccttcatgattaaaaaacaaaattatgtggcttcaaatatatacttaattaggtttgatttttatcctttataacttttggtctttgcatttatctagttgttgacctgtcagacagaaggcctgtagcttcactcttctaaaaccgaagcaccacgttcaagaggattctgttcttaggaatcaactctgaatatctcctctgtattctcccattttttgttattttggctactgagcctacaaagtgaggaaagtccagcgtgttttctttgtgtccagggaggaaaaataaaaacattagtaactctattgacaaagctttgccccttaaaaaggggagctcttttcttcaggtttccctgcaataaaaaaaatcaaaagctgtcaactctgtttaatagatgattccctttatctccatagaaattacaacggacagtagcagtgagggcagtcggtctgggccaggtagtgagggaaacctctctcctgtagaagacggtgcttattcttatggcaccagtggatttgggagcccacccaggcgtccaggcatgagccctgatctcccacacgatatgcacacccttcctcctaacaaagaccccttgggccagcacacttcctcagcaggatgggaggcagtgcccactccccccagggtcagacagacagctgtaggtaagtgcttctttcagtctcgcctgccatcaccaaggacaagggacccccaactgcccagtccagtctgcagtgaagccaagtttccatggacacattccagggaggctgctactctttccctgtcgaggtttggtgctcataacacatccagtgcatcctctctggaagaacatacggtggagtcaccgcatacgctgattttattcacatacgttcaactccaagtgctccacccacctctaccccacacctgtcttccccccaaaacaacgtgacattgtgggcagttctctggaaggagccttcgttgggggactggcctcaggcagctctgtgttggggtgtctgcctaaatgcctcccgtggtgtggccagttgcatggtccatgtgagtttggacttgaagacacaaagatgttttcacagatcatggtccttgagtataagccacctactgagaaaatgcactcttacgtaggctataggagggacctgaaagattttcaaggggtatgttgaccacacccaactctctctagaatctgaccttagcccctgacccctctgcacgttttgatgccacaaacttgccacataaactcagctgggaagtgctgagaacttgcttggaaaatggtgtagccagaggttctcctccactggcatttttccgtacctggaactgcattcactagatcacactgacatggtcattaagttcctccagcagatctccagcagaatggaaagcaggcgtccttctcatgcagccacagctgttctccaccatcatccctgggtgtgagcaggggctgcacagctgtgcctgttgtagaggccatggagcgcttcacattctattgaactcagataccacttgaaactagaaaaaagtcaggttttttcatggactatcaacaaaatcataacagcctggagaaattaatgaaggctgctgtggaaaaggtttgttccctggcagaaattactgacattttagattaggcattcaaaaaagactctgaatctcaataatgtaaacaattcattgcattttaaaattcaacctttcctgcagccaaagtgcttttgttagactgcgtgttttattttttctggtgaaagaggccaaacggtttggttctttctccaccacctgtcctgtctcttctgcatacctgtgtcatctcgtcccaccacctgtgttcctcgtgctgggacagaagctcacactgggctgcttctcccaatgctgctctctcagctgccagctggcgtgtttctcacttgcttccctgatggtgttgtgagaccacctcccatgatcagaccaatattatctgtcagttccctctcccctcccattctctctccatacatatatacacatatgtacacatctatctaatgatgtttagtgatccacatgtatatatatgcatatgtattaggatttccaaaataattgttttgatttcttaaaataaactttcaacttttattttggattcactggggtacatgtgcaggtctgttacatgggtatagtgcagaatgctgatgtttgggttacaaatgatgccatcatccaggtagtgagcatagcgccccgtcaggagtttctcggcccttgccccctccctccttcaccatctagtgttccccagtttctgttgttcccatcttcgtgtctatgtggacccaatgtttagctcccacttataagtgagagtatgaggtatctggtgttctgttcttgtgttaattttcttgggatgatggcctccagtggctgcagaggacgtgattttgttcatttctctggctgcatagcattccatgtggtatacgcaccacatctttattcaatccactgttgatgagcatctaggttgattccatgtccctgctattgtgaacagtgctgcgatcaccatattgagtgcctgtgtctttttggtgaaacgacttcttttcctttgggtatatacccagtaatggcactggtgtgtcaaatggtagttctaagttctccaagaaatctccaaactgctttccacagtggctgaactaatttccgttccctccaatggtatatacatttttaagtgtttcttttctttgcagtcaccccaacgtctattttttgactttttaatcgtcattctgactggtgtgagatggtatctcattgtgattttgtcttggatttctctaatgattagtgatgtggagcatttttatttatttttatacattttttaaatatattttttatttatattttattatctgcttgtatgtgatcttttgagaagtctattcatgtcctttgctctttttaatggagtcattttttgcttgttgatttaagttccttgcagattccggacactagacctttgtcagatgcacaatttgcaaatattttctcccattctgtagggtgttgttcactctgttgatagtttcttttgctgtgcagaagttctttaattaggtcatgcatgttaatttttgtttgtgtggcaattgtttttgtggtcttagtcataattctttgccaaggctgatgtccagaatggtatttcctaggttttcttgcagtatttgtgtaatttgaggtcttacgttcaaatctttgatccaccttgagttaatgtttgtatatggtaaaaggtaggagtccagtttcaatcttctgcatgtgactagccagttatcccagcagcatttattgaatggggagtcctttccccactgcttatttttctcagctttgtcaaatatcagagggttgtaggcatgtggttttatttctggttctctattctgttccattagtctgtgtgtctgtttttgtaccagtgccatgctattatagtgactgtagccttatagtatagtttgaagtcaggtaatgtgatgcctccggatttgttccttttgcttaagaccacttcggctatttgggctcttttttggttccatatgaattttagagtagtttttcctaattctatataaaatgacaatggaagtttgatagaaatagcattgaatctgtaggttgcattgggcaatatggctactttaatgatattctaacccatgagcatggaatattttagcattcatgtgatctatgacttctctcagcagtgttctgtcgttctccttgtagagatctttcacctccttggttaggtacattctgtgtgtcttggttagatgtattctgtatattttgtgtgtgtgtgtgtgtgtggctattgtcaatgggattgcattcatgatttggctctcagcttgaacaatttattggtgtatagaaatgctactgatttttatacattgattttgtatcctgaaattttattgaaattgtctattggtttaggagccttttagcagagtcttcagggttttctaggtttagaatcatatcatcagtgaagagagataatttgacttcttatttcctatatggatgccttatcatcagtgaagagagataatttgacttcttatttcctatatggatgccttgtcatcagtgaagagagagaatttgacttcttgtttcctatatggatgccgtatcatcagtgaagagagataatttgacttcttatttcctatatggatgccttttatttctttctcttgcctgactgctctggctatagcactccagtgttgaacaggaatggtgagagcaggcatccttgccttgctccagttcttaaggtgaaggcttccagcctttgcctgttcaatatgatattggctgtgggtttgtcacagatgcctcttactatttttgaggtacatctttcaatgcctagattgttgagggtttttttaatcatgaagggatgttggattttattgcaagctttttctgcactattgagataatcatatggtttttgttttagttctgtttctgtggtgaatcatatttattgatttgcatatgttgaaccaatcttgcatctgagggataaagcctacttgatcatggtgaattgtctttttgatgtgctgctggattcagtttgctagtattttattgaggatttttgcatctgtgttcatcagggatattagcctgtagttttctctttttgttgtgtctgtcagatttgggtatcagggtgatgttggcttcatagaatgagttagggtggagtcctttctcctcaattttttggaatagtttcagtagaattggtaccagctcttctttgtatgttggtagaattcagcagtgaattcatttcatcaatattggtctattcagggtttcgatttcttcctgattcaatcctgggaggttgtgtgtgtctaggaatgtatccatttcctctagtccaaaagaaccacttttggaagctgggtggtatatggagttgaaacccaattcaccaggaaattattaattcactgtaataaggatgcatttgttgccagttacatatttacgtaagtgaacagttggtcacctctatggactttgactaacatacaaacattttaaacgtgggctgtgcttagctttccattttgcagagtgtgtgggtcctgggaaggctccccagcatgggccatcctgcccctggcacggccgcagcccctgccccagcctgtgctctctgaggaggcccccgaggcccagccctgtctcaatgctttcacatgcagtgtggccaggtacagagtgtggctgtggttatgtgcttctccaattcatctgacctagacctcccgatctatttccacctacatgttaagacacaaaaaagacaaaagtcaaggaaccgctgccatcctcactgctttccaaagctgcatttcccgtgcacgctcctcagttaggctcactgccgctctgttcttcacccccacttgctcgcagacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtgcgggatggctgcctgcgggcggcttcatcagcccctgaggcgggtctgggtcatgggggcagagactggcaacagggtatcgacttagagatggccttctcctgcaggccatgggcgaggcacgggaggaggtggcatggtgctgtgacggcaagggccctgccctctgcaaagtgccttctccagcatctgcccggtttgtgtgcacacaaacacacccaaatatgtcctgtgaactctggattctattagggcctacgttgttgagaaaaataacacaggctccaaattttaaaacaacacttgtcagtcagcagacaggcagggaagagaggaaggagggagagggaaagggagggaaaaagggaagaagggagcatcagcagctagaggctggagttccatgccttagttctttaatacacctgatggaggttgtttcctatccctttggtacccagttccttttttttttttttttttttttttgagacagagtcttgctctgtcacccaggctggagtacagtggcaccatctcagctcactgcaacctctgtttcccaggttcaagtgattctcctgcctcagcctcccgagtagctgggaacacagatgcgcgccatcacacccagctaaatttttttgcatttttagtagagacagggattcaccatgatagccaggctggtcccaaactcctgatcttaagtgatctgcccgccttggcctcccaaagtgctgggattacaggccgtgagatccagccttctgagaggagaggagccttgtgagtctcaagtagggaaaatgagagaaagtgtgctgttcagtaggagaggggaaagaaagagggccttgaaccctgtttgcagtttcagcaagggtcctgacagttggcatttgagaacggtcggaatgcctgctatgtggcactatcttgttacgtaggaacccatttcaggcagacagaaacaccactttgtgcagcctacctggtccttcttggtagagtggggtctcatcacacacccttttaatgtgcgtgaatttaaataacatgcattcatccaagcaaacaccctgcctgatgagaagaatggcaggttgtccaaacactagatgaaaaactggctcttaagtcagagtcatagagcgagggttacatgtacacatccacagcacacacgtgggtgacctatgcaggtgatttatggtatttttaaactatatttaaaatatattttcgactacactcacttaccgtcagtgggactattgtatttctgaaccaatcaattacagtgcttgatttattttcccccttggctctaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaataggtaagcgcaaacccctattcgaccttccctgtgcattttatcccacaaaacacctgccgctcagagaggcaggcggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagatgatctaatgggcgatgaagtaccgtcttgcttgcaaacaatttatcgcatctagaaaacacatgattagctgctttctggtaatacggtttgaacatcagcctgtctacaataaatttcagtgggtggttggggggccgctatgcctttcattctttaggtgacctttgcttatccaagaggcacaagctcttttctctttagtttgggtagacatgaaactccttcatttatcttaagccagtctgcaagcaccagtgagaatgcagcaaaactattttcagtgattttttaagcaacattacatttatgagttttaaatttttttccacgtgcaataacaatgtcctcattaaaaaaagcctctgtagtctcaaaaaaagcctctgctttttctaaaaagctgtagagagatatcagttttatatcattcatatttaaggtttaatacttcaaaacttgattagcttctaaatcagacttcaaagacaaaattctgtgcttcaaagaatatacataattttaaggataatcacaaaatcaaaacatttcaaccttttttggcattaataaacgcattgtttcaagacagaatccacatctaatagtcgaagtttagtgtgaatatatcgcccacattaaatccatgagatcgaagatctttgagccctttatcccctctactcacttttgttaagatctcctttcccgaagttgactaagactctttcaaagagagcacaggccctgtacaccacagacccagaaagtatacaagaatttctgttaaggaacggtaacttgatttatcagttagattaaaattttttatgctatttttctaaatgtcgatggccaagggaacctagcctgatatatctatgtgccccctgccgcattgccagaaactatcatccttaatggtgaaaggctgaatgtgatcctcctaataccaggcacagacaaggatgtcggccctcaccactccttttccacatcatactggaggtcataaccagggcgacatggtgaggggaagtcacacctggtgtacagactggaaatgaaggaatacaactttttctgttcacagatgacatggaaatctacttagaaaatctcaaggaatctcaaaggataaaaaagttcctagaactaacaaatggagtgtagcaacatcaatggatacaaggtcaatatacaaaaatcagttctatttccatatgtgagcaatgaaaatttagaaattaaaatttttaaaagtagtgccgtttacaatgacacaacaaaacatgaactacttagcattaagtctaacaaaacacgtgcagtatttgtatgccgaaaatcagaaaacactgaggaaagaaatcagatacctaaatacatggacagagagatcatattcatggacttaatattggtatgtcagctgccccaagtgagcctacagatgcagtgcaagaccattcgaaatctgtgctgggatttatgtagaatcaacaagctaattctaaaatgtatatggagaggcaaaggaactagagtagccaaaactatttttaacaagaacaagaagcttggaagattcacataagctaattgcaagcttactactatagaggtatgctaatcgagacaacgtggtattggagaaaggatagaaacatagattaatggggcagaatgaagtccagaaacagaccaacacatatggagtccactgattttggacaaaggtaaaaaggcaattcaacggagaaaggatgctcttttcaatcattggtgctgacattactgcacatccatatgccaaaatgaaccttaaccacactctcaccatattaaaaacttaaataaaaatggatcatagtttcaagtataaaaattaagactctaatatttccagaagaaaacacaggagaaaactttataataatcaggcaacgatttctttgacaggacattaaaacatgatacataaaaggaaaaagtcaatgttaggcttcaccaaaattaaatactctgcacttaaaaagtgcagaataaaaagccacaggctggcagaaaatccttgcaagtaaaacccactggaaaaaggatttgcattcagaatacacaaagacctttcaaaactcatcaataagaaaacaacccaataaaaatatgtacaaaatatttaagtgacctttcgccaaagacgatatgtgggtggcaaataagcacatgaaaagatctttaacatcatcagtgaaacacaaattaaaaccaccctgagaaaccaatgcacacacactgagaatggctaagattaaaacggctggccgtcgcaggtgtgggcacaaagtgtgccaggtgggcctgtgcatgctggtgaaagtggaaaatggcatcaccgctctgcaaaacagttcgctggtttcttgtaaagttatatgtgcacttacaatacaatccaacaacttccctcttatacacttactcagaagaaagggaaacttacgttcacacacaaaaaaactgtacatgaatgtttgttaatagtggtttgaccaacggtcatcaaaatctggaaacaactcaggtgcttttagctggtgacagaaacagaacgaaggcgccccacacaatggggcctactcagcaatggaacagagccactgctaatacagccagtgacaggggtgaatctcagaggcgtcatccagatgaaagaagcctgtctcaaaagctacattctgggccgggcgcagtggctcacgcctgtaatcccagcactttgggaggccgaggtgggcggatcatgaggtcaggagattgaaacatcctggctaacacggtgaaaccccgtctatacaaaaaaatacaaaaaaattagccgggcgtggtggcgggcgcctgcagtcccagctactcaggaggccgaagcaggagaatcgcatgaacccgggaggcggagcttgcagtgagccgggatcgcgccactgcactccagcctgggcgacagagcgagagtccatctcaaaaaaaaaaaaaaaaaaaaaaaaaaaagctacattttgtatgagtcccttttagtgacattctggaaagggtcaaggtctgggacaggaaacagatctgtggtcatctgggctgaagtgactacagaggactatggccggtctatatcttgattgttgtggggtttctggactgtgtgtgcttatcacaacgtaaagtactgcacgctgggaagagtgagccttcgtgtatgtaagtttgacttcagtgagaagtacatgtatgttgttatgccacctttcaaaagtcatacttgtaacattccctgtaacatgaataatgctgagaaacacgaacctctggaggagacacacatgtgcaggtcctgcagaggacacatgtgcacagaggcgtgtgtgcgtcctgtaaactacagcagtggctcctaaccagaacccaaggggagagtaatcgctggaatgttgcagggctacacagctggcccctgtacctgctgaaaaccactgaaaagccacatcgctgactttagttgccgttgagatatttgcctttgatagttttcatctgtatgtttggaattccccaaatcaaatgtaagcaaaaagtggctgtgtttagaagaaacacataaatgccaactttcgccaggaggaaagtccttcacagccccaccccttcagtctgacaggggtttcgtgattgggccaggttctgcggctctgcactgaggcctccttacgtcctgagagtgttcacctgttatctgtgtggagcgctcacgctgggcagagcctagggcaattcctctgcagccccttcttatgcttctgagtgtgctgggatgatgcccaggccccgatctgtggcagagacagagccaggccgtgggaatgcacctctaagtcgactgtgcagagctgggatcttctctacggccgctgctaaaccacaatggaaggatgccagggaagcagcatgagggaagccactgggctgggtggagaaggcatccctgtttatgttcgtgcttctcctgaggacagtgccttagttttgcctatgcttaggggagcatgacttgattttgtagcgccaccatagttacacaaacaggcacttttaaaactgtgtctatggggccttcccagagcaatgtcacaaccgtgcactctgcagggcctcccaagccacggcctccccgtgctggccaaagccgtctaaatttgctgttcgagagccccgtgcttcatgtgagtctcactggtttaatggacagactggaggaaggaaaaggttcatgttagtctaagggggagaaaccatactacagcaaaaatataagaatatggagtcccagaccactgacccaaagtagagacgtttgctgatgtgagtgcccaggagcacgtggccctgttagcagtgccaggtctcggctgtattggccatgtgtgacccggaaggaggggaacaccgctaagtttgaaataacctcatgatggatttctttcccccttgtgatctgaacagagagaagcaggagaagtggcaggcgtcattcggtatcgacgcggagaatggtggccctgtatgactacgaccccagagaaagctcgcccaacgtcgatgtcgaggtaccagccaaacactgcacttcatgacggacacaaccacacccttcccttccctcgtggtacaccacactgaggccacgtgtgttcacctcctcattccttctctccgaaccatccgtaggaagggctgccgatccgagggatggctgatacagacatggccacgcaggagagaaatcatgggattcccagggacatggccagcccctgacaagccctgtccccatggcccagattttcctgtgccatgacagaaagaacaatctgtcatccacatctaatggtgatgccacctgagggccatctttaggagagaaataaaagcccatcacatgtggtcagcaaacaaaagcaaagcagtcaggccccacacatagaacagtagagaggaaaccagtgataggtgaggttgtgtcgcctggcacagcttgggatgcctggtgtcttgaaggctgaaaccactgccttcagaaatgagaggtggggtctccagtctctgcagctactagctgagatgacaagatgtatgtgaacccatgttacacagtactttgctctgacaagccactggctcaccaactatattccctcattttgacatttagaaagaaaatgtgtttggttgtgaatattgtctagatttctgcttccatgttctgctgggtgactgggaactgaaatgtgctgggtcagttggacccctgagggcagtggggcgtgtttgacaccgcctgctttggggctgcagcccggcccatcgtagacactgaataaagagatgtttaggctgggtgcggtggcttacgcctgtaatcccagcactttgggaggtgggcagactgcttgagatcaagagttcaagaccagcctgggcaacatggcaaaaccacatctctataaaaaatataaaaattaaccaggcttggtggcacacacctgtagtcccagctgctcaggaggctgaggcagaacaattgcttgaacccgagaggcagaggttgcagtgggccgaggttgcactgctgcactccagcctgggcaacacagtgagattctgtctcaataaataaatagatgtttcattaataattgagtaggttttaaaatactcagtgaaaggatatttacgtaatggtccttatactgcagagaacatttccctaatattccaggtttttacaattaaccatttcactagctttaaaaatgtattatcagtagaacatggtaataatcttgaattttggccaaaatcaaagcactgcagcattttccttttaggtgcacattatcttggtttgttcttactttctagaagactgtggacagagccattcattagcttctacctttatttgactgaaagagtagattaataccagaaattctcaaatagtaagggaaagcatagagaacttatttttaaaaaactactactgttgtgtagaaaaatacgattaattttatgtttcatctccacaggccgaacttacattttgcacaggagatattattacagtttttggtgaaattgatgaagatggattttattatgtaagtttttgaaatatcaagaagtaccatttgatttttgtattttcatttattttgtgtgttttgttttgctagtccgttccttctcttaaaattgggcatgaacgtcatacgcctgctgatagctttgcttaattggctgagttatagaactttgctgagttatagataatctagaaagttgggactgtgaacttcattgtttcttccttgctaatactagtgttttcaatgtatatgcactgtaaacaaaacaaatacattcatattcttattttttaaattgctgccacccaaacatttacaaaacaatttaagtttctagattacttaactgtataggtcaaaaataaattttaggaaaaggaagaaatacaaataagcaaaaacaaaacaaaacaaaaacctaaaaccccacagattttaggacttctcccttaccttttttctagagccaactgctgttagcagcttggaaccccccaccccgcccccaccccttgctgctggtgattcctggcagggacctcagagccaccctccctccttttctgttcccctggagcatgtcttgaatactccctggggcaaagggagggaatggggtggggttatctcagagtttccgcagctggggcatctttacaagtagctgcccctccctgaccagaagcccacagggccacttaggaccctgcgcagagcccagtgggggtccccaccttgcacatgtgtttccacctgctcccccaccgcctttatcagaatcggcaagaactgatgacatcctggacggtaggtttctcttcaagtcaaacatgctacagccgcaggcatgtgtaggattcccaggctctctcctctgcctggtttctgatttgcctttggtgaggatattcatactttgtcacatgtgtttcaaatagttctttccagctcaacctctgctttttaactttgtgtgtgtgtgtttgcttctccatttttgttgtttattaaggatgaatttcacgtttgcatgcggtcaaatgtttctgccttgggggtcatgcctaaaaggtccttcaaggtgatagaaataatcacctcattttgtttcaattttatagtttcactttccacatgtaaatctcaagtatctaccattttttcctaactatgagaacaaatgtctcaacacatttactaaataatctgcactttccctactttaaaaaaatcattttttaataataaaaaatgaatacgttttaaaattaaagtgtaaataggaatttaatacttagagtatttatggactttaacactactccatgctgtcttaattattgtatttttataatgcatttttatgtttgggagggaacattttgtaaagagtcccacctccacaacaaacctatacttttttgtttagatgtacatttagcttttggaagaaatagacataatattgtctttcaattctgacatagcatgcgcctcctcttaaaaagtttttcctttcatctgtcagaaaagattcatagatttattcttacgcatcctttatatatcttaagtttactcttaggaactatatagatccaacggccgggcacggtgactcatgcggaggctgaggcgtgctgatcacctgaggtcaggcattcgatatcagcctggccaacatggtgaaaccccgtttctactgaaaatacaaaagaattagccgggcgtggtggcatgtgcctgtaatcccagctactttggaggctgaggcaggagaatcacttgaacccaggaggtggaggttgcggtgagctgagatcatgccattgcactccagcctgggtgacagtgaaactccgtctcaaaaacaaacaaaaaggaattatatagatcttattatgattgtgaatgatttttccccctagcatatattccactgttatttagaaaacatgttggaaaagtgtgtgtgtgtgtacatgtcccccacaaatcatttttctgaatgcatttatttctcttatcaaccgattcccttgggttcccacagattgtcattattttgcctcctcttcaccaatatttataatttgtcatcatttttaattgtcttactaatcacttagaacgattctgaataacagagataaggaaatctgtgactcgttatgtattttagtaggaataccactcatattttacatgttatatgtaggttagactatcagtaaagatagatggtctttataatacggagaaagtatcctttataatgctaagaaagttttagtttgctctgcttatttttcatcagtaaattactggccatcatatataatatttttaaggcactggaagttgatttgctaatattttattcagaaattatattccagaaataataataatctgtattcattggaatacctttgttgtagcttttgataccgggattatgctagaattaccaaataaactaagaaaatttcaacctttttctatgctttagaggagattaagtgacacagcaattactattatttgaaggttattagaatctgcccagagagagatcctttaggttcagtatctttttagactgcagttgcacaaaagtttttatttgcttaaatggttatcttatcagtttttaacaatctacatatcttcagaggaatgtacttttcatttagattttcacatgtagaaacaatgggctttcctggaatttaagaagatttttctaatttgtctgcatgtttctattccccagttatgttttatcttcttagtttcttgaatagtcttccctaagtttttatattatagtgggaatcagatctaaattaatatgaaacgtatgcttctttttatttaccactcctccaaatggttttactatgattttgctggtcatgttcactgagcggactgcccagttcatttaagtatttcttatttgataaacaatgacaggggacacctaatttgataccaaaaatcttaaatttcttggtactttgttttgatatctgtaaccttaaacatctcgagagagcgaattcaaatactccaccggtcctaatattgtaatatcaccctcctctttctctgttctgctatatcccatatcagtaaaacaagcgtaagcagggacccccgagggactcctgctgtcctccctggccttttcctccttttgctatttcataatttacatcagcccccattaagtcactgaagacttctaacaccccatcgtgttttaaagcgtgtgctgttcttgctatagcccagcatctcggtatctgaaaccttaaatcctgtaccttcctatgtcaaaagcaagccatcacgtggcgtactaaggtacgggagataatccagaggagtgtgcaaacacgagtggatgtctcactgactggggcacagagaaaactgggaggggatcgattttggtgttttctgcctttcagcctattcccattctgtctggacattaggcctccaggtagttactgtttggccgcaaatagagaaatggtgggaaatgaggcgtaggagagaagcagagatcaaattatggagggactgaggagggaaaggtcaaggtgaaatttttttagagaaagttattctgtaaagggttttgatggtacacttttgaagggggatgggagtgggtccaggaggctgggaaacatgctatatggaaccctccaggcaggaaacatggcccgaaatacgtcagtaccaggggaaggcagactcaagatgatcttatccagcgttctgactgccagtcagagggacagagaatgtcgtctgggggagccttcgattctgacctaggtgatgggtgcccttgagaacgcaaggataagaacaacgttgaatggaaaacctggcttagaaactcttgagcttgaggggtgtgaacaggacctctgagcctctccaaacagaacggaacttaggccaaagcagtattcacaccgcgagcaagtcccgtcgtcactttggacgcagtagcacgcagtggtagaggcatcagacatggggaagggagtgacatggtacatgtgcgttctgacgtggattttactagggctgtgtgtgttcagcccaaaagaacaagagcaataaccagtgcaggcagttccacccacattctactcagccagagcaggggctggcctggaggcctggctctacaggagcctctgcaggctggggtacacacgcctcttgtggtgtgagcatgacaccagcggagatgtgtgcataacattgtgtgtgttcacagaacacactccccaaatataagccaactactccatctggtgctcagccagaggaagaatcttttctaaggctggcagagaaatctggctgttggacctaatgaggggggacttgactggttataacttttgagtgtcttcgtatttagatgttattaaaaaccctcgataggaagaaatcgccaggggcacatgcacagtaaaaaggataggtggcctagaaatagtctgtaatgtcaacagagaaaaataagctaataatggagccggtgagagaaggcccagggcagtcacaggtaaataagagtaggaccttcaaggtccaagcagaagagtggggcggggcagggcagtgagtgtgcacctggcagcgttgctgaacaggaagatgcaggaagtatgtggggctgcctcttccaattaatttttgtgataaaatctacataaaatttatctaaaattggccaggtatagtgcctcagcctgtaatcccagcactttggaaggctgaggcgggtggatcacctgaggtcaggagttcgagaccagcttggccaacacggcgaaaccctgtctctactaaaaatacaaaaattagccgggcatggtggcatctgcctgtaattccagctacttgggaggctgaggtgggagaattgcttgaacccgggaggtggaggtggcagtgagccgagatcacgctactgcacttcagcctgggtgacagagcgagactctgtctcaatttaaaaaaaaaagatataaaatcatttttaagtatatagttcagtagtgttaagtatgtttacattgtgcaaacaatcaccaccatccgtctacagaactctttccatcttgcaaaactgccatcttgttttcaacagcagctgcaccatctcaccttcccaccaaaagtgcacgagtattcgtttcttcatatcttcaccagtacctgttttttccattttgtttttgatagtagtgtgaggtggtactacatggttttgaactgcatttccctggagattcgtggtgactggcatcttttcatgtgcctgctggccacctgaatctcatttttggagaaatgtctttaattgggttttttgatgttctttatatgttctggatattaaccccttagcagatagatgacttgcagacattttctcccattccacaggtactcatcactctgctgtgtccttcactgcacaggtgttttgatgtagtaggctctttatgtcatttcctagaccatataaacagagaaacaggattccgtgttgcccagagccagccaattttgaacttggtttaggcactttatgggcagatgagtttggggaagaagtgacgtggtaggcctgtgagccacttggtgcagatgaccagcaggcagatggactcatggatctcgactttagacaaggcatagatatgtaaatgagtagaaagatctggaaggatatataccaacctgaagcagtaatgtctgaggaggttatcaacagacactttcattttctccatattgtttgaatgtttacgataataacctatccatgagtaagagggaggacagtcttaaggctgagtagaccagtagcgctcaagcttgctggcatgttaggaccaccaggtccccaccgtctgaaggtgtccatcattggtctgggctggtgtgctgagcgatgtgtttttagcagctccctagtgcctcagatcagccaggcccgagaaccactaaatgagatctgccaaggagtgtttccttcagaagcctgatcctaagaatcccaggggctctttggccaaaaggcagattcctcagctcctcactgaacaggagaaatcaagaccccaggaaaggggcttaggactctgcatgttgctgaggaaaatttggaaaccctgatttagagtcctttcaagtcctgccacttttgaaccagaataaactcaccatgtacctgtactctgagctgtattcctttagccaaagcaagatgtgggtttctagaaaaataaatagttcttctgcctcacccctggtgttttagggggagctgaatgggcagaaaggccttgtgccctcaaacttcttggaagaagtgcctgatgacgtagaagtctatctttctgatgctccatcccactactctcaagatacgccaatgcgctcaaaggcaaaaagggtaagcaaacctatttagcctttttaatctctgtcccgttctgccatatgtggtctaatacaatctttgcactgatatttttatatcttgggccgaaaagcgtaaatacaccctgaattttttttctctgccctgaagccatgggagttgtacctaaaaattcttaattctaaatcttactcattttacaaaaaaagaccctttcaattctaatcaatcaatctgcctttactcacaaagaaatgtcccatcctacattatagaagcacatttcagtttgatcaagagtgaaaaggggatggctcctcttcagatttggtgggcaatggaggttatttgccctctgttaggactttagtctcttcacaaggatccaagggcttctcaagcatattgaactattagactacattcatgtttagtatctcatttttattttatttcatcactgcaagtttttctatattatatttttatatatatatttttatttctttgctcatctgcttggaaacagaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggtttgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttatacaacactgtttattctctttgttttaaatattttatcatagcgggataactgacttcctttctcttaatgtttacaaaaagcaccataaccttaccgtttctgggagtatttttttttttttccaaaaataattttggtctatgttttgggagccattgacaatgttgtgacactctcatactaccagtaacagtccagtcagtgacaaaaggtcattcgcacggagtcagtataagcactaccaggatgaattcaaacacaaattgttaattccctctggcagctttagaattcaagtgaaattaatgaacggctacagcaacataatacaacaaaatataacttcccaaatacatacaattttcctaaaagccttattttagaattctccaagtaaccagatgatgtcttttcaaagaaagaggtaaaaccaacacacttacggcaagatgaaaatatagttcaagtacataatttcatgaacctataatttatctcataattgctaccataatatctttttacctacagtatttacaggaaaagttgaagagttgctaacaaaaagtatccagaactaatgtttctctaaatcttttgaaaatatttaccaattccccaaagtatgaaaatgtaggcaaacctgaagtaataatgagctggtcttagcttttcttcccccctattttataagtaagtacaattttcctaaaaccaaagcacccaccctgaggacaagaaagtgcttaagtcacatttaattactcattccagccccaactccctcccagactgagctgagagtcacttcagcaatctcccttttctggtgatgataagagaaaaaccatgttttgcttttgttttatgaccgaaaattgtaccaaacaagttaggaagctctccattaccagtgtgagtgtaattttctgtcttcacaggttagtctaaaagtggaagcccaaactgtacagagtactcaaagaacagaaaccatttcctcttgcagttaaatggctccaacccttcctcccgctgcttctaaggaagtggctgcagccctgacccatgagcgcctccccacattaccatccatttgcctctgctgctccccctcccctgccaaataaaacaagtgattctttcgattcagaatgaccctcccattctcatcctgacctgtaaaggcacaattttcattgaacaacaaacaactatacctaaattcttaatttcattttctgttatgactttcctatgtatattcaaaatgagaaacttttgccaaatttcgttttgcagttacttctcatgcacataaacatttttctatcctctcgctaacacttttcaaataaactatttgcttaaactagaacacaaaactcctgtgttccaccaagtgagctttactgtattttcttattcttgaaaattatttaaagctgcactcagaaaaaaaaaaaaaaatgcaaaaatccccaaccttccagaaatttctacggtacttttttctgtggccccgaggtagaggcagtctggcagtgacgaactgggttcttgggaaaagttctgctaaataaagcttgtttgcaggtatattggaagcttttgggaaaagaaagaaaactacattgaaagcctcattcatattaaaagaaaaaagatatacttctaaacatttttaattttgaaaagaaaaccgttttatgtgaagtgctctttcatatgggtaaagaaaaaatacctagctatcccctggctggctccgtgcacctccgcgtgcaagctcactgttgcagtcggactccaggcccttgtgctgccagctggcgcagccccttcctgcagcccctctcatcacagagaactgatgcctgggactaccaaacagtatatggagcttatggtagaacaacaataaccaaagtctctaaaaaagaggatgaatcaagtgtcaaagtgaaattaagaatacgaaagaaatccgaccctatgtggaaatactccatggagcaggaggagctatgcagagagagtgccgagaaggcccaggtacaggctttccacccacatgcatggtaggggccttctctacctttagaaccttaccccaaagacgtcaataaggaatccgtaaaatacatacagcaaacacaaaatgcccaacttcactagctgaagaaataaaaactaataatgcaaaatttttctgctccaaagttacccaaaagccaaacatgaaaccgctgatattggggaggatgggagctcctgccgtgggggctgcagtctctatcgtgtgtcttacgcacttggccaagtgactttctaaagccttgaacgtgtgtgtttatgtcctttaactgaatctcatttctaggaatccaactgaaaagagatatctaggcaaggatttaagaactaagaaatgtatcacattattataatagtgaaaagtggtaaattcacaaaaaaatccaataccggtctagtgaaatcatagctattcatcacaggattcaacattcaccaggtaactgacacacacacgtgaggatggtgactgggtcatcacaacattcagtattcaccagaactgatgcacccacgtgatgacggtgactgggtcatcaccacattcagtattcaccaggtaactgacggacacgtgatgacagtgaccgggtcatcacaacattcagtattcaccaggtaactgacgcacccacgtgatgacggtgactgggtcatcacaacattcaatatgcaccaggtaactgacggacacacgtgatgatggtgaccgggtcatcacaacattcaatattcaccaggtaactgacgcacacatgtgatgacggtgaccgggtcatcacaacattcaatactcaccaggtaactgacagacacacatgatgacggtgaccgggtcatcacaacattcaatactcaccaggtaactgacggacacacgtgatgatggtgaccgggtcatcacaacattgcaatattcaccatgatgaactactgcatgaatgaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaagagttcatcagggtgggaggggtggatgatgaaaattacttaatgcggtatgatgtataatattctagtgatggttggctgggtgcagtggctcacgcctgtaatcccagcactttgggaggccgaggtgggaggaccacgaggtcaggagatccagaccatcctgaccaacatggtgaaactccatctctagtaaaacaagaaaaaaaaaaattctggttatgctagaagctcaggcttcactacacaatatatccatgtagcaaaactgcacttgtaccccttaaatatatgcaaatgtagcgggaagtgtgagagtccccatggctttgtatcttcaccaactttggtgctgtcaatccttctctatggaagccatcctggtgtggcacagtggtgcctgcagaggcatgaacatagctaagttcacccatgtcatagattctgtccttgaaaagccacatggtggtgatttcagagattccggcaggtatcacttccatgagagtccaaacccagacacctctaggagttacgtctaagcaaagcagcctggctgaagatcatccatggtggttaggattggcacaaagaggagagtgtctatctgtctaggaaacggtctatcactcagctccagctagctgtggtccatgaggaacatgggccaccactattggggccactattatttttgaagtgaaaccaaatcaatatttttatgtaaaacatccccacctgacgatgctggtgactaaggaaagcctgtctgaagcccacttgaggttcaccggctgccctttagcaagctcacgtcagacctttgctgacctctgatcgctggccggctccctcagcaagggctccggagtgtttcagcttcccccttagtgagcagctgctgctctgttctctggggctgatgaatttatgataatgctttgaaaaaagaaccttaatcagctgggtgcagtggctcacgctcctaatcccagtgctttgggagtccgagatgggagaatcacataaggccaggagtttgaggccaggctgggcaacatagcaaaacccagtctcaactaaaaaattaaaaaaaaaaattgtttttaattagcagggcatggtggcacacatctgcagtcccagtacccaagaggctgaggcaggaggatcgcttgagcccaggaggtcaaggctgcagtgagccaagatcatgcctctgcacttcagcctgggcaagcaacagaatgagactttgtctctaaaaataataatattaataacaacactgcacaagtactaatctaagcaccattgcatagactaactcatttaatccttgcaacaagcctgtaaaacacagctctctctatatatatacacatagatatacatacatatacacatatacatatatacacatatatatacacatatacatatatatacacatatacatatacatatatatacatatatatacatatatatatatatatatatatatatatatatatatatatatatacacatatttttttgagccagggtcttgctctgtcactcaggctggagtgcagtggtacaatttcagctcactacagcctcaacctcctgggctcaggtgatcctcctgtctcaggccctccaagtagctgggactacaggtatgcaccaccatatccgctgattttttgttgttgttgtattttttgtagagacggggtttcaccaagttgcccaggctgggctcgaactcctgagctcaagcaatctctccgcctcggcttcccaaagtgctggcattacaggcgtgagccatcacgcccagttgcagcattatttttattccccattttatgggtggaaaaaaaaggagacaaaaggcatttaagtaatagtgtgggtggtatgtacaaaaatgagagagagagagagaaacagagacagataggcaggcggagctgggggacaggttcttacccataaacataaatataattttgggttaacagacatcatcccctggttatccctggcctcctgaaatgcccatgacccccagaataggtcgacactgttaatctctgtgcttaacactgactggctgaatttattccaaaataatccagcctcaagaatgaagaccaagctctcgctggattttacaaatccccctccggtaatggtttccaaaaggtctttagaatcctttattcgcatcaaaaaatttcaccgtcataccccaactgcacgatagtatctagacttccacttacttccgccatagtcaacccctgggcacttacagattggccgacttctgcaataatctattccccaaccaactggaccttggagtatagaagttgttgcaggtccctgctgtccaatatggtggccaccagccatgtctggctatttaattttaagtttaatttaagtcaaataaaatcccagtatgtagagcttaatttccttctctcaactgtgggctggacttggtgacttgcttcctaaagtgagatgagaggaacagcaactttgcagataccaccttcaccaggtgaccgtggttgacagcaccagcagtaagtcacaatgataccgtgaagcccctgatatggcatgatggggaggacacttctcctctggggtactttttccaaaaacctagaaccccattctaatcacaggaaaacacaagacaaccccaaattgggagatattctgtaacatatctggccagtactgttaaaaagtaccaaggtacaataaacaaggagggactgagaaactctcacaaatcttagtaagaaaactctcattaaggaggcatgagggccagatgcagtgtggtgtcttggatggggttccagggcagaacaatgatgccaccagggccacttacaccccagctcttcctaaacacagcatcgactgcagctgtgcacctgcaaatgctagggttggttccacagaatgcatttcaagcagacacgaggccatagttttgcttattggctttacgccaaaagttttgccttctgcctctgtagctgacgctcataagactgaaatttattttcatgaaacccattttgccactggcagcgtaagacagggaggaggtctgggaaagaagatagctccatcaccctacggtacaaggcaaacagatgcagggcaggaccttggaggcctcccagaacccccacatgtttgccatattgccattagcaaacgacttaacctctttgaagtctcacttccctctcctgtagaagtgagtatcctgacccatacctctgtggggtcatcgggaaggttaaaataaccagcctatgcgaaagatccgggtgcatattagaaggaaaacgaaagtgagtttctgttcacctcatgcagaattctcagtccaggttgtacatatacggtacatctcaaattgcaaaggaaactctcgtcctatcataaattcatcagccccagagaacacagcaatacatcctgattgcttttcatgggaggaaatgagtttgcctatctgcctagcatggagaagtcattagagaggctatgtcagcgctcaggtctaagctcagatcatgtttgaaattgcccctttggctggactcagggtgaaatgactgctaattataagcacacttgctcttgctgtctccctccagatggaaggatagaattgtcaacaaatttgctgtttccattttattcacacaggatcactagactccaaaaactgacaaaagcaaaatgcaggtcagtagaacccctcagtgtggaaaaaacaaatagggcctcatgcagtcctcagtgtggcaggaaggagatgatccaagatggcagctcgtgactgcatttgaccgtggagatgttttacggggccccaagttactgaatagtgtcattaggacatttaaaaaatagaaaatttaatataaaaatgaaagaatataaataatattttaaagtgcattcttctttctatatattctcccaaaagctcttcacagtggaaaaaaaaatcagaaaatttggcgatcttgggtctgcatttccacagtcacaattagccgtaaacgtccgtatgtttgtccttggtcctcactgcccttactcatttctgggatccctcagaaacctcaattcagtgaagtgagatgatttaagaaagatcacacagagaatccccgaatccactcaacactcctccagcacccagccacccgcccacctatgcatacaaatggccctgcatttacattaattcacaccgtcaagaaaagcctccctccccgtgccaccctgcatgccagagtctgcacacttcagctcttgaacctctgagctataataagcaagtatgttttctgaaatggcaaaatgggttttatagcatttgcatcaatagagcgagtcacgagcattacagagctgctgccaggcctgggcagcagagaaccaaatacagcctgcttcccaaccgacttcacatgctctcccagagaggcttgagagtcatgggcagtgacaaacgtggcttcctgcccccactcttccctccccgtattgcctggggatcgggtggtggcccatctccatgcatttctagcaccaggcaaggtgggaggaagcagggtggtcgagagctgggcagggtgggcctgagggtgctaagggtggtaaaactgcagggcatgtccacggctctgcagagctcctggggctgtcgatgatcttcagtggctttctagaccacgcttcagaaaatatggcctgcaggccacatccagcttgccccttttaaataaagttttattggaacacacccatattcattcatttccaaaaatccctatcatcagtgagctttgggggagaatatatacatacatatatatttttacaatttgtgtataatgtttatattacttgtttccttatttccctacatacatgtattatataacagtgtcagtgaatgcatacataaaatatactatgtttatataatatatataacatgtaaagaacagtgtcagtgaatgggatgtaggaatatgaaggaggaaacaaatgtagagatttctagaaaatgtgatcaaagaaggtgatgtctgagcaaagatgtgaaggaagtaagagtgtgagtgctgtgggcacctcgagggaggagctccaggcagagggagcagcacccacaaacatggtaacgtggagcaagctggggagagggcatcatggcaaatgcagttgatgaggtggccaggtgtaggatatggcaaatgcagtcgatggggtggccaggtgtaggatatggcaaatgcagtcgatgaggtggccaggtgtaggatatggcaaatgcagtcgatgaggtggccaggtgtaggatatggcaaatgcagtcgatgaggtggccaggtgtaggctatggcaaatgcagtcgatgaggtggccaggtgtaggatatggcaaatgcagtccatgaagtggccaggtgtaggatatggcaaatgcagtccatgaggtggccaggtgtaggatatggcaaatgcagtcgatgaggtggccaggtgtaggatatggcaaatgcagtagatgaggtggcgaggtgtaggctatggcaaatgcagtagatgaggtggccaggtgtaggatatggcaaatgcagtagatgaggtggccaggtgtaggatatggcaaatgcagtcgatgaggtggccaggtgtaggatatggcaaatgcagtagatgaggtggccaggtgtaggatatggcaaatgcagtcgatgaggtggccaggtgtaggatatggcgaatgcagtcgatgaggtggccaggtgtaggctatggcaggaacttgggttttgatcaaaagttgatggaaaccagtgcagggctgagagcaagagagtagctttcatccaatgtgtgctttgaaaggatggccttgggaagaggatggataggaagatgggttgccagtggatgagaagggcactgggcagactcatgggtaggctggtgtggttggctgagacagacaaaggcaggtgaattaaggaatcgcacacaagaaaggaggtgagcagggaccagttttgaaatcaccccagttgtcctgtagaactgacgtttatggattctttgaaaaaacttagaaaatgatcctcccagtcttgaaacttgagaaagttgcatttgtcttatctgagtttctttctcaggaaaccgaccatcagacctcccagatagcatcatggaactgaaactcaccaggtcaccgcatctggacagtgactcaccagaaccttcgcccgtcatgactgcctaagggaccaactgcttcctgctgaccaactccctgcctaattcctgttttccccacacatggctaaatttcttcctgttatgtaaacccctagtattagttggtcagggagatggacttgagactgatctcccatcttcttggctgcagcacccgattaaacacttcttccctggcaatactgacggtctcagtgagtggctttctgcgtggtgagcagtaggacctagaccaagcccctggcatttcagtaacagtttctgggtatttcaaggggatttgatgatgggtttcatgtgggggtgagagcaaggaaggagttccaagtttttgttctgagaagtgcagtggtgttgacaatccacagagatggaaccagagaggcttggagggctaccaagagctgagatgaacactcttggcttgctaacatcggctatcacaggatggaagaggaggagtgatagccctgctccatccagagcaagaggccactgcagggccacagagttcacactcatcattaaaatcaaaagaaaatgagcagagcacactgcactcctgggcaatctctgtctatggagcaggcatcctcctgtctctcatcttcttccctcacttcccctgccctgaaactctgagattagagatctttcttcaggttagctacactctacatggacgcttgctttctgtgatcacagagggatccctctaggattctttccttatagtaattcttagtggtgtctacaggtcactgctttctctccagtctgatgctgaggcattttggaatgtttcttcctcttacaccaaaataaatgaaggcaacttgtggatgatattgagtgaagatcacggaatgattcattatttaactgcaaatgctgaaaacacagctgtactcactgggcctaagaaagtgacttccttcctctcattgaatatagatgtttactcatcagcttattttaaaatgtgatctcaatgccatgccaatgaaagccttttagtctatgatttctttgccaagggaaattggaaatgttttctttgaaatgttctaatgcaggcatcatctggccatggagttgagactgttatcaggagcaacagctgaacagcaccagaagcaacatttacgtcacagcttccaggtgccgagccatgctgcagacactgtatttgtattgttgtgttcattccactcatctaatatatgtttgttgaacactttctaggtgtactagctcatgggatgcctttatgtaaactaagcagaggttctcttctgagcaagctaatgcccccttggcagacctagccattgggctgagtgttggcaaggtgacttttggcacaaccatactcaggggctctaagtggaggcatcgcctcagaactgggggtacagcaaaaaccacagaaggcaaaacccctatcatagaactcacatccttattgggaaaatgtggatggaaatgtggtatgtcaggtaaaaatatgttctatgaagaagacaagatgaagtaagcacaaagagagaggggaaaggatgctggctaggaaattttagagcagaggccttaatgatgtgaaagaatggcagaggggctggggcatgcaaaggccccaaggaaagcaagtgcttggggttttggagaagcagcaggaagtgactgcagtcttgtagggaagatagatgggtgagaggacccctacatatgcacattttccataggacatcaaatctagtctacaatactcttgttaagttcaaaccagcactatcagttctctccttcccctagaatctgagatgagtttttatcacagattatctgttgcatcctctgcctttgaaaacacacataatcctgctgcagaaaaaagaaacagccaatcaaatttgagaagagggtgggagatgagggagagttcctgaacttcacagttttgaagaactattaaaggaataatcttgtacttatcgaaaatgatttgctctgcatgacaatactattctaatatccatagtcaaggaaggagaacacagaggccagcagcccaacaagacacatacagtcatcagtgtccttgtgactctagatgcaatctgccttaaccaagacaattcaacctccgggaaaatgaattccattcagtgggaccccaagttttccatggcaaatgggaaaaacattctttctgttgtaaataggaacacaacttgtttatgaggatgctttaaaaaatagaaagtcatggtctacatttccattgttcctcattcatccattaacacaacatttctgtggatcttgtgagttggttgctggacaaatctgtggggttggagggttgctgactagtgggtacataatttctccaaatgaggctgattccatttgcccttcccgtctctcagggttggatgatgaactgagaaggtatgtgcttgtagttcccacatttatctttcaatattctgccctaatgaggctgtcaggctaaacgcctttccagaaagatgactctaactttcttctccatggacagtgtacttgaatggcatttcctcacacccttgtcaacatcagcattagcattctttaaactattgattttataggcaaaatccccattatcttactatttgaattggtttgtagcccttgacatttttcatacactgattagccatgtgcccccaaatatggccacttctttggtaatcattatctcatgttctgggaaaaacacattctaaaaagtttaaattacttgtttgaaaaaggaaatgggagttgtcattctagttcagaaaagattctagcccataccaaccgtattgctgcagaaaaactcaggccagcagaaaacagaaagggtaggtagaccagcaggctgaagaggcagtgagcttggggactcaaagctcttctccaaagatgagccctatagattgggaaatatgaagatgcctcacgaggaattggccgtagagagtgatgagggccacctctttttgctaaaaggaagatttcttccattcccccagttctacaggaacccaacgagacagcacaatgacaccacatgaatttggccacatcatgaaaattaagttgggtgcaccaggtggaaaaaaaaaaaaaagttctttcacctataagagtttcaggcactgctgcatcttgccagtcagctaaatgttttccttactgccaatttaacagcaatttaagtcattttatgcctcttgagctttggaaacctgtcctgctaggcactcaggatgttgatttaatagaatgtttctcttgaaggtatttggtaggattgtcaccgttttaacctgtttttgttttcctatgcaaaccaccttatgatcactcatcttggtttctgggagacattttaattagatcccttggagaatcttacatagcctggaacctaccattcttgtctcaaacatctaagggcagtttggcctttcccctgtctctccatttatccatatcctatctgtaaggctttttgatgtccttcctcttctgtcctgacccctttcacttcctggccacacaccccaccctctcaatgtcctggaaggggaagagatgcctctgcaatatcgctctcctccccagtaggtgcttttgttaatctgttttgtctagagctgtgtttaagccatgctgcatgggaagcactctctgctgcttcctgggacaggattggtcagctggtccagggtccccctttaagcctgatcctactcattgatgctgagatacagtaagcaggacaaccagcaagactgccgtagagaagacaccactcgcctccctctctccctctccctgcttctcactccttttagcatcttagcacgctggtcatgttttacaggcctataccatagcaggcagcagagtgttataatctaagatttagatccagatgtaactggaggcctttttttttttttttttttttgagatggagtctcactccattgctcaggctggagtgcagtggcgtgatttcagctcactgcaacctttgtctcccaggttgaagtgattctcctgcctcagcctcccgagtaactgggattacaggcatgtaccaccacaccccgctatttttttagtagagatggggtttcaccatgttacccaagctagtctccaattcctgagctcaggtgatctgcctgcctccacctcccaaagaactggaggcctttatacttcaggttgcatactaagacagatggagagagtgcgggtgagagtggaaactgtagcacagtgcatcagcttctagctcttgaatatgcatctgccttgggaacatattctgaaggaagtgtctgtggcaggacaggattcaagcatttgtttttttaggcatccattgaacaaaataccaaaatctcacattcacttataaaacagtttactggtaaatctatctggggactaaattgtacctatatatcattgtttttcaagtgtttcatttggaaaattttttaaaaacaagactgtaaggtcctcaagggcagaactttctcgtcaggactccctggtacttggtacatctcgagcacaggagatgttagaatcagacgcgtaattgctgtcccaggcagcggccgctggtgacctgcagctaccgaacacatgaaatgtggctgtctcaaccaacgtgtgccctacgtgtaaagcagacaccagattttcaagattcaatgccaaaaaaatgtaaaataaggtattatgataaattataacattataaaatattgatttaaattaatttatattgatttccttttgaagtaatatttaaggtttattaggttaaatgaacatacattattcaagttcatttcacttgttttctttttactttcttgtaacgtggctgctcaaaaatgtaaaattgcattcgtgcctcacactcaaggctgacattgtatttctatcaggtgcgtccctctagaccccagccggggtaacatgaccgaggaacgagcccagttcagagccgccgtcgagtgtcacgtctggggaggagaggggagcgccgtgctaaggggcttacgcagaatcttcttcaaagctgtcaaatctccatctccgccagccatcactgctgcctctacaccagaagcacgtgagaacgtgtgggtcccatttttcatacaaatgtttaaaatatattctgtgccaataccgttcttatctagtttatgggattgtggaaaaacaaagccacaggatttagggctcatcaaaaaggacttagtttcattctcagcgcagtagggaaaaaatcttaacacagcttgggtaaagaaatgactaagagacaaacagcagtgggttttagcgtgacatatgcccctcatgggagagtcctgtccccctttgggatctcattgagcaattacaaatatcactgcttcttttttttttttttttttttgggatggagtctcactcactctgttgcccaggctggagtgcagtggcgcaatcttggctcactgcaacctctgcctcccaggttcaagtgattctcctgcctcagccacccgagtagctgggactacaggtgtccactaccacgcccagctaagttttttgtgttttttgttagttagttaattagttagctttttgagacagaatctcgctctgtcgcccaggctggagtgcagtggtgtgatctcggatcacttcaacctctgcctcccaggatcaagtgattctcctgcctcagcctccagaggagctgggattacaggtgtgtgccaccacatccacccaatttttgtatttttagtagagatggggttttgccgtgttggccaggctggtctcaaattcccggcctcaagtgatctgcccacctcagcctcccgaagtgctgggattacaggctgagccaccgtgcccagtctactgcttatttctgccaacgttcttcaaagattagaaaatatgatattgttattttccagagacaaccttcttttcatgcaaaacgaaatctcccatgtctagaagaaggccggtaaactggcagcccaccaggctgcgcgtggatgtgttagtcaacgcagtgattttcaagaactgactcatttgttttttaatttgttatctgccaatatttcaaaatcaaaacaatttacatggaaagtctggatttctgacttctgttaagttggaagcgctggcaaccctggcctatttccctgtagtttcacttgatggaatgagaggctggccctgtgagatgactcctccactgacccaccacaacccccacccactccctatcatctccccagtgctggggaggaggagggacagttgttatcattgctgttgtagttctcatatcctggaaatatttccctgtccccctacttccactgagactgtgaaaataaaatgcagactgggtaatctgtttcttatgtctgtgtcttctctattctttaaacaaaaatgcttctgtatgttttcacctaatacagcaaagctcaagacagttagggctcttttaatattgaagacaactaaaaaaaaatctttaagtgtgcatacgctcacacagaaagagttctccaagccttgagtttctttagcattacttagtgtagttggtttcctgtcccaaataatggggggaaatatcttttgggcacagttgtgcggattgtttagaaacatacatctctgattaatataaacattacctgcaacacagagcccgaaggcagcctgttttctcactatcgtattttataatctgttagacttattgccatgttaatcaaaggtctacttttcatgctaacactagctacagaaattgtctcccagcagtttccattttgaggccttgagacatcataaaaccccaaagcagcaatgctggcctggcaacagggtacagagattacatcgatccctgctgcaaaaggaaatgaaatgcctgagctactctgtcacgtcagccccgaaatggggaagatcaggacacggctgcatcattagcgattcccaactggttcttcagtaactctcctgatgccagggagatctcagagcaaagcacgatcacagaaaactgcctacgctcgttcccactctccagtattcttctgtttttcatctcagtgaagacggattagagaaacttattatatttaagaaatactcatttaagcttctaagcaggaggtttctaccaagaaaggcctaatctctctctttcatctctttctgcctactgaatgtcttgtaattctgctgttgatgatgcacagacctccatgtatggggctaaggatgatcgtatgtcaagtagtagacactttcagcagaaaagcctgccctggtcaccctctggtgactgaccatgatccaaagaccatcaaagaccaaaatgtactctcattcaaagcatgaacaggagtgacggaagacaagaagcccacgacggaagacaagaagcccacggcttgttccactcgggccatgaagttaagaatgtgaacaagggtgacaggcatgattctgaggcccaaaatacacagagacaaagcaaactgaggcacagagttctgaagccccgtatctctctaatttctcatcttcccctttgccaccatttctggaatggtctccaagttcagtctctgtaggtaaaaggcaatgggtaatttaagagtttcatgttttatttccatgccttccactgcattttcacagctaaagctaagattgtgatctccccagcttatcaggctacaaaatgttttcacgtgatctatcatgcccacaaaactgcccttaaaattccatctctgatctttcccaggagacatgctcatcacaaccttgctgcctcttggactttgtgggtttttttgcttgtttgtttttgagacagagtctcactctgtcacccaagctggagtgcagtggcataatctgggctcactgcaacctccacctcccgggttcaagcaattcttctgcctcagcctcccaagtagctgggactacaggctcccaccaccgtgcctggctaatttttgtatttttagtagagacggggtttcaccatgttgaccaggctggtctcaaattcctgaccccatggtcccatggggtccccatgggaggcctcagcctcccaaagtcctaggattacaggcatgagccgccgtgcccagcctacctcttggactttgttttaatcgggtgagacccttcttgagatgaccactcttgattagcagccctgtggtatttttcaaaggatttttgtgaaactgactctgtgccaataattctgcaaaagtatctctgtgaaaacttctacgtctgtgctaataattctattctacccctaattaaatactcctaggaaacttgtaagaaatgcagacataggggattttattcagtgtgatttcatttggggaggactgcctaattcaaacgtgtaactctaggctggtggatatttcatcattttctccagcactgaaccaagagcatcctcaaatccaaataaaaacagcctctaccatatggactaagctggcatctgatgcccatcccgggggaatgatacgacgacagtttttaaataaaggtgaaaatgacttggtgatctttggctactgtcaagagataaaacagtccagtgttttttcttaacttgtattttaggcttggggtacaagtgaagatctgttacacaggtaaactcatatcacaggggcttgtcgtacagattatgtcatcacccaggaattaagcccagtactcaatagttgtcttttctgctcctcccaccctccaccctccagtaggccccagtgtctgctgttcccctttgtgtccacgtgttctcatcatttagctcccacctacaagtgagaacatgcagtatttggttttctcttcctgtgttagttcgctgaggataatggcctccagctccttccatgtttccacaaaaggcataatctcattctcttttatggctgcatagtattccatggtgtacatgtaccacattttctttatccagtctgtcactgatgggtacttgggttgattccatgtctttgctactgtgaatagtgctgcaatgaacattcatgcgcatgtgtctttttggtagaatgatttacattcctctgggtatatatccagtaatgggattgctgggtccatggtatttctgctcttagctctttgaggagtcgccatactgctctctacaatgttaaactaatctacactcccactgagagtgtccaagtgttcccttttctccacaatctgtccagcatctgttactttttggctttttaacaatagccattctgacaggtgcgagattgtatctcactgagtacacgctgttgatgtaattcaagtacttctgaaaacaaagggtagttatcgactacattggaactatgggaggagaaaggccatgagtgagcgtgtttgtcctgggagaagggatgtctactgcatcaactgtggcttttgtatgctgctcatgtaggttccatttctctgtctcagactaaaggggacctacaacttgctccacccaaaatatttcaatttaagagatacacatagagaaaagtgatgatgttcagaaagctttctcctgaaaacataaagacagcccaggaacatttttatttgaatggtaaaaatgatcacacagcaaagacaaaagtaggctgaaaccttcaaagtcaaatgaaagtaattctgaagggcgtctgtactttaattatattgggtgaatgttggtgtccaggctgtggtcatggtaccacggtggtgaatgatgtttccactggggtcagctgggtaaagagtatactcctgaacaactatgtcctatttttgcaatgtttatgtgagtctaaacgtactgcaaaatgaaaaaaggttaaaaattaaactataaaatgccatgtcattagacatgatgtggatggccctctgccaattcatccatgatttaacagatacatttggttttcttattacacttgaggtgatgtattaagttctctgggagattctaaaagacacaaaaggtaatctctgtcctcagggagcttatggtctccttgggaaaacagagacataaacagagagaaagttttaaaatgacatttatggactgtaagtgacttttgaagctgcacataagtaatcatgaagttactgagatgaaaagtgggtgccgcacattaactggaaagcaagcacctgtgtgtctaaaatgtggtgacatgatgtgtggcaccaccttccagaagctggtgtctatgtgctgttcatggctgatcccacattacctgacccacaataatcaccaggtctatgttcattattgattggatacaggtgaataaagatgctacttgacctaactctcagaagattaaatcaagtgaagcaggaattacaaaaaggagggtgactccagcaagagccccagatgtggaagtccaagccacacctggaaaacaggatctctgccagctagcctggccagtcatgatggtagagaaaggtggaaagaagctggcatcagaggggcttaaatggcaggaaaacaattcatataattgtgctatcaccctagaaacccagagactgtttcccatgatttgatttgtgagatatttctcacttcatctgtcttatctgtgttcatgggtacacggccataggcactcagatgttgcatgaaaaagaaatgttaatctaaaaaaaatgtcccatagtttgctatttttaaaaatatagaatgcaaatcatgataattttcttctttgcctgttcttagatttcttttttttcttatcttattgctttggcaagggctgctagtccaacagtgaattacaggggtgttgtcatgcctataattagttccctgtgtccaatttatagaattgtgcattcttgacaaaagaaaatgcacagatagagcaaggtgagataggaacccaaggaaagagaagggactccatctgtaatgttgcagtgggtccctccaatgctgcaaagacccagagcaagcctcaaggaagaattccacttagaggtaattcttttccacaaaggggccttccagtcatcccacagaagtggattcctacattaaatccccaagtcaccatgtagtcttgcagtttcacattatgttagtggcaaatcatgaattatgagcttaaaataggtgtaaactgacaaaactgcatccagtgatttcagatcccatgttaactacatgaattgttaaaccaatgttaaagtcgtttccacagcattggattaaattagataatgggttgcttgggctcataactgctttaacatctataagatgcattcgctagtatgatgctaaggcatggcagacataaaatcaataagagagcttctaataaatgaaagaatatcaactgcttcatgtgttttagtggagaaatcatgaaattcacattctgtggaataattttggtcagccagagtagggggtagagggccgtgggcagtgtatacaggctcagtcaaaagaagccaaatatttttcatgtgataaccacataagcaaagttaccttaagacaaatcatgttttctttccaaaagtcacttgaaaagtaaataaatttataaaagaaaattagtgcattaatatctttttcaagacaattatataactgcaataagttacgacaagatttgtttaaaacataacaggaaataataatgacaagataatggctaaaatgataatgagagtgttctttccctaaatagtactccactaaaatatgacatcttaaaaactgctggtgagcagatcaggaaatgagcatcattagtcctgacactagaaattcatgcagcaaggtcatgttttcacaacaaatcagcttgttcattctgccagttcagtacaaaaattagtagacaaattcatgataaaaaggatcatgttagtcttttgtctgcattgatcatagaaactgattagaaaagtgagattgtgtacatcccagggtgacagagccttgtgcactgtccaaggtgctgattaagagatacccagggtcattccattttgcagcaatagttatctcagagaaaacaggacaggtcgccgggcgtggtggctcacacctataatcccagcacttggggaggccgaggcaggcggatcacgaggtcaggagatcgagactatcctggctaacatggtgaaaccccatctctactaaaaaatacaaaaaattagccaggcgtggtggcaggtgcctgtagtcccagctacttgggaggctgaggcaggagaatggcgtgaacctgggaggcagagcttgcagtgagccgagatcgcaccactgcactccagcctgggcaacagagcgagactccatctcaaaaaaaaaaaaagaaaagaaaagaaaataggacagatcacctctgattcagggaaaacatggaggaaagggaaggacaacatatgactggctagccccacaccaaggaagcactggacacaataacacatactattattataacaattaacacctatcaaatgcctctttctgccagctgctgtgttaaacactttccctaaattttctctttaacatttacaataactctataatgtgagcataattattatcatcccttatatatcaatatatcaagatgtatatgtcaatatatcaatcttaatatatagaatttgaatgctaggtgttaaataacttgacaattaggaggccgaggcaggtggattgcttgagcccaggagttcaagaacagcctgggcaacatggcagaaacccgtctctaccgaaaatacaaaaattagccaagtgtggtggtgcatgcttgtattccaagctacttgggaggctgagctgggaagatcacctgagcctggaagttcaaggctacagtgagtcctgattgtgccactgcactccagcccggacaactgagggaaaccttgtcttgaaaaaaattaatagattcattaaataacttgaccaaagacatagagctgccaggtggcagttctgggacttgaactaaaatctctgtctccccaaactctacataaagatggagaaactgttaggaaactagagttaaattcagttcgttggtggtggcctcaaagaatatagagaaggtattggaattaaggactctagatttatgggatcacagtaaaaattccaaggacgaaagaaatacatatttattcctaggtccagcaaacatttactgcaagccaactgtgttccgagtttggagcacaaggagtgaccatctgtaaactcattgatctcgggaagcagtgaattaactatagacaaaaaagagagagaaagcatatgtaatagcaaagaatagggactctgggagcaggtacaggaatcccgacttcaatttcctgtcccatcatcactaagtgtgagatcttagaccagtctcaacttctctgagcttcagtttcctcaattcttatgcacctcagagggcttttctggggcctaaatgacataattcagttcaacgtttgctaaagtacctagcacacaggaagtgcccagggagtgattagcattctgccccctcattcaagcatcctaatgactctcctgagatccaacacaaacaggtagagagtgcatctgaactaggtgtgaaacctcatgtttgtggttatgaaatggatacaatatacggccctcataaagtgaccctactaacatcaccctcaaattcaatgacagttacttaggcttacgaatacagactaaaaacaacagaagttgtcagtgaaggcactgttgaacagtactcctaaatgtttatttaacagatatttgaattcacttacgtgctgctctacacatttgataaacattaatttgttcaaagttcaaaataactatgcagtgggtgtcatcattatccccattttagagagaggaaacagagacaatagaagttgtcagtgaaggcactgttgaacagcattcctaaatatctaacaaatatttgaattcacttatgtgccgttctacacattttataaacattaatttgttcaaagttctaaagaactatgaagcaggtgccatcattatttccattttatggagagaaaagagagacaagagaagttgtcaggaaaggcaacgttgaacagcattcctaaatatttagcaaagatttgaattcacttatgtgctgttctaaacattttataaacactaatttattcaaagctcagaataactctgtgaagtaggtgccatcattatccccatcttagagagaaaaaacagagccaagacaagttaaaagactcactgaggtcacacagaaaagacttgaaccctgcgatctgactccagtgtttgggtgcttaactactatcctgtatcagctccctgtggtgaacttctgcctctgttgagatgaatcgggaaaacagcttatgttgaacaatcagattcaggagaaagccctcgcaggaaaaaatggtaaatttaaaaaataataataataaaaagccttttccaaaagcccatgttggctcctggctatggcagcagttagtcaaaatgagaagcagcgtgggtctcacatgatgcacccctcaccgtcctggacacagacggccttagtatttatactttagcctctgaactttattccacttaatgaactcaagcaccataaatgcaagcctgaacacacagcatggctcatttgaagacagaaatatgattatattattacagaaaaacacattgaagtggtaagtgacaaaagtgtagatacatttgtttcccagaaaaccatctgaatgtcttaaaatctaataaaagatctatccggggcacaggaaagctgttcaacaaccgcctcacctctgatttatagcaggcatttttatgatgtttttatggctttgacctcagaaggatttctcgataaagcagctaaaacacgaaactgctagtgcaaaagccagttgcatgtaccagaggagggagattgtccgagaccttgaaaataatgccccatgcctggcaaaagttaatcgtcatctggttccattctgagcaataatcatgaaaggcagccgtgcaggccggctctcagaaatacatttcaatgagccaggcccatcgccaggcacggagaggaggcagcacccgacaggaacatcatggttgtcatggcaaccacatggcatggcaggtgagcctctgccccctcgtacttcggggaggaggagaggaaatgaacaggatgagcagcactgtgctagattctgaccggggagtcaaggcttgctgcacttgtgttcctggtgtcaagcaaacccgtgttttcaatgcagagttttgttgttctgttttgtttatcactccacagcaggcccaccctggcaacgtgcactctgtctgcccggatcttcattagccggctgcaggataagaagcactgtggcccagaccttcccctcatgtggcctgcataggataaattcatatccaatggatcaaggtggtttctatgaagccctagagaccgatgattcattctcactgtttgcataatttttatcttaccatttgtctaagataaatgattggaactcgggaagtggtaccaatcagggtgctgtctggaaacagatagaacctccagctgggattctgaaaagttagacaaggaacaatgtagaggggcatgggcagaattaaagtccagccagggacgctcgggcactcaggatggacaaccaagcaactgtgagaagctggtgacccccacatggggagacccaggccaggggagctggagccttgcagggaggtgcagctgctggaaacaccccaccaggaaggaatggagacgggggaggctccccaccttctcgcctgctaccctcccaactcaagatggtgccatcaccattggccaagcccaaatggaaagcagacagctagagcccaagtatgcagtgcagcccccaggaacagtgtggagaggagcaggaagggggtcaggatgagatgtggagaaggtcagagcaccgggccagtgagcaagtgagccagcactgtgcacccttagggcgtaggtgcagagacgtcttgcatctcggcttcttgatctaaacaagatggtcatatcctgttatgggttaaattatgtccatgaccccaagttcatatgtaaagtcctaacccccagtgcctcagaatgtgcccttgtttgaaaatagggtcttagcagatgtgaggagttaagatgaggtcatactggagtagagcagaccctcgtctcatatgcctgtgtccttatcaaaaggagacctttgcacacagagctgcacacgggaagaatgccaggtgaagatgggcaaagaagggtaaagcacctacaggccgaggagtaccaagggtgctggcagccacagagacagggagaggcctgcagtggagccccccacagcctcaggaggacccagtcctgctggcccctggagctcaagcttcagcccccaactgtcacgccacacgtttctatctaagctgccagttgctccagcagcccaagaaactcatccgtgtcccatcaggccatctgaaaatgcagtcaggcctgccctcagccatgcgagtgaccttggaggcgggtcccaccctagtggggtgagctgggatgtggaacaccccctgcccgggctcagaagcagaagccccttccaaagcccgcagccccaggtgatgcctaggcagactcaccacggactctgagcagaagtcttggctgagctgtgcccgaactcttgacccagagaaaccacaagacagcagatgtgtgttgtttgaagccaccgagttgctgtaatttattacacagcaatcggtgacaaataggtcacagctatagatgacaaattcagctacctgcggagattgatttttaaaaacatattttaaaatcctcttttttcctgtacttatctgtagacaagagtgtcaccttgttcgatgccccgccttcatctagagacaccaccacagaccctggggtcaaagcgccttgctccaattcctgccccttcccagtgagcagctgtggcttcggcaagttacttactcctggctcctgcgaccccggttcctcacctgaaaagtcgggcgataatagtgtccacctcattgtgttgcagaaggaaataaacaagcaaataagaggaaatatgtgcttaagacagtgttcagactcacgtctggcatagaatcaatgctcagtgattatgagctgtaatgattactatggttatgacaaccatgatttgattctattcacccaggaatgaaacaacaacaaaatgcaatggcaggctgacttttcctggggtcattcttgccggtttttttagctgacagcatccactcaagttctcccctcattgtctcacggagaagagcttgctaataacaccctaacaattagaaggcagataaatctggaaataaacatttccacagttatgatcattttggacatatgggatcataatattttatgatcaccaacagacacacctctctctgcaaacacacacagctgccggggtggggctgggctttgcacttcctgagattgaaagagcaaattttcttcctcacagtgatggtgacagacagaaatcagctgctggctacttccactcaagtcaggctaagggtacgtcagcagccgtgcagctcagtccgactccagggacccaaaaaagaatgaggcacgctgttaggtcagcagggagagccccagagacaaagggaagagaccgagaatgcagccagcctgtggtgtcactcacagggttgggtgtgcagtcagaggccaggcggcccccttgagaagggctggtcccagcagcgcatccaagacctgcaacggcatctaaatcccctgtgaaaagggtgatgatgacctgctatgtccagggaggagcttgcaattctgtgtttctaatccgcttccaaggggacacttttccttgctaaaatgttaaatgacatttgctgttaacaaacactatatacttccaagtaatttattgacttggtcatgaaattgaaattgtcaagtaggttagaaactcacattctccctcttttttaaaagcttattagtctatattttcataatctcaacttctgatgattttatcttctcttatgccaataccttgttttttagattttatttttaatagacaataagtgtatgtatttatggggtacaatgtgatgttctgatatatgtttatgttatggaataattaaatcctacttattaatgtgtcaatctccttatttctctgtggtgagaagatttgaaatcgactctcctggtgattttcaaatatacaaaacattgctattacctataggcaccatgttgcacaggcagttctcttagaatttattccacctaatagatattttgtatccttccaacaacagctccccaccccctaccccatgccctggccccaacctctggtaaccatcattctcctctctgcccccgtgagttcgacttttttggatttcgcctatgagtagatcacgtgccgtttgtctttcaatgcctggcttatttcacttagcatagtgtctcccaggtttatccaggtaagggcagatgacaggctttccttcttttcatggctgaatagtactccgctgtgtatatacaccacatttctttatccttatatccgctgagggacacttaggttgatcctacaccttggcgatggggaacctcatgctctcttaaaaaacacgattcccatttgttaagggtgggctgggactgcgtgcagggcactgacaggcgtacctaattcacattagttctttaactccctggagctccgtgagaccacatgctgtagagactaagggtgctggcttggaagccacaccatgactgtgtcaacctgggagctagcaggtatttagatcccagatctagcactttgtaaccagatgacctcgagcaagctacttgactgctcaaggcctccgaattttcttccataaaatgaacaacggtaacacctgcctcgaagggttgtttaggacatgctctgcacccatgaggcatttgctcttataactcactctgcccccagtttacagagagggaaactgagaatgggagcagggggtgatttgcttaagggcagacagctggtcagcggcagagctgccactcaatcacaacacacggccaaagtccagggtttgtttaatctgagatctgggaatgacaactctcccagacggaggcaaaaatgtgttctaaaggcaaagtattattgcaggtagaatttctatttcccccaccatattcaggtaatgtggtaaaagacttcctaagttcccattccaggctatcattcttattaaacctgcttaacttcatctcccttttaatttcactgcagatttaatttggggggagggcagagtcgggggtctcggttccagggtttctcaacctcagcccggtggtcatcttggtctggaagattctttgctgtggggctgtcttgtgcagggcaggacgtttagccacacccctggcctccacccactggatgccactagaccccccaccggtagtgaccacccaaaatgtctccagacattgttctctgggaggcagtatgtgctctgctcccactcccatccgctttgagatccccagtctaatctaccataaaccatgggttacgctttccccataacacagcaacgctgactcctcgcgtggccaagctgcgcctttccatggccccatgttcatgagtcaggagagcagctcctcaatcgcatgtgtcttaaccaaatggaactctactttcaaagtaacgttcaacaggcatagatcaacctgttagactctacccaaaatatctcatcgtggcctccctccctatgcccaagagcccatgtcgaaattttcttgcaatccagtattaagggctgagttgtgccctcacatccaaattcatctgttaaaggtctaaaacccccagaacctcagaacatgatgttctttgggactagagtcattgcagatgtagtaagtcaggggaaggccatgctggagcagggtgggcccctgacttaatatgactacagtccttacaaaagagggaaatgtgagcacacagagacagatacaaagagaacgccatgggaagataaaagcagagatcagggtgatgcttctgcacgccaaggagccccaaagatggccaccaaatcaccagaagacaggagagaggccagaacaggggctccctcacaccccttagaaaaagccaaccctgccaacaccttgatctcggatttccagcctccagaactgggagagaataagtgtctgtcgtttcagccatgtggtctgtgagtcttagtactggcagcatagcacctacatacacagagacacttattaaacccaagtaccccatactacaaaacattcattcatttcctgatgtctcaaacaggggttgaggcaacatatttagggaagctaggcccaggtacagtgtggttaaaagaggagcgtcagatagttctttgggaactgactgatacgagcaaggtaccccaaacccaatttccaccttcttcttaattgcaggagtttgtaagcctctttctccttgattcagagaaccctgggtagagggacgggtccttcttgcgtaatccggtgtgatttttctggtgaatcacatacagaatacggatatgtttaactcccaactggccattaaacacatgtggtcatttgcggtactctgaaaggcatctcaactcccatttttaaattaagggatgaacattcactaaacatgataaaagggggtttctgaacgcagaggcagccatcctagcaaggatggctttaggtttcaaactctcctttaattttaacccacacaactcttttgctgcacaaatctgttaaacagattttagaatgagatcttttcattctccagagtttgggaagagtcttaaatttatctgaatttatcttttattaataatttattctgatggttatagtaatatatgttcactgttaaaaaatgttaaaatatagaaaagtgcagaaaaaatgacggaaactatcaaactctgcaaaaatgacattacctttgatctgtgaaataaagcataaaatcagacacacaaggaggggagatatatcatcaatttttaaagtttaagttttaaaatatatatccatcactcttttagtgcattctttttctaatacttagcaaatgaaacatttgtgtgtaatctaaaattggattttattaacttacttcaaagccaccctccatgaaacttagaatactttattcacaaggaacaatagttccataaaattcttaatagagtggagttttatctgctagaaatagaaaaagcaatttaagctagcttaattgaaatggaaaattatgactttacctaactggaagtcctggcatagatcagccttcaggaatgacttgatccagggaccctacctggcaagtgcctggcttctactcttttctgtatatcaaacttgctgtcaggctgaagtgacatgggttcagcaggaccagtcacctttgcttgacagcaaccaagggaaggaagtacaggagtacttctggaagctcacatagaagaaagaaaaatcttttctagtagccatctatgagcctctcctcttctctcattggccagagttggatcacatcccctatccaggaccaacccctcataaaggctggggttctaaggccaaaggagcttagccttggctacaagggtggggccttggaaaaggagtggaaacctgaaaaaacaacagcagctggagttctgtttggcaggaataaatgaaaaatggatgtcagcaagcaaccaagtgccttctcaattctgtaagagtggtctgtatctgacagctcatcagaattccactgggcacattcaagagtgaagggaatttgaaaggcaggggaaaatcactgagctgggagtaactcactgtgcatttaataaaatctaagcagaaatctctgacagcgtagcttggtatgacggacggctggctgtggacagcttttgactttactgatctcatctatctttctaactgaggactaaaccagaagctaaaaacgcattcacgctgcataaaatgtatctgctaaaacactgttatcctgagtttggttctaaatctcagagggcttttcaaaaagcatcttaaaatcttaagtgcaagtgacacacaaggacccaccctgtcaatttcatattcccatcgccccttagaccactctacatttttcttccacaaataaatgaattaccagacacttgaaacgcgttcttacgccctgccaagcctcttcctcaacaagacacctggtggcatctccagctggaagtccagtgattaacctgagcatgagaaggctaaattggttcaaataccaaatggaagaatagatcaaaggattgcctgaaagtcaatggggttgaatttctagatcaaaggttaatagcaaaaggtttaggattcttctacaattattaagctgttcaaaggaatggcccagtcagacttcatagggaatcaagtatgaaaacggtgactcatcattgagactatactgggagctttcatttctaatgctaacatcctttgaagggataaacaaatatgccctactgcagcagggctttatttaagtgcaattattttttcagtgatgcttatttaaatcttgagccgggttggccatttcaagccagtagtcaagtcatcccaaatgtacattgactagaagtgggttcacaggtactctcatctcttctctgtgttactgtaataacctcaccctctccaccaacccagcagctagagcgatccttttgaaatgtaagtcagcttgcatcattcttccatctaaaatcctgcagtggttttccgtttcaattatatacaaaagccaaaaaccttcctacacctgctgggctctacataacctggcttcccagcctcctctgctgctacattttcccctcgctcactccatctctaccacaccagcctccctgctgttcctatacaagtcaggcagtcccagtcccagggcccttgcacctctctctgtcccctcttcctcttctcccaggtgcccacgtggctaactcccccacccttcaggcctgctgttcctatacaagtcaggcagtcccagtcccagggcccttgcacctctctctgtgccctcttcctcttctcccaggtgcccacgtggctaactcccccacccttcaggtctttggccatatttcatccgacgccaccctgaccaccttttacaacttctcagatgtccccttcctccttattttatttccccagtcttttcagcactgtgtttttttcccaaagcatttctcatttagatgcgccaaatcttttacttttttctaacattttaaaaattggggtgagatttacataacatacaattaactattttagagttaacatttcgccagcaacaatggtataacaaatggccaaaaagcccatgaaagggcattcagcattcttagccatcagggagatgcaaaggaaatagggtatatacatacaatggaatattattcagcctgaaaaaaggaagggaattctaccacttgcaacagcgtggatagacctcaaagacattacgctaagtgaaataagccagttgcagaaggacaaatactgtaacactccttttatataaggcctctaaacagtggcagttaacaggggatgtaagagggggatgtggggagttgtggttcaatggggttcaagttcactgatatacaagatgcattagttccagagatctgctttgcaaccctgagcctacagttaataaggtactctgcacttaaattgtgttaagagggtagactcaatttaagtgttcttaccacacacacacagaacaacaaggaaacccaagaaaacttttggaggtgaagagtgtgtttattaccttgatcacagtgataacatgaatgtgtacatatgtccaaactcaaactgtataaattaattatgtacagtttttggtatccaattataccaccataaagcagcagggggaaggaaatgtaagtcaaaaccacaatgaaatattacttcctgccctttatgatgcctataattttatttttatttatttttttgagaactctgtcacccaggctagagtgcatggtgtgatcatggctcactgcagccttgacctcccaagttcagatgcctattatttaaaataatttttttaaaaaatggaaagttacaaatgttgtcaaggatgtggagaaattggaactcaacccttgctggtagggatgtaaaatgggaaacagggtatggaggattttaaacacagagtcagctatgacccagcacttccactctcaaactaggtatcatatcattgtcagctgtctctccccaatggatcatgagttccatgcatcaatgatgttgtttcatttgatgctggatcctagcacctacggtagtgcctggaaaagaggtgggctcaaactatgtgtcaattaagtggatacacatgtggttgcttccttattctcagaaaagaactaagccattccccattttatcactatttctaggataaccatgagctcccttaactccgagattcctgctagtatcccaactacaaagcccactccttgtcccctctttttaaaattattttgtagctcagtaacatgtttggggtctttctttgtagatctttttatttattaccatcacatttgttcacacagcagcacaaagggtgatatgaaaaacactgttaacgaaataaatagaaagcagtgatttcagggctgttgccacacagcatcccaattttgctggagatggaagagggaagagccaatttattgccatattccattgtctttaaaataatattgtttctactcccaaaaatgaatggtgagaatgtgaaaacctgtatcagagatgatgcattttcttcctagcaggcttgtcaagtatcagttcctaacgagaactatgcgatggaacttgtcattgataaagagggtcaaatctgtaatctgcctgcccaaggtcaaaggctgtaatctgccagcccataggctgaattcattttgctcagtctgcatagtgtttaactttttaaatttgttgccaatttatacacacatgcacacacacacacacacacacacactcactcaacagtcctagcttctaaaacatagcaggtgtttgggcaattctgggccccacttcctgtaaggcaataatagagaaagtggagctgctattgcccctctagacaagaggtgcaaggtggcttgaaaaatatgtccacaaattacctgatgctctatctttaaggaggcggagattaacttgattatgggctaaacttagtggctcacttctaacagaatagagaagctgtgatacgtcgcttctgaggttaggttataaaagacacagtggtccctctctcatgagttgttctagaagcagcaagctaccattttatgaacagcctatggagaggtccatgagctgagggtcaaagcctccagccaatgaccagcaaggagctgaacctgccagcaaccgcaccagacaagttggaagtgatccatcaccagcttcagctgagcctccggactctgcagccccagccgacagcttgactgcacatctcgtgagaagctgaagccagaccaggcagccaggctgcttctaggatcctgaccctcagaaatggtgagataaccagagtttgttcttttaaaattgctaagtttggggataatttgttacacagcacttgataactgatacaacacaataactaagcaataccatgctgctcaatgtctcctagggctgcattaagggattatcactccagccttcatgtttttcagctccctttaatgggcagagggcagctgtgcctacagcttcgatggttagggtgggcttaaatgcacaggaaagaggggagtaggaaatgctttcaaaggcagagtcagaagaaaggcatagcgaagatgaaagaggtgaaggaagttggtataaaaagctctgaccagaccaaactcagggaaagtcaaatacaaaatacagccagggaaaattaaaattctttataagcaaggaagcttttgagatgtccagatgggtgaaatctttataagtattcacataatcatcatctatggattcagaagaagcaaccgtggattaaagacacagaacatgtttgcaggccccaggtttccgcatggtctggcagctggcgtatgcaccacaagaaggcagagtcccttgtcccaccacaaactgattactagaaaggctgatgcttattagtttgcatatgttctgaaaaatgcgagttcatgacatcaccatgttaggattgcgctcatgtgcactctgatgtactttccagcctggagcgtgtcttgcctcctctggaacccacccttctatcccccactctgcctgaagggacactagagggagacagaacgggggagagggaggagggagggtccctgagggtctttgtccagttgccccccacataactgggcatcggcacgtccctgggaaggggcagcaggttcctacttgccattttcccacatttgcaggctcagcatcacatatccccctgggcatagcagccacagcggccaacacccctttcaggggtctgggtcccctccaccctgcctctaagtcttaatcatcccacctcttccccctggtcctccagccttgcagggggagccactcggcatcgcctttctaggtctctattacctagcctgcagttcttcatagggaattctctctgtggaaataattagcatgggctctgtctcctgactctgcctcacctgatacacctgtgcctttcagtgcaccttggcctgtcttacctatgccttggagccatcccacgaacatcacctgccatgcaccaattaaaaaaaaaggcccgtggtcccaggaccattatatatgatgtttcctccaaaagatagcctgctgattggaaatctaacatcaggtgtccctccattccagattagttaaggttctctccattgtcagcaacagaaacggcctttggcagtcttaaggtaggatgtaaatttatagaagaaggcagggtttctcataacttctaaagcaaagctcaaccaaccaaccttgcaagaggggagacccaggatatctcaggggactcagcacgggggtgtgggggtttgagaactttctcttctgtggctgtttctcatgtgcttcagctccccagacaactaactcctctgcctcctgtgcaagcattaagttcccaggaatccagatctaacagtctggctggatcagtggtaaccctaagtcagctcctatgcatggacagagttctctggtatccacacaggccctggggccagtcccagagagccgtgagcagacattcagccttttgatcctgacttctaatttcgggttgacaatgacgtgctcccctctgggaaacccagaagcaatggagagacaagctctgccgctcaggagactccagtggcaatgaaagtctctgccagatgaacagcccctttgccaacttgatctgtgcgcttcttcccaagtgctcagagctaaatgctttgctttgagacatctgttgaaacacttccaggtccccaatcccacagtcatgtttcttacgtaaatgatttgatacacgctatttcacaaactctttttttccagccagctcctgtgaggtgggcagaattatttgagtgccaagagggcatctgctgagtaggaaagctatttctggatcccagggcattatccaatggaaaaaaacccgaattcctagagttgatttctaaaatgccacgtgccctcctcacacagccattgtaactattggagctgtgtgttagtgacagggcacctatctgacatctactgccttggagaccccccaccgagaagctggagcagacaggacatcctcatgtattttatgactgtcttcagttccgtgtataaaaccttattctcataggatcacatgaagcagactgggaacacctactagacagtccacacactgctagtccaggacatgtcagctccctgggccctgggacagcctcatccggctctaagtgaaccgtgtcaccacatgaacagcatgacctcggtcacgacctgaacggcaggcatcggactcatgaagaaacatcaggaggcagcttccagagaagagaaagccttgttagcttaaagagcaaagcgtccccctccagccatctcactaacagaatcccaggctccttcttctcacgcccagttcttctccaaaaactcaccgcactccagtgacccttgagaaagctggggctgagccacgcaacctaaaaccagctgtccccaactggaacaaatacctgtctacataaactgacatgcgctatggtttggatctgcgtccccaccacatctcatgttgaattgcaagccccagggttgcaggtgcagcctggtgggaagtgattggatcatggtttataccatagccttggagctattctcctgatagtgggttctcacgagatctggccatttaaaagcgtgcagcccctccctcttctctctcgctcctgcactcactgtgcaagacgcctgttccctcttcaccttccgccatgactgagcgtttcctgaggcctccccagccatgcttcctgtacaccctgcagaaccatgagcccattaaacctgttttctttataaactacccagtctcaggtatttctttacagtaatacgtatatggcctgatacaacatgacacggccaattatttgcatttaaaaggcatctacttaatggtttatataaataatgaactcattggaaacctaccttactctgcacacactcatttcacacacacctttatgaggaaggaatgccatcatgtttgtatgaaaatcacacaccttgattatttccgaaataccaaagcacagcccggatctgcttgacaggaagatccactctctttcctctctctctgtgatgtattaaaacctggaattttaggccaggtatagtgactcacacctgtaatcctagcactttaggatgccaaggcaggaggatgacttgagcctaggagtttgagatgagcctgcgcaacatggtaaaggcccgtctctataaaaaacacaaaaaaattagccgggtatggtggcttgcacccgaaggcccagctagttgggaggctgaggtgggaggatagattgagcccaggaggcggaggttgcagtgagctgagatcacaccactgcactccagcctgggcaacagagctagactctgtctcaaaaaaagagaccaaacaaaaaccctgaaattttaagctctttacgggaacaaacttcagaaaggaggaaaacactgatatgtcaacacctgaggaacagcataaaacaggagcaacagaaggtgacaggtaagaggtgaggacagaccttggctagactgcctgcgcgacacctgctctgtgtggctgtggacgagtcgtctagactgcctgctctctgcactgtggaggagtcgtctagtctgcctgctccccaccctctgtggagcagtgactctagcagttcccaccacacacagtcatataggactctgacccaatgagaacagtgttaagcgcaacatcagttccttcttatgcactttcatgaacatgatgatgactgggaataatcaacaaggtcacagaataaaaataactgcagcaattagagtgggcaggtgcttttctttaagcaggtggataaaggagaaattaactccacaagtgcttactgaaggcctgctacgcattgggggatgtcgctggtgccaggaacacaaagatggggaagaaacaggcaaaggccctgccctcatggagcttagaactgaatttatggcaggaactgagaaaaaaatgtcacgagaaaaaacgtgctgcggtcattgttttggcacttgagggaaggggctaatccatggcgggaagagggctgagttccggaaggaggaggaaagagagatataggctttactgggtctgcatcataaagggagaaagactggggggttactagagatgggggggagagaagtagctcagccaggggaggggaagtgggaggccatgacagaaaacagccatgcatgggtccccgcaaggggaaccaccctggcaggtctaggaactgcaactccctgacactagatgtttagtggtttttgaccacgtgttcgctgccacacacaagactcagctgccgtgtgtgctactgctacccatagtaacattttttttttttttttttttggagacagagtctcacttttttgcccaggctggagtgcaatggcacaatctcggctcactgcaacctccgcctcccaggttcaagcgattctcctgccttagcctcccgggtagctggaattacaggcgcccgccaccatgcccagctaatttttatatttttaatagagacggggttttaccatgttggccaggctgatctcgaactccacagtaacctcttaatgctcagacagttggcaccacctgcatactcaagaccctcctgtgccgtcccaccccacttgggacaaaacgggaacctcactgtggcctccaaggctgtttgtatctggcccccatggcctctcagacctgccatctgctgtgtccccttcactcactctgctgccccacactggcctccctgtggccccctcacacacccagggagcccacctcggggctgtacatgctgccccttcccacctggacacccctagagccccctccaccctgagcaccgtccctggctgcactcagatggtcggcctgtcccggcgccctcggtcacctctaccccttcgctgctcctgcacagctgcatccatgccagccttagccattggtgtatctactgtttgtctcccagctagcaggtgctctgagagcagactcacttcagttccctgctccacccccagtgcgtgaaacagcatggccaggagttatgaggaaggccggggatgaaggaaacttagcacgggtgacagggacaaagcggccggaaaacccacagacgtgttaggaggaggggcctcccactgcacgcaccacggaggtcccagctacttggacacatcagcaaaagatgcctttgaagacccaggcgctcctgagtcccaaatgcactcacagtaaccccaaacatggaatcacccccgcaaccagcagtcacaaaaaacccattgattttccttcttcccggctcgcatgagcatcaggtatagaagggaccttccttggacactcggctccctgggcctgacggtggactcatcctttacaaggcggctggagacgacctgattcttccatccctttcccctgtgtgcaggttttactgggctgcgtgaacttgctggatgattctagaaagctgacaggggcagggatgtgacaccgatttccacagcatgatgtgctgttatagaaagcactgctacaaaacagacacaagagatgcaaacagaagaaggcagcttatgctcattcgagttaattaatccagaggctgtgcagggactcacagggtttctcggtggagaaggggcactgctctggggaacgctggcacacagccagcgcgtgtgcagcaggacgacctgtatgcactgtcaccacgggacggggccagagggatgcacccaccaactcaggggacaggtggagcgaggcaggagccagggtaggagcagggtcaggagggctgtgggagctgtgaggagggacccagattccgccacagggcatccttccccccggggggacagagctgtccacggcagctgcgagtgacgaagccttcttcccacagccactgctggctgcagccaagcagatccagttcaagtgcccagcgcctgccccaaaacgtggtcagaccacaaagcagacatggcagcctttgagaaatcagtgaagcaacactgcaggccccctatagcaatggcttcatcccaaaaaaaggtatatatgtatttattctatgtatctatacttattctatatttattgcatacttcatgtatattatatttttatatttatatattgtaaataacaaagtaaaagactcggagcatagagacgatgattgcaaaaataactgttggattgcagtaggatcagaggtcaatatttttaaatgttctttactgttagtatgatacttttaaagacagataagtgttcgcgcgtgtgtgtgcgactgtgtgcgtgtgagtgtgtgcgtgggtgtgtgcgtgggtgcgtgcgtgggtgcatgtgggtgtgcaagtgtgaggtgcgtgtgcttactggagatatagacgtgatcagaaagtgagctgcataaatgtattagcgattctctgagctgggtctaattagacattggtgatgggtctgaacagtctttgaagttcagagatgtgactctaggacagggcagggtgggctgacccccacctgggggggtgatggctgtgtctggtcctcagtgacaggggtagccaaggacatgggtgcaggagtggggcaggagggtgcaagtggagaaacgcaggaagccaagtcagcatgacacagccgagctgccaaactttgggatgtgggtcattttgaaagcgctctaggctgatccaggcctggagcatggctgtccacacagaaatcccatccccagcaagttcccccaacatgctcccctccagctcactttccagcctccacccacatccctgcaggcacacatggaattcagaagtgaagaagggaaagagttgccaattctgacgggaaggaaaatggcaagcagagaactaagcagctgggtctgtctcctagagtgggttttcacatcgagggattatcaccacgctaagggatggcacgcggggaggtcaagcttactttccccccttcagagggatttagagtgaaacataactagcaaacaaggaaatctaaatgagaaaaaattatcaaacagatcaaaataaaaccttgtcataaacactattttgtttctggctggagctaaataaatgcaagatgcagcattttgagaaacagcagcagctgtcctgttgggggggtggcggtgggcggtgacatccacaacccccatgttcatcaccgagggggacaccacacacatggcgagctacctccttccctaggaactcagcctcaaggagctcctattctccagtcagcctaagaaaaccccccacaacagagtcaaattctcatctcattctattgccaatgacatgagagaattctggggcaagttatttccttttaaagaagtctgtggttgccatcattttatcttttacataaaagctcccagtgtgtgtgagagacatggagatgcatcgctgaacctggtaggccgcaggcagcttcccctttctggtctgaggtctcacaagctccagccatctgcagcacatcaaagttcaaacggctgggagcacaggaagactgaacagtggtccctggcttttctcaaggactccagagagggcatcggaagccctgagcagccccaccgcccaccccagggctcacaacccctctgccaccacctccttgtgctctaggcactgtggccgtcacccactgcttgccaagcctggttccctctgtccactcacagggaagacaacttcctagaccccttcattagctaggcccatgcggccaggtctcacccatgcgttgtgagcagaagacctgagtgctgatgccctgtgccaagtcctccagaatcacaccccccaccgccacccccacccccagacgccctgtgccaagtcctccagaatcacaccccccacccccacccccagacgccctgtgccaagtcctccagaatcacatcccccaaccccacccccagacgccctgtgccaagtcctccagaatcacaccccccacccccacccccagacgccctgtgccaagtcctccagaatcacaccccccaaccccacccccagatgccctgtgccaagtcctccagaatcacaccccccacccccacccccggcagtagcctacaatgctcacagtactagagttgctggggtccctgaggaacaacagtgaacagaagttcccaccaacccaatggacatgccgcagaggcaagaaacacacttgagaggttgggggctgtttgctgctatggtgtgagttaaactctccaggcagatataggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtaaatcattgataaaatcaggtgtcttcataatttctgtagtgctgaggctaatgagcttcaatgtcttcctcttctctcccctttacctcatttccccccaccccaaggtttatactgtttaattgttgttatattggccaaaacctgggttgaatttttgccttaaactctacatagtttcagtcaaataatactacagaaagcccaagttaagtatgcttttatttttaaaaccaattttagtagtacagtgttttggaaagctgaaatagtaagaaagtttacacatgtttggttaggttaaatatttgtttaagtgcattttaggaactttgtttctcaacttaggtgtaaacaaaattctcctttccatgattactcaacaagatagattgcaagctttatcagttccagactgtgcagcttttatatatcaagtctttaccgttgtccagagtgaaaaattcttaattgaattaacccatagtaagtcttccagtttttattgaattggagatgcataaatagatttgcatttttcttgtacaaattgcgttccaccaggaggatatgcccagggtgaggctatttcatgagggacaagttaatttgaccagggcctgcaggcagtagctggcttagaatacaaattgaggagacgtgttccctatgagaatcggaggcagctttactcctgagacaaggaatcagggtcagtgactaggagttccaacagcaaaccagagcccccacttggatttcctggggatcgaatagctgtatctttgtggtagaacttgaagtgctatgatctgcctacaggaaagccaaggtaaaatgtctctgacttccctctaatataatgatggggcttcttgcagtcagggatcttctccagatttgctagtgatagcgcggcccaaagagtatgtgagcctcagcagctccccacctcccactccagattggggcgctttttaaatgcacgtacccaagacaaaaattatagaggcatcaagtgctaaatagaccagcccctggctggttcttagaaacctatcgtgtggttttcaaattttacgtaatttttgttaaagcatttagcctgtggtgaggcatatttgctttaacatgtgcttattacagaagttatgtttcactgtagaaatttctggaaatacaaatgcaaaataaaacacaaatctctgtcattctgcagaaacagcattcttttgaccccttttgttttattctatagatgtatatttttgtgtttacagaaacttgatcatactattttataacttgctgtttcatataaaattatcatgaacatcttttgtgtcatgacatgtctcttcttttaatgagtgcatagtcttccaaactacaaatcttccatactctgtttagtgttcctccactgctagaaattttggttgttcctgatttttattttcccttttataaatgtctctttggtgaacgttattagacttacagtataatccagttgatacataagcgaatgaagacagtaaccctcaaacagatgtgtgtgtggcatgtacattaactgctatcctttcagcactttgttttgttgaaatggccatttccattatgttcaggaaaactcattttgggaagaataagcaataaatttgtaattaatgaaatctggttcagtttttcagtttgtccaggttttaagagaagttaggcactggcctagctttaactgatgtctgttgccagtgagttgagatcatcaggattgctctgaatacatgccagataaggacgctgagtaccagcacataggcacgggtgaatgctgcttcaaatggtacaaaatgatgttcacccataaagcaacaagaacatgttaatgacatacgttgaatggcacctcttgaagtccaaagtcaggagctttattgattaccatatgaagtgtttcctgggatgcccagcatgtttccagaagagctgctggggtgcatcgtggttttatacaagcttggccatgaaaggacagatactcaaactattgtatgttttcatcttttaaaacaaaccttggtcatagaaaaccaacagagtcttgtccacctttgtcctctaatgcctcccaacatgttatcttcctgaggggagaccctaaatagatgacctttttaaaaaataaaaagatgacttttttaaaaaataaaaaatctaacagttgctcatcttgaagttatttactctttgttttattatcagtttcattttccagtttttgtatttgaaatattttggagaagggaaagatattttagagaaaattccccgaaacaataaacacaacatctctttttcggtaaaattgctgtgcattttctctccctcttccacgctcaccataatacactattatgatttttatactgcagggctgttagtctttgcttttgatgaactattagttttcatttccatagataatgaagtgtgtagttagttggcttggtgatgagaaagaatgttaatatatttctgcccactttaccagcctgtccacagtgctgcagatttattttcagaagctttcttaaagcttgtaattggatggaatttaaagtgttttgtgtaattcaaaattgtcttttaaagtactttcttcattgttgaaacattatcatgagctactgttgaaatcattatttcataacatccttacgtgggttttttagactttgctccagttcatttgctgtgctgctttcgttcatcaaatgcctgattttagtaactctttaacatagttacctacttaactgtgaaacaaaacacccactcaaatatatttttaacttaatgtaagtactgctttaatatatgatgcagtttaacctgttttcctgaagatgcgtctatgtgaacggcttatagatgtttcattggctgcgaagttctcatgttccacacctcagggcagttgcatgcacattcagagatgataagaacttattatttcagctttccggatcagtttgaggagtgtcttgagattttaaggcaaaacagacatgtttgttatttgacatttgcactgaaatctgtggctcggggctttctggatacagtgatgtcccaaaaattcagaaactgggtattaaagctgttgaaaaatgttacttctcctcccttccctccaattttaaatttatgcctatcaaaagtcatgctctttttaccaggtgactgaaatgatatttaagttgcaaatctggccttaaaaacatatcagtcctttacttgtctatcttaatagatgtctgtttttcaaatgaaactttctgaagctccttgctgcatgttcttctgaatctccctgtgcaggtctgtccaaagacctaacccaccgccatcagtaccacacatgctgtggtttgggaatgttgtggtttgcttcagactttgtctctgatcctcttatttggatgccatgggagaagttaagacaggaataagtagattgtttgtttcttttttcatttttacttttagaaaggctaagatgctcagaattggagctgtcataatccttgttttacaagagtttatcattgacccctgcatatcttttattttccttattaataaggaaatgataataaggaaataattatccttaataataagcccccttgagcccatctcccaatcctggaactaaaccatggcaatagccaccgttcacccatgcacaccaccccttcctgtctccattcacccatgcacactaccccttcctgtctccattcacccatgcacactaccccttcctgtctccattcacccatgcacactacccccttcctgtctgcattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccaccccttcctgtctccattcacccatgcacaccaccccttcctgtctccattcacccatgcacaccaccccttcctgtctccattcacccatgcacaccacccccttcctgtctccattcacccatgcccaccacccccttcctgtctccattcacccatgcacaccaccccttcctgtctccattcacccatgcacaccacccccttcctgtctccattcacccatgcacaccaccccttcctgtctccattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccaccccttcctgtctccattcacccatgcccaccacccccttcctgtctccattcacccatgcacaccaccccttcctgtctccattcacccatgcacaccaccccttcctgtctccattcacccatgcccaccacccccttcctgtctccattcacccatgcacaccacccccttcctgtctccattcacccatgcacaccacccccttcctgtctccattcacccatgcacaccaccccttcctgtctccattcacccatgcccaccacccccttcctgtctccattcacccatgcacacctccccttcctgtctccattcacccatgcacaccaccccttcctgtctccattcacccatgcacactacccccttcctgtctccattcacccatgcacactaccccttcctgtctccattcacccatgcacaccaccccttcctgtctccattcacccatgcacaccacccccttcctgtctccattcacccatgcacaccaccccttcctgtctcctgacctctctgctgccaaagtggatgctgttgaaattatcattcccttgcctgttgaaaaagttttaacaaatgtacatgggtcagtattaattactatttatttttagttggttttgaacttaataaaatttacagcatatccttgtccaaatttgccagtttttcttttatagacagagttttctgtgttttaaaacttttgctctaacccaaagtcagaaatatgttcatctgtattttcctagaagtttataactttaaatctctagagtagagcgagttgatttttgcatggtctaaaataagggaacaatttcccttttctccatatggaatgcatagtcgttttccacctccatgtccctttcctgaagaatgtcttcttttcattttggtttttctttttgagtctcgctctgtcacccaggctgaactgcaatggcacaatcatagtttgctgcagcctcaaactcctgggctcaggtgatcctcctgcctcagcctcccgagtagctgggactccaggcatgcaccaccttgcctggcttctttttttccactgatcttccatttaaacctcactcacacatcacagccccataaatgtgaagggccatttgtcattgatcagttagttgatctatcccagtatcagcatcccattgttttaattactatacttacctacatcctgatgtctggtaggacactttcctttatgattccaaatggattttagaatatatttgtaacattcatgaaaagtttaagattttattaaattgcatagaatcaataggaatatgtagggagagtaaacaatctttacgattttaggttttaccatcctccaaatggcttattatcccatttacttgagttttaaaatgtctttcatcataaagtttcataattttctgtgtactgatattgtacatttttgtttgatttattcctaagtgcttttagagttgccattgtaaatgttttaaggattatattttctaatttttacaagtatatgtaattgagctttttaatattgatcttacatctagctgctttaatacacttttatttctaatgatttgcctgtagtattttgtgttttctatgtaggcagttgtatcctctgcaaacaatgataattctgttttcttctttccaatctttatgctttcactttattaaattttctccatttaagattacatccattataggatttttataaacaccttttaccaggttaacaatttattcatagctttctaagagctttcaaaggcatttctgttgagtttttttagtttttctatatctattgagatgataatatggtttttatcttttattctgttaacatagttcatgttagtttaagattttctcagattcaatcattcttgcattcctgagataaactaacttggttcttttttttaaatataccattggcttttgtttgctaacattttgtttagagtgtttacacttacattcatgatgaaatgggcttataattttttcatttccttactatctttggttttgtatccaggtatacacttctcttaaaatgtcttgaagggtgttgtctttttattttttggaagggtttatataagattggggtgatctgagtatttggtaggattctttttgttaaactctctaggcctgaagtttttcttatggaaaaaaatttaactattactttggtttcatttgtacttatcatttttttaagctttcaattttttattaatcagtgtcattattttacactttttccaggcatttgtctatttttttctgggttttctaatttattaatagagagttgataatacttcatctttataaaatcggctgtatgattatgttctttttaatttaaaagtattattaacatcttctgtttgttgtgatcagcctttccagctgtatttcctttagtctagttcaaagttagttcacatcaacttcgtattgttgttttctgtgtcactggcttctactctttatctcttttcttcagttatcttttcttcctatctaacatcttaagttcattagtgtgtcttttctcgtataaagttataaatttcccttgaagcattgctttccctgcatcctgcaagcttgtcgtgctttcattgtaatccagctctctctctctatagctgatacacgggttctttagaagtgtattttataaaatttctaagttagtgccatttgataatttaacttccacttagtagccagggttaatttaccatgttgttggaaaccagagctcctaacatgaaccccaagtttttaaaaaatagtaaccaagcttagttgtgattttctggtgtattgttcaatctaatcagcactgtgattagtattttagttttgtaacaagtttttttctgttactcagcttcgtactcttagtactgcagatagaataggtattttaatcttttctgatgtcttcatttccaggttttggaatgtaatacatttgaaaatagtgctgtgagacagtggtccactgtcttgtgtttctacctgtctggtgagaagcagtactgactacctttgtccagatgatgtttgtgaggttgtttgtacagcagactgccccagaaggtagagatggtgtctcccttcagagcagagggcaggcatgcttacaggccagcgtcataaaaataatatcttgcttcagggcaaaagtcagacaaggttactgcccattataaaggactccggggtccctcagcccaggtttcccctgctccaattcagccacctgtgtgtgtgtggcatcactggtcccgttcactttgctcctttggaattagagcttgggcaatgggtaccagttatactctttttgcttctgaccacatcttctgtctctgactcaaggatctcatgtcttgtttcctaccccttactctgaagtcatttgtcatagaccttgtttggtttgttccctctctttctgctcctcttcccctccctccctttcaccctttctttttgttgttttctttctctcctctcaaacaggtgagggctgtatgcggcccacccatcactgggctagacggtgggctggcttggcctggtcgttgtctctcacctgctgggcagcttcttctccaggaccggtgcctgcacaacttacctggtccctgtctcactgctttgaagcctcctgccttccccacatagttctctgtgcactggcacatatggaaaatcagagtcccagcaggtgctgtccccggggccctcgccctctttcccctcttctgtcgtgtggatcgcactccagggctgtgtccctagaatggctgtgggcgtctcactgttctctccctgcttcctactaagttcctcaggagttgctgatttggatgagggacaaccagcagcacatgggcctgaggaagaggaagggctgctgagccccggcttctcgccaaggtgaggccgcctgccttctcaccgtctccgcttcggaaacaatgtcttcaggaacaacgcgggtgagacagcgctggaaattctcgctggggccgtgctctctctccttttccctcacagtgtgtggagattacgccccaaatctgacgcaagtccagccatctctacaaggattttattggaaaattagaggcagctgttttggtgactgctcatcaaatgctatcagaaggcagcattgttgtttaaccctttcctcccccgtcccttttcctcctactctatccccagagaagtcttttaagaagggactagaaaaaagctttattattttcaatttgtatggttacttacatgtgtcttcttcttctggtaactaaatggaatagggattgtgaagtgcggaatggtcacgaggctggaggcaaagaccccagcagaatggtagggaggctggaggcagacaccagctgtggtagatgaggccaagccagcagagagggtctgagtgtcagagaaaatggagaagggccagagaggggtgaggatgcagacaggccacctgcgacacccatgggggcatgcgtaaggggtccttgaaccttaacagagatgctgctcctgataagggcctgtgaccacgagagcctttccccctagtcaccgtcctcacatgcgtgcgtcagtgacctggtgaatattcaatgtgatgacccggtcactgtcatcacgtgtgtccatcagttacctggtgaatactgaatgttgtgatgacccagtcaccgtcatcacgtgtgtgcgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaacgttgtgatgacccggtcaccgtcatcatgtgtccgtcagttacctggtgaatattgaatgttgtgatgacccggtcaccgtcatcacatgtgtccgtcagttacctggtgaatattgaatgttgtgaggacccggtcaccgtcatcacgtgtctgtcagttacctggtgaatattgaatgttgtgatgacccggtcaccgtcatcacgtgtccgtcagttacctgttgaatattgaatattgtgatgacccagtcaccatcatcacgtgtgtctgtcagttacctggtgaatattgaatgttgtgaggacccggtcaccgtcatcacgtgtctgtcagttacctggtgaatattgaatgttgtgatgacccggtcaccgtcatcacgtgtctgtcagttacctggtgaatattgaatgttgtgatgacccggtcaccgtcatcacgtgtgtccgtcagttacctggtgaatattgaatgttgtgaggacccagtcaccgtcatcacgtgtgtccgtcagttacctggtgagtattgaatgttgtgatgacccggtcaccgtcatcacgtgtgtccgtcagttacctggtgagtattgaatgttgtgatgacccggtcaccgtcatcacgtgtctgtcagttacctggtgagtattgaatgttgtgatgacccagtcaccgtcatcacgtgtgtgcgtcagttacctggtgagtattgaatgttgtgatgacccggtcaccgtcatcacgtgtgtccgtcagttacctggtgcatattgaatgttgtgatgacccagtcaccgtcatcacgtgtgtccgtcagttacctggtgaatattgaatgttgtgatgacccggtcaccatcatcacgtgtgtccgtcagttacctggtgagtattgaatgttgtgatgacccggtcaccgtcatcatgtgtgtctgtcagttacctggtgagtattgaatgttgtgatgacccggtcaccgtcatcacatgtgtgcgtcagttacctggtgaatattgaatgttgtgatgacccggtcaccatcatcacgtgtgtccgtcagttacctggtgcatattgaatgttgtgatgacccagtcaccgtcatcacgtgggtgcgtcagttacctggtgaatactgaatgttgtgatgacccggtcactgtcatcacgtgtccgtcagttacctggtgaatactgaatgtggtgatgacccagtcaccgtcatcacgtgggtgcatcagttctggtgaatactgtgatgaactactgtaccatctgattaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttacgaatgccaagtttttcatcaccggtagtgaccacccaaaagtctccagacttgttctctgggaggcagtatgtgctctgctcccactcccatccgctttgagatccccagtctaatctaccataaaccatgggttacgctttccccataacacagcaacgctgactcctcgcgtggccaagctgcgcctttccatggccccatgttcatgagtcaggagagcagctcctcaatcgcatgtgtcttaaccaaatggaactctactttcaaagtaacgttcaacaggcatagatcaacctgttagactctacccaaaatatctcatcgtggcctccctccctatgcccaagacaacattcaatattcaccaggtaactgacgcacacacgtgatgacggtgactgggtcatcacaacattcagtattcaccaggtaactgatggacacacgtgatgacagtgaccgggtcatcacattgaatattcaccaggtcactgacgcacgcatgtgaggacggtgactagggggaaaggctctcgtggtcacaggcccttatcaggagcagcatctctgttaaggttcaaggaccccttacgcatgcccccatgggtgtcgcaggtggcctgtctgcatcctcacccctctctggcccttctccattttctctgacactcagaccctctctgctggcttggcctcatctaccacagctggtgtctgcctccagcctccctaccattctgctggggtctttgcctccagcctcgtgaccattccgcacttcacaatccctattccatttagttaccagaagaagaagacacatgtaagtaaccatacaaattgaaaataataaagcttttttctagtcccttcttaaaagacttctctggggatagagtaggaggaaaagggacgggggaggaaagggttaaacaacaatgctgccttctgatagcatttgatgaacaatcaccaaaacagctgcctctaattttccaataaaatccttgtagagatggctggacttgcgtcagatttggggcgtaatctccacacactgtgagggaaaaggagagagagcacggccccagcgagaatttccagcgctgtctcacccgagatgttcctgaagacatgtttcgagagcggagacgtgatgagatactggtttattgacccgactctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtgacagacgccttttaaaagatcatgtttaatctaggaggatgttttctttttctagagaggatttgtttttgcttctgccagatgtttgggggcaccagctatcctgcttcaccttattccagatgtaaagactgaaattatttaaagctggttagactgggtcgcggtagcctcacgccctgtaatcccagcacttttgggaggccaagacggctgggatcatttgaggccaggagttcaagaccagcctggcccacatggtgaaaccctctttctactaataatacaaaaattagctgggtgtgatggcatgcacctgtagtcccagcttctcgggaggctgaggcacgagagtcactcgaatctgactgtcagaggttgcagtgagccacgatcgtgccactgcccttgtgcctgggtgatagcgtgagactgtctcaaagaaaaangtttatgttgcttcagggactattttggttctcttttactcctaggtaccactgctatggtgggccttgggaattcaacttggggtcccttttgtccttgtgaagnaaattaaaagccctctttcaggtcggggcccgggaagcctcaacgccctgttaatccccaacactttttgggaaggcttgaaggcggaacgggaatccccgaaggttcggggaaggttcaaagaacccaattccttgggcccaaacaatgggtggaaaaaccccccgtctctcttaatttatgnaaatttttataaaaacaaaattttatgccccccgttctattggtttggcctctgtcccgcccctcggttaatcccccacgcctttacctttgggaaaggcctttcggagccacggaagaaatattgctcttggtacacccccggcaggccggcagggttttgaactttgagcccccggaaattgccgcccctgttcccttccaccctctggggtggaacagaagtgggacctttctttcctcaaaaaaaataatataaaatccctcagaacgaacccccagggaaggccttcttaaaccttttgggctttatatttttattggggcgttttccggcgagaaatataaacgctccccggagaagaaagcaccgcctttttggcccacggggctcttggattttgttttgccacatactggccacttttttgttcctgttt

SEQ ID NO: 708 - DNA, 212708 bp, Homo sapiens
  misc_feature (1)...(212708): n = A,T,C or G
tgaggttgggcacatttcctgcacttgcagtctgtgagataagtgtttcctcaaaaaaaaaaactcccttttctgctgaagaatgtcacttgattttctgtaaattgtaaacacacccacacactcacaagactaagaaatccaccgttcaatccccaatttttttttttttggtaactttatattccttccatcacgaggtcagaacatttcattgctgctgtgagactctccagagttctcattaaagagttcaagacaatggctgttccgttagcctcgatctctgagtgattacagagagctgagccatctgggagacccatgatggacatatagtgtgagtgagaattaattcatcactgctataagccatgagacactgagagtgctttgttattgcagcataacctgtcctatcctgatagaatcataagaagtgctgagagacaatttgctggaactgatatttacagggagaagagagccagagaaagataagacaaagattggatgcagtggcttatgcctgtaaccccagcactttggaaggctgagtcaggaggatcacttgaagccaggagttcgagaccagcctgggcagcatagcaagaccctatctctacaaaattaaaaaaaaaattaacgaggcttggtggcatgtgcctgtggtcccagctactcaggaggctgtggtagggggatcactggagcccagaagtttgaagctgcagtgagctatgattgcgccactgcactccagcctggacgacagagcaagacccagtctctaaaataaattaattaaattaattttttaaaaagaaagataagataaagagtcatagaagtacaaatgagaaaccaggagaacatgggacccaggaaagtcatggaaaccaagggaaaatactggtccaagatgcagaaagtagccagtgatgttgaatgcatccaagagatcaagtaacataaggaataaaatatatccacccagtctggcaactgagaagtctttggtaacctcattgagaacagaatccatggagtggaggaggtagcagtgatgaaatagcggacaagggctgaaggagtggagaggggagagcatgagggaccagtgcaagagtgcagcagaaagacaacaaacaggccgggtgtagtggctcacgcctgtaatcccaacactttggtaggctaaggcgggcagatcgcttgtgaccaggagttcgagaccaacctagccaacatggtgaaaccccatctctactaaaaacacaaaaatcagctgagcgtgcgcatggctgtaattgcagatactcatgaggctgaggcacaagaatcgcttgaacccaggaggcaggggttgcagtgacccaaagtcttgccactgcactacagcctgggcaacagggggagactccatctcaaaaaaacaaaaaaaaaaaagaaagaaagaaaagacaaagaaagaaagaaagaaagaaagaaagaaagaaagaaagaaagaaagaaagagaaagaaggaaagaaagacaagaaaatagatgtctttgagtggtagcaagagcaacactgaagtgatttgcctattctggacatttcctataaatggagtcgtaaaagatgtatccttttgtgtctggcctctttcacttaagcgtagtgttttcaaggttcatccatgttggagcatgggtcagtgtttcattcctttttatggctgaataatattcccttgtatggactttcgtgcttttgtgtatccatccatcagctgatggacatttgacttgtctgcctgttcactgccatatctactattcctggtgctcttgggaatgagtgaatgaatagcataaacagagctgtccaaggtcacagagctggtaagatgtgaagccaggatcggaagccaggccattagtcccctagagcctatgttctaagcatcaggctttacctgtgaatctcctctttttacagatgaagatgactgtatcactcagattcccggcaggaaagcaatggcatactcaagtggggtaactaatgatggaaccatttacaaaggtgtggacagagttaagaaaaagcaataggagatagtgagcttcctggggctggtaagagtggggagcccttaccactcccaggactaaaggagggagtggtgcccagaagccctgcctatatgcaactgagaagggcagggccagggagtcacgtccatcctcactgctctccagtctcctgaactggaagccagaaggtgaggggaaccctgatgcagtttgtatgtgtgagaaagtacaattagtttagactgaaaaactgaaaatctacccggccacttagcaggctggaataacagaaatggatcaagccagctgtaaagataacagggaacaataattctctgtagctgtaaagtgataatacaaccctgcatctttgagtgactgctgaaacattgtcctttaaaatcagagaccttcagaaacttcgctgtttgaaattacatgactaagactgaaatattccaattttgcctggaagatttaagtcatcttgacacagagaagcagcctcaatttacaactcaggagcagagcttcagataaagattttctggacacatttgacatgtatcttagctatgttgcttcctaggaaacagggccctgggtcctctttgcaatccagactgaagttgactgctttgtacaaacctgttttgctttgagtccatcaaaacatgacttcatttagattttatctcaactccactttcctcggaatcctatactaaattgctgttttcctttgtttggtgatgtgcgtagctcttctggtgggtggtgtccctcactgaataggtcaacaaacctaactttgttggactgccactgtgtccctggtgatctttggctgattggtctaggtcatagatcgacctgccggggtgcagaggagggtggagagtaactcagagggtcaagcatgaaagatctggcagaaaaataaagcccctccacccccaccacccctacccctgcaaatctgatttcccccaccaactgcagaccagagtattataaggggcggtggaagaagagggggagatcttcatttacccagagctcctatacatcaggggctgaataaagggttgtagaaatgaatgaatcaatctctgagtggggcttcaggcagtggaaagatctcagtccttttctgaggcataatggaagctcccagtcttgtgacatttgcaaggctgcccctttctcccaagagacatgagaccaaaaaagtgaaaggaaaggggggaaaagggagaattctgaaaatgcccatcctctgaacaccatctttgtgtaggcatctgggggaggccagctggggtgaggtcatctgccagccaggcccgtaggacttggcgcttcttgtttatcacagccacatgtggggccactgccagggcccgccccaactctgcagtcattggaggagcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttggtaagtgggatctggggaggacccagatctctgcagtggccgacagcacagaaagccccagcgggcagcttcaggtgcacattctgaatctcacatggttttcgaatctgagacgtgctctcacagccagctgggcgggagggaggaagcagcagcaggcaagaggaaacggtgccaggctgcagcagagagaagccacaggacaagcgggattcctttctgctctacttcaggcccgccagggcgcgcagggcagggcgtgcctggggaaggtaggaaagcgcagggcaacaccctggatccccagggaggaggcgaggatctcagggcacgcctggtgatcatgctggcatctgagtcaccatgcttgggaggaataggaccaggcttgaaaatgtgttataactttaggtcctcaccaacgtcaggaaggccctgctttttggtttttgtttcttctaaaagaaacttactgagatataatttatacaccatacaattgacccatttaaagggtaccatttaatgattttcagattattcccagagttgtgcaaccatccccaaaatcaattttagaatattttaatcgactcaaaaggaatcccacactccttcaccatcatttccaacactgttcctcctccttcccacccatcaatttcctttctgcctctatggatttgccgattctggacatttcatataaatggaatcacataatatgtggtcctttgtggcacttagcgtgttttcaatgctcatccatgttgtagcatgtgttgatacttcattcaatttttttttttaaagagacggggtctcactattttgtccaggctggtctcaaactcctggactcaagtgatctgcctgcctcggcctcccaaagtgtcaggattacaggcgtgagccattgcacccggctgatacttcattcctttttacggctgagtagtactccattgcatggatagaccacttttttctatccattcatccattgatggacattggggttgtttctcttttttggctatcatgaataatgccacatgaacatttgtgtacaaggttttatgtggatatatattctcctttctctcgaatatgtacctaagagtaaaaattgctaggtcatatgttaactatgtttcacctttggggggaatgtggagctgaatttcacagcagctgcagttttttacattcctatcagcagagtatgagggatccaatttctccacatcctcaccaacgcttgttatcgtctgtctttttgggttttgttgttgtcattttgtttttgtctttgagatgaagtcttgctctgttgcccaggctggagtgcagtggcgcaatcttggctcactgcaacctccacctccccggttcaagcgattctcctgcctcagcctcatgagtagctgggattacaggtgtgcgtcaccactcctcactaatttttgtatttttagtagagatgaggtttcgccatgtaggccaggctggtctcaaactcctgacctcaagtgatccgcccaccttggcctcccaaagtgctgggattacaggcatgagccgccacgcccggctgattgtctgtcttttttattatagccatgctagtgggtgtgaagtggtagttcattgtggttgtgatttgaatttccctgatggtgagtgcctcttattctctgtgctgattgataatgatgatgaaggcaatttgtatctatagagtggcagtgtagtttactaagagttagggtaacttatttcatagtactggctatgtcttctgggccaagtcattaacttctctgagcctcagtttctgcatctgttcatagggttgtggcaattaaccaaaaaaaaaaggcatgaacagcccttatcatgatgactgacataggataagagctccataactagtatctatttttaaaaataatctttttaagtctgggagtggtggctcacacctgtaatcccaacactttgggaggccgaggcgggtggatcacgaagtcaggagtttgagaccagcctggccaatatggtgaaaccccatctctactaaaaatacaaaaattagtggggagtggtggtgcacacctgtaatcccagctactagggaggctgaggcaggagaatcgcttgaacccggaggcggaggttgcagtgagccgagatcaagccactgcactccagcctgngtgacagagcaagactccatctcaaaataataataatagtaataatttttttgattatataatagtatatatgtatataaaatacatgtatgtatttttatctatatcctctgctctgaccctcaaagtaaccacgtccaagttcaggatttgaaatctggaaacgtggattcaaaaatccttcacctctttgagccttggtttcatcatctgtaaaatggggagaattgttgataggaatattaaatgaactaataaatgcaaagctgtttgagaaatatatggcatatagtaatccctgattaagtgttagttcttattattaataatgctattattaggattattattattcgattcatatgtttactgttcaacaaatattgaatgataaacatatatgctgggtccggcatggtggcccatgcctgtaattccagcactttgggaggccaaggcgggcaggtcacttgaggtcaagagtttgagaccagcctggccaacgtggtggaaactccgtctgtgctaaaaatacaaaaattagccgggcatggtggtgggtgcctgtaatcccagctactcgggaggctgagacaggagaatcacttgaacccaggaggtggaggttgcagtgagccaagattgcaccactgcactccagcctgagccacagagcaagactctgtctcaaaaaaaaaaaaaaaaaaaaaaaaaaaaaaaatatatatatatatatatatatatatatagtatttttagtagagatggggttttgccatctcttatatatttttatatatttatattttttatatatttatatatatttatatgtattttatatatttatatatatgtgctgaaatctaaaataagacatatcacttaaaccagctatcacaggaccaatggtaaagagcataattagtaaatgcccccttctgcattaatacgtagattgtatgtcacaatttcatgtagcaggtgatggggcttcctgacattcttgggcccagcatacaatctttttatttcttttttagagacagggtctcattgtgttgccctaggctggagtgcagtgtcattatcacagctcgccacagcctcaacttctcaggctcaagtgatcctcccgcctcatcctcccaagtagctgggaccataggcacacgccatgatgtctgactaattttttatttttttttgtggagatgggggtctccctatgttgctcaggctagtctcaaactcctggactcaagtgatcctcctgctttggcctcccaaagtgctgggattataggcatgagccactttgtctggcctacaattccttttctttctttctttcttttttttttttttttttgagttgagtctcactctgtcacctaggctgtagtgcagtggtgtgatctcagctcactgcaacctatacctcccaggcccaagcaatcctcccacctcaacctcccgagtagctgggaccacaggtgtacaccaccacgcccagctaattttttgtatttttggtagagacagggtttcaccatagttgtccaggctggtcttgaactcctgagctcaagcaatccacccgccttggcctcccaaagtgctgggattacaggtgtgggtcaccatgcccagccttcaatttcttcagattattgtataataataaaatttctaaaaacagattactatgagaacaccttgtaatgataaatatttttctttcacatggtgaaatcataacttacatgtatttaactccctcaaattcagttatacatgttccatggggacatggagagagagagaacaatataaataatgcaatgattcagcaaccgggttcgctggagtaggtgtgagatgggatactggcatctggtgttccctccgtcaatctctgttcccacgtgctttttagcgagcatcttgctgctctacttattaatctaggtacatatttttcagccacatgacccctaaaataagtcaactccttcaccttcacctggagcaaaactgtaaaaacagcaacttgttctagatctggaggcaaaattggttccagcagacccactgggaagtgggaggtgtttgctatgctttgtggacaatttaagtgtttaaaaggcaattttgatgagccatgattttcatcttaagtgccaactttagaagataaccttcatataaaagtttctctacagtttgtattttaaaatataaaatggaagaaaaaactatcaccagctttgcttttttcctcttggttaatggactatctattaacgtctcactaaatggccaaatggagtctcacagtacacagtttgggaaatgctgccttaagttgctctgtgaagccttaagttcgtgtaaccatgacttagccatctgtgaaatgggtagacccatggggcataggaattggggaatgtattttgcatcaagtaggactggtgtggaccacaggtggaaatccagacaggctcgagcaatgttcaggatacagcagcaagtgacaggttctggccagctgtccctactggggctgcaaggactaagagccaggataaggagacagggcctcggttattgaaaatgggatacaaagcagggactggttatggcggaaattaaccaagaggctgttcagcttcttctattctcacaaccaattcagatctggattcaaaggcagggatgcagctacaagaggagtttgtgttggaggtctgtgtagataggatgctaagcaggtctgtgtcagccaggatcgtttgggcagtaagtgacagaaacccaacttacgttaaccacaaagcctcaaaggggaatttattggatcatgtaactggccagttgaagagatggtgctgtcctcggacgtggatgaagataagagttcaaactgtgtcatcaggacggatccgtctccctacatcctggctccatttgcttctatttggcttccttcttgaacaactctgtatgtacaagatatcctcacattctcttcttttaacaacctcagaggagcaaacaagtctttcctgatagctctgctaagaaagtcccaggaaagactctgattgatcagatgtgagttacagatccatccctgaaccaatcactgtggccagggccaaggtgtcatcccattggccagcctgggtcatgtgctggctcccgtagcaggaagtagggagaagacgagggagccgtgtgagccctacgtgaaccacatccagtggattttccttaggaaggaagattctgtgaccagaccaaatggaaaaggaagtggggagggtaggcagacaaaaatcggtgatctattacaaggtctttccaaaagccagaaattagggatttctaagtgtacctctctagtcctggcttgtctcagccctgcagctgggctgtggagactccatcagcaattgctgaccccctattcttacctcggccccttcctgagtcccaccaggagccctgctcctcatctgggacatgcttcttggcccatggaggttgccagctcaccttggtactttactactatttggtttctgtgaccaccaagctgttgcttaaaccaagccgcctatggtggcaccactttggagaattcttttttattttttgagacaggttctcactctggttaccgagactggagtgcagtggtatgatcttggctcactgcagcctcgacctcccgggttcaggtgattttcccacctcagcctccccagtagctgggactattggtgcatgccactacacccggctcatttttgtatttttagtagagacggggttttgccatgttggccgggctggtcttgaactcctgacctcaggtgatctgcccccctcggcctgtcaaagtgctgaaattacaggcgtgagccaccgcacccggctggataattctttagattttattccaagtgggttgagaagccatgggaagattgtaagcaaaggaataaaagttggttgcattctctttggaggatttccctcttccctggagaccagtcctcacagaagcttttccaatggccacagaagactaaggaagattgagagaggcacaggaaacaattccactcagagctgctgcttcgccactgcccagtcagcctccactggcgccaacacgagcctatgctgtcattcctgggcccaggctggctgtcgctgtggagatggtgctgctgtgctagtttgtggctgttaaaatggagctcctggctggacacctgtttcccagtgggtggccacaaacctgtgagtctgggcctcctccagctgagtagaagtgagcccagcacagaggccggggaggccccagacgccaggaggagcaaatccaaatccaacccaagcatggcccctctgaccctgaccatctttttttttttttttttttttgagacagagtctccctctgtcacccagactggagtgcagtggcacgatcttggctcgttgcaacccccacctcctgggttcatgcgattctcctgcctcagcctccctagtagggactacaggcatgcaccactacacccagataatgtctgtatttttagtagagatggggttctgctatgttggctaggctggtctcgaactcctggcctcaagcgatccatccgtcttggcttcccaaaatgctgagattacaggtgtgagccactgcgcccagcctgcccctgactgccttcagaaaagtagaagcaggaggtctgccacattctcatcccatccttgacacctgggtgatgtgctagagcttgaggggaaggtcagaggtaacccagttcgggaagtgaccccgtaggaggagaagaatccagccacgtgacacacagtacgaagagaacagtaaatgcaaagacctggaaacgaggaacagcaaggacagcatgtcccagaacctggggagagaggagggagcagccggagctgagggcagctcaggggaagagttgctatttgattttcagtgcatgggaagccactgaaaagttttatgcagagaagtaaaaccatctcactcatgtttctagaagccttatgggccactgtgcagagcatagagtgtggtgggacaagaatgacggtgaggaaccagtgagaaggttcctggagtcaccagatgcgaggagatagaggcttgggctagaatgggctggcggagctagagagaggtggacaaagctgagatgtgttttggaggcagaaatgatagatttgccaggaggtgaaagatggctctagattcctgaggaacgatgatgccttttaccaacctgaagaagaccaaggagaggcttgaggactaacacggaactgtgaaggaggccaggcaaaggtggagactgccgtgagctgtgatcacgccactgcaccctcgcctgggtgacagactgagaccctgtcttaaaatatatatgtaataaaaaataataaataaagggccaggcgtggtggctcaacgcctgtaatcccaacactgggaggctgaagcaggtggatcacctgaggtcagaagttcaagaccagcctggtcaacatggcgaaatcccatctataataaaaatacaaaaattagccagacatggtggcacatgcctgtaatcccagctacttgggaggctgaggcaggagaatcacttgaacctgggaggcagaggttgcagtgagcctaaatcacaccactgcactccagcctgggcaacagagtgagaccccataaataaataaataaatacataaataaaggatatcaggcaagcaattaaaacacctgcctactaccatctatccgcatcctttttttcatgtctaacaccaaaacaccaaaatagctggaaacatatcatgtcaaaagataagcatgattctttcaaatgaatggctgtggacttatgaaaagctgcctccgcgtctgattttcttgtttcaaggggtaatgatggaggtttctctcctgcacctgcaggcctccggggatgctgccccagtgcagcctcccaccctgggctggagcctcccagccccgctgcatgggtagcacagtgttgggaagaggaaggagcagtttgtctggctttttcacaggcccacagctggccggtacagtggcagagaaggcgaggctgaggtggggctggggaagccagcaggggcctgatcatggagcgccttgagctgcatcccacaggtactgagaaagcatggagagctgtcccccagcccccagcatcttattagaaaatattgaaacataacagaaaacatgaagggttttatgttcatattttcattttagagagatcattctgcttgaaatataacacctactgagtactgctgaggacttaccatgtgccgggttctgttcttagcatgtgacatgtattggcctatttgattctcctacataatcctggaagattggttgtgggagtgggtgatcatgacctgaacagcctaaccatgtttagggaacactctgtgttatgcgttccaccacacaattcatgtcacagctgaatgtcccagtttcccttgcagctaggacacaacgggagacccaagctttccaaacatatgccccaggcaacactttgatacacaaggaataacactggatgctgggtgtgcacagaattcaaattcaggaatggagggaagtactgccctttgacccatacaataggggatccccttccttggaccccatggcttagagggccccactctgtccctctgcagactgtgagctgccctatggaatgaggggtgtctgaggctgtattaatttctatttgttacacagcagtggaaactaatacagtcccacaggcctaaatcaaggcgtcagcaggctgagttcctgcctggagactctggggaaaattcacttccaaactcatttttgttgttggcaaaattcaatcccttgaggctgcaggactgggctctgctcctcactggctgtcagcctggggccactctcagattctgaagtcctcccacattccctgccacatggtcctctccatctccaagcctgctatgacacaacgcattgttctcatgcttcaaatctctgacttctctcccgggaccagaagaagaatactctcttcttttaaggggctcatgtgattgggtcaggtcaactctatcatatcatggagtctcaccgtcttgcccaggtgggtcttgaacacctgggctcaagtgatcctcctgcgttggcctcccaaagtgctgggattacaggcgggaactgctgtgcccagccaaggccagcatcttcagacctctctgccctgttttcacatggtcttctcctctttgtgtgtgtgtcaaatctccttctgcctctcttataaggacgtgtgtaatagcactcagggcccacctggatgacacagggtcatctcgccatctcaaaatcgttaactttggccaggtgcagtggctcatgcctgtaatctcagcactttgggaggctgagacaggtggatcacttgaggtcaggagttcaagaccagcctggccagcatggtgaaaccctgtctctactaaaaatacaaaagttagctgggcacgcacctgtagtcccagctactcaggagactgaggcaaaagaatctctagaacctgggaggcagagactgcagtgagccaagattatgccactgcacttccagcctgggggacagagtgagacttcatctcaaaaaaaaaaaaaaaaagatgactgggcacggtggctcacatctgtaatcccagcatttgggaggcccaggtgggcagatcacctgggttcaggagttcattcaagaccagcctggccaacatggtgaaagtctctctctactaaaaaaaaaaaaaatacaaaaattacccagatgtggtggcaggtgcctgtaatcccagctacttggcaggccgaggcaggagaatcacttaaacctgggaggcagagggtgcagtgagctgagatcactctgctgcactccagcctggacgacagagcgaaactccatctcagaaaaacaaattaaccaggcatggtgctgcgtgcctgtagtcccagctactgggaaggctgaggtgggaggattgcttgatcctgggaggttgaggctgcagtgagctgtgtttgtgccactgcactccagcctgggcgacagagtgagaccctatctgaaaaaaaaaaaatcggccaggcgcggtggctcacgtctgtaatcccagaactctgggagactgaggtgggtggatcacctgaggtcaggagttcgagaccagcctgaccaacagggtgaaaccccgtctctactaaaaatacaaaaattagctgggcatggtggcaggcacctatataatcccagctactcgggaggctgaggcaggagaatcgcttgaactcaggaggcagaggttgcagtgagccgaggtcatggcattgcactccagcctggtggcagagtgagactccgtctcaaaaaaaagaaagtctctttttacaacttttttgaggtataacttacatatcagaaaatcaccggttttaaatatacatttcaacgacttttagtaaatttcccaagttgtgcaaccatcatcacaatccagtttcagaacatttcatcagcccagtaagagccctcacacccattaacagtcactccccactcccacttcctcctggtggttgctcaacccaggtaaccatgaatctattctctgcctctggagatttgtcttttctggacaatctttcttcttaaactcagcagagtgagttctgttgtttagaactagaaaccctgcccaatagaatactaatatcctcttgttttgcaagggagttagagtctcgctctgtcgcccaggctggagtgcagtggtatgatctcgcctcacttcgacctctaccttccggattcaagcgattctcctacctcagcttcctgagtagctgggattacagacgtgcaccaacacacctggctaatttttgtacttttagtagagatggggtctcaccatgttggccaagctggtcttgaactcctgacttcaaatgagccacccgccttggcctcccaaagttctgggattacaggcatgagccactgcacccagccctaatatcctcttattacaaaagaagaaacaatgactcagaaagattaagtcacttacccaaggtcatgtagtcagtaagcaatagagctgagactgaacctcactccaaagtctatgctctcactaaagtattgcagtgtagagagtagaggggacagggtgagactggaggaagggagggcatttaggagactattgggatgtccagatctgagagctgttggcgacctggactggggaggtgatagaggcagaggagagaagtagatgaatttgagcatattaggaagtgaaacagtaggatttggcaactgaacgggtgagtggacaagaaggagaggatgagtcaaagagtgcaccatgcttctggcttgggcaactgatgggtactggaataacttgctgggataggaaatgcaggagaaacagccaatttggggtggaagatgaggtcaggactaaaggcattgagtttgaggtgtctatggaatgtacaaatggagatgttgaatggatggttggatatacgaatctgcagctgagatgtaggtttctatatcaccagcatatagacggcaaccagaaccctggaagaaggtgcaaccgaccagcaagagaagatgtagatgagaaagcaaaagggcctagaacacgccccaaaggagtgctaacctttaaggcgtgggagcgcagaagtccccaaaagattctgaggagtagccacggcgatccagtgaaagtcaggcacaagtggactcctgcaagctaagggaaggaggcgagggaagtggggcatggtcacagtcagtgtcaactgctgctgagagttccaggaaggtcaggtccatggtgtatctattggatttagtgacaacgacattgttgtttacttggcaagagaggctttagagaagggatgggggtgggagccagactagagtgggtagaggagtgagtgaatcaagatgcggaagtggatgtgatgactcgccctttctttcttctttctttcttttttttttttttgagatgcagtcttcctctgtcgcccaggctggagtgcgatggtgtgatctccactcaccacaacctctgcctcctgggttcaagtgattctcctgcctcagccttccaagtagctgggattacaggcatgtgccaccacacccgcctaattttttgtatttttagtagagacggggtttcaccatgttggccaggctggtctcaaactcctgacctcttgatccacctgcctcagcctcccaaagtgctgggattacaggcgtgagccaccgtacccggcctggtgactcactctttcaagggactcagctataaagaagagaggcatggagtggtggtaggatggattaagctggggaggggaggcatttttaagatgagaaatgatgtttaaatgcagatggaaatgggacaggagagaaagggaagttgatgggataaatgaaaattatcatcatcatcttcctcaccatcaccagcagcaaccacaaggaaagctcgttctgctctgggactgccctgttagacatttcttccttatactgagccacaatctatctccctgtaactttcgcctttggttagagttctgccttgtgtccctcttctactcttcaaatggctgcacgctgctactatgtctgtcctcttcttcaaactcacagcccccatcctacgggccctgtgctcccagcctggtgacccgaccctctactgtcccagccaagttcacatgaccatcctcttatttgtcaagcctctcttttttttttttttttttttttttttgaggagtcttactctgtcccaggctggagggcatggcacaatctcagctcactgcaacctctgcctcctggtttcaagtgattctcctgcctcagcctcctgaatgctgggattacaggcatacatcgccatgcctggttaatttttgtatttttagtagagacggggtttcaccatgttggccaggctggtcttgaactcctgacctccagtgatccccctgcctcagcttcccaaagtgctgggattacagcgtgagccactgagccgggccaagcccctctgaagagacagtgtgcacactcttgctttgctgatagaagcatgaaatggttcaagtttttgtgatttgggaaaatgaactcagctataaaatgtgcacacccagaagttgtcctatggacttaatgtcttaggggtgagaagaagcttgtgcagggattcctggcaacatgaatgcgggatggacagacagtgagcacagtgttgaggagcacagcctgagtgcatctccctgagatcaggaacaggacaaggatgcccgctttcaccgctgctgttcgacattgtactggaagttctagccagagcaattaggcaagaaaaagcaataaaaggcatccagattgtaaaggatgaagtaaaactatctttagtcacaggtggcacaatcccatatagggagaatcccaaagaattcacaagaaaactgttagagcaaataaactaattcagtcaagttgcaaggaacaagatcaaccacaaaaattaattgtgtgggttttttttacaccagcaatgaacatttgaaaaggaaattcgaaaaagtattccattcactgtagcatttaagaaagctgaggctgtgaagctacatggctgtgtttggagctggtgctgctatttaccatgtgaccttggacaagcttctcacttcattcatgacaccgtttattcagctattaagtgggggtaataatagtaccttccttatagagttggttttttgtttttgtttttgtttttggtgggggagagtaaggattgcaagagttaatatatgttagcaaaatggacttagaagagtggttggcacatggtaaggactatattagggttaccaaaaaatgtttataattgggaaaattgaacaaaggttccagtaaatatccatcccagaggctggttgacaaattatcacaatgtaccttttagcttgaaccatatggaactgcctatattctatagctatggcctacaaaatgcaaaatgggcagttttttttgttgttgttgtttgtttgtttgtttgtttgtcttgagacagtctcagtctgtcaccaggctgaagtgcagtggcacgatcttggctcactgcaacctctgcctcccaggttcaagcgattctcctgcctcagcctcccaagtagctgggattacaggtgtgcaccaccacgcccagctaatttttgtatttttagtagagatggggtttccaccatgttggccaggcgggtcttgaactcctggcctcaattaatctgcctgcctcggcctcccagagttctgggattacatgagtgagccaccgagcccagccaaaatgggccgtttcatatgttcaatttaaacactaagatactctttagccactgaaaatgactgtgtatcatagatctatctttatcacagatctatctttactgtcatagaaagaactaataacatattattgaacaaaaataacaagttacaaaacagcttgcagccacgtttgtaacatcagtatatctatttgtgtgtctaggtgtggacataaagagatatctagaagacactcccattgcctatgggaatgacttgggctgggatcttttttatttatttatttatttatttatttatttatttatttattttgagacagagtctcactctgtcacccaggctggagtgcaatggcatgatcttggctcactgcaacctccgcctcccaggttcaaacgattctcccacctcagcctcccaagtagctggaattataggcacccatcaccgcacctagctaatttttgcctttttagtagaaatggggtttcgccatgttgcccaggctggtctcaaactcttgatctcaaattatccacctgcctcagcctcccaaagtgctggaattacaggcgtgagtcaccgcacccagctgtgatcttaatttatattttttctttttaacccttgatttttaccctgtttgactgactttaggagtctgacccccaaaactgcaaaagaataaattagtgttgttgaaagccactaagtttgtggtaatttgttagagcaacaaccagaaactaatacaatcgggattaaacttgccctgggggtgctggctctcccccactttcttctcagagcatctcttgggtcctcgccccttgctgagcccccaccatggccgggtggaccagcgatggacctgatcggattctcctcttgggattttaaataagagatgcagaggctgcacgccaagcttctctgtgccgcactgcaggcacagtcctggcgctactgttctttaggggtccatgaagatgtttgttggcctggcttaggtgtgagctaagagatacaagggatacactttggaggctcagccctttgatgttacctttgcgctggaagcccaggggctgtaagacggagaggaactttgctgaaagggaggtcctccctgcagagcttgaagagcaatctaaccatgctggcatggggcccatcccacctgtgatgccagtgtaagtctgtgacagtcactcatattcagagcatgtggattgagactctgaagaacgactttatggtgggcaccttcatctccatctggtgggtccagagcaagcagcctcagggtcccatgggcccaacctcaccctccatccttatttccctgccactccagggctcctcctcagccagacttgcctgtgagtgccccttgatggctgtattagtctgttctcacgctgctaataaagacatacccaagaccaggtaatttataaaggaaagaggtttaatgggcccacagttccacatggctgggaaggcctcacaatcatggcagagggcgaaaggcatgtcttacatggtggcaggcaaaaagtgaatgacaaccaagcaaaagaagaaacctcttataaaaccatcagatcccatgagacttactcactaccacgagaacagtatgggggaaactgcccccatgattcaattatctcccaccaggtccctcccacaacacatggaaattatgggagctataattcaagatgaaatttggatggggacacagccaaaccatatcagtggccctggcttctctcccattagctctgttctacttcccaaaatctttccagctttgttcttttttagagactggagtctcactgtgttgcccaggcttgtcttgaactcctgggctcaagggatcctcctacctcggtctaacaagtagctgcgaatataggtgcacaccaccacacccccacaacttacccatcctccccggctcagtgaaatccctaggtccttcacactcccgttagctccaggtaccagcggctttgccttctacagaatgcataacattatagcctcttagagcaaaaaggtcatggggatggggaaggctgggagttctctcttcattcagggattaaacctaccacctggaggggtgacatggctcaccttagtcaccaagcaaggtcgggagagtatttctgggatggtcattagcactttctttccaaagggaggatactacaaactcactttcatgatcacagtatcccccccgacaggtaaagtgtgcaaactcgctttcattccctttttgtctttgacgcagctctgaagcattttaattcttaaaatttacatgttcatgatgacacagagacacgttttctgtttaggagagggcctgattccattaaggctgatcgatcatatgttgcacattctgggataaatatgagagatcagaattgagcttcccaaatggtgggtcacatgacccagtgttgttccaggagaacgttgcaacatccagcatgagaaagcgctgcatgcaccatgtatgtgttgggatgctgggctgaaatgtattaatgagcaagtgttatcatatttgtctatggaattctatttaatagctatgtctcgtatgtgctgattgggtctcaaatctgggtatcttaccccaacatctttcttgaaaatccttctttttaaataaatgttggccgtgtgcactggcttatgcctgtaatcccaacactttgggaggccaaggcgggtggatcacctgaggtcaggagttcaagaccagcctgaccaacatggagaaaccccatctctactaaaaatacaaaaattagctgggcacgatggtggatgcctgtaatcccagctacttgggaggctgaggcaggagaatcacttgaacctgggaggcggaggttgcagtaagctgagatcgcgccattgcactccagccttggcaacagagtgagactccgtctcaaataagtaataaataaatgttatagaaatactaaagtgtattgtgcataatataacacccacgtaccaccatccaacttaagaaataaagcattactaatccagttttgctccctgcaaactcatccttcatcccattctctttccttttgctttataaacatcctgcagccaggcacagtggctgcacctgcagcctgagctacttgggaggctgagatgggaggatcacttgagcccaggagtttgtggctgtcgtgtgctgattgcacctgtgaaatagccactgtgttccagcatgggcaacatagcaagactccatctctaaatgaaatccttttttttttttttctttttgagacagagtctcactctatcacccaggctggagtgcagtggcgccatctcggctcactgcaacctccgtctccagggttcctgcctcagcctccggagtagctgggactacaggcacatgccaccacaactggctaatttttgtatttttagtagagacggggtttggccaggttggtttcgaacccaggacctcagatgatccacctgcctcggcctcccaaagattacaggcatgagccaccatgcccagcctaaaagaaatcctgaatttgacatttttaattcccttgtttgttttaatatttctacagcacatatatgtctacatatataaaaatataattttttattggggtgaaattcacataacgtaaaattaaccactgtaaacatgaacaattcagtggcatttaggacattcatagtactgtgcaaccaccacctctatctagctccagaacattttcatcaccccaaaaggacactccatgccccccaggagtcactccccatttcttcccactctgtcccctgcaacgaccaatctactctctgtctctgtggattcacctattctggatatttcatataaatggaatcatacaatatgtggccttttgtgactggtctctttgacttagctgggtgtggtggcacgagctacccacctacttgggaggctgaggcaggagaatcgcttgaactccagccataaattatattgttttcaaggttcatcaatattactcgcccaggctggagtgcagtaatgtgaccttggccccctgcaacctccacctccccggttcaaaggattctcctgcctcaccctcccgagtagttgggattacaggcgcacaccaccacacccggctaattttttgtatttttagtagagagagggtttcaccatgttggtcatgctggtcctgaactcctaatctcaagtgatccacccaccttggcctcccaaaatgctgagattacaggtgtgagacactatgtcaggcctagtcaattcattttcactgctgcaaagcatctcattttaaaaaattattttattattatttttttgagacagggtctcactctgttgcccaggctggagtacaggggtgcaatcacagcttactatagccttgacctcccgggcccaagcaatcctcccactgtggcctccagagtagctgggactacaggcatgtgccaccacacacagctaatttttgttctttgttttttgttttgttttgttttgttttttgagatggagctttgctcttgttgcccaggctggagtgcagtggcgcgatctcagctcaccacaacctccatctcccaggttcaagcgattctcctgcctcagcctcccgaataggtgggattacaggctcacgccaccgtacccagttaatttttatttttagtagagatgaggtttcaccatattggccaggatggcctcaaactcctgacctcaggtgatccatccgccttggcatcccaaagttctgggattacaggcgtgagccactgtgcctggctcaaagcatctcattgtatgaatccaacaatttatttatccattcgttgtttgagtacatgtaggttatttcctgctttccctcttacaagcaatgctgcagaaacattcttgtccatagctcctccggcacatgtacaagagcttctctagggcacaaatgtaagagttttattgctgggccatggggaatgctcttcttcaaatgtacttgctattgtcaaatctgagctatcttttcaggagcctactactggttctcagccctggctatgcattagaatcacttgggaactttaaaaaaatatgtgggtatctggataactcccctgacccgtggaatcctagtctccagggatgggactggggacttgaaagctccctgggtgattacacagccaaggtggagaacagctgggactgagtcttggcccactctgtctcagcttcccaaggtcagctcatagagggcagccatcatcttagacttgctaatatcactcagcagctgagcagatagaagggactaaataaataaagtctgaatgagtaaataaagcatttaaaacaaaccctttagggctgggtgtggtggctcacacctgtaatcccagcactttgggaggccaaggtgggtggatcccttgaggttgggcattcaagaccagcctgaccaacatggcgaaaccttgtctctactaaaaatacaaaaattagcaaagtgtggtggtacgcgcctgtaatcccagctactcggaaggctgaggcaggagaatcacttgaacccggcaggcagaagttgcagtgagctgagatggagtcactgcactccagcccgggctacagagcaagactccatctcaaaaaaaacataataaaacaaaccctttaggctgggtgcggtggcgcatgccggtaatcctggtaactatctcctactgttgtgacgattaaaggagatggtgcatgcagagtacttggcacatatgaagtgctcaataaagagtaactcctgcagcctggtgtggtggcccacacctgtaaccacaacatgttgggaggctcaacatgttggcaggaggattgcttgaggccaagggtttgagaccagcctgggcaacataaagagacccccgtctctataaaaaataataaaaactagctgagcatggtgatacatgcctgtagttccagctactcaggaggctgaggtgggaggatcaacttgagctcgggagttggaggctgcagtgagctacgatcacgccactgccctccagcctgggcaacagagcaaggccctttctctggaataaaaaaaaaagagaggctgggcgcagtggctcacacctgtaatcccagctacttgggaggctgaggcaggagaatcacttgaacctgggaggtggaagttgcagtgagccaagatcgcaccattgcactccagtctgggcaacaagagcaaaactctgtttcaaaaaaaaaaaaagagagagagagagagtagctgccattttcaatgttattgataaagcaggtgggtgtttctgaaaatgcaccagatgcagccttagactggaaggtgctgatgtgttactgagcctccagacaaagctggcgaacccaccggggcgagactttatgacttgagaagctgtcctatctatgagggtccatgttagggaatattaaagaataggattgggggcagtagctttcctgtagcaagtgctagctatgtgccagatactgggcaaaggagtctgcagacgtctctcatttcatcctcacaatccatgaggcaggtatgactattcttcccattatccagagagggaaaacaagtcacacggaagcaagtcacgcagcagagctaggattggaacagaagtgcctgcatcctccaacgcctgcatcccaacccgctgtgctatgcctcccgttgatgctttcccatgtctgccatttagctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggtgagcacctcgtagcattctcccaggctcgtcgctggtcaccgtcgccagggcctagctcccttcccctaggatctacagcctcactccagaaaaaacgctggtcctattttaaaagctctgtgaacatcccaactgagaaaacctaaaaattgcaaaactgggtgagatccaggagatgattctttgctttatcaagtcctacagggtttctcaaaatagcctcatgtcctggtgcattgaaaacaggatttgattcacttgcgcttgatttacccgcagctttttagacgcacagccaccaagccagcaaggtctgccgagattcagaaggacagagaactttctaccaaagagcaccagcccttctagattgtgtagcatttcatcaacaaaaatgactccaggagaccattcttgggtacatttttccacaaagaaaggatgtaaatgacaaaaagaagaaaggcatcggtcactgagagaaggcgtgtgacttctagatttgcaagcagggaaaatgaaagcagaattgccaaaaaagagaaattaaagtagggttgaggagtccaaaaaacagataagggggcgagagggaaaaaggggcacgtttgtggcttggggagctaaaatgctttgcaaagacccatgaagcccaagctgctgtttgtttctaacagtgggtcattaaaatcctgtgattgctcaggtggtgggatgccctagtgccctttcattaaagtctgggaaaatctgaacagtgttgtgatgaaggctgctcccctaccctcgcctccccaggtctcctgagtttcaatttaatgagatttttactgcgtaaaaaaaaaacaaaaacaaaaacaaaaacatgaaaaggctgcttttgagactgcattggtaaatgactcttcaacccattcaaacgctccttcactctccctcagctcagcagggctgctcgtccagctttgatattaagcccttggcatattccaagttgcccacagatcctgatttctagaagcttagaaaagtggagaggttcgcccagcaagctggattattataattaagtagttctcttttcaaaggccttgcattttcttagcctctccttctccacaggggaactctttcttcgtgatgacaaactttctcaaaacagaaggccaagagcagcggttgtgtcccgaggtaaggaggggacctggagtggtgggtcaggtcttaagagttcctgggggaggtgcaagtcggaagaagcagaaatgcggaccctggggtgtatttgagcccacaaatatctactgagcacctgcctcttttgtggggtagggctgggctgagtggaggaagggagagaacacatggcagtgtctctccatggccaccagatctttgtctgcctgcctcggtctctggttctagcactagggacccgtgcagacggcaaccctgctctttctatctctggctctcttcgcagcttatgacaatggtgattcttggcatttgcacaacatttcacattttacttgaggctcacaatgactttaggagaaaaatggcattttacaaaccagaacacagattcagagatgttgtgacttcccccagggtcacacagcttgctgcaggcagagccagggttaggacctgagtgtcctcactcacagcttctcctaccatggttcacagtgaacggtctgcagggctggtcttggaaaaccctggcacacagctctcttgctcattcatccacttcttagagtctcagcctctccatcacgtgcatgtgcccccatgactccctgccaccaccccagacaatctttcccaacttggctttgctctctccaaagagccgcctctttctggaagagcttcttccctatcaaatcatatttgttttattctgggctaggcacggtggctcacacctataatctcagcactttgggaggccaaggcaggaggatcactggagcccaggagttcaagaccagcctgggcaacatagtgagaccttgtctctaaaaacaaaacaaaacaaaaactgtatttgtcctattctttacctcaccatcctgctctctcctcttaaaccagcttttcttctaagtttatctataccagcgtgttactgctaggcattacctgtaactcccaacctcccagcctcccctctcaggtaacgtaactgtgctgtaccagggaccatttccaacactgaccgttgcagcagcgctggtgatacccagccagatcctccactgatgagcaggaccagccctgccggtggagttttgctcacgggcccactctggcaacaaggtctagcttcctgagtgtccaggacctctgggcaaaagtgctgtctttgagtacagtctttgccatcatttgtacccaaattcagaaccaagataacattcccttggtgtctatcttgataacactccgtctaaaaggagagctttctacatttgttttgtcctcatcaccccttaactgtccctgctgctcagatgaaatctctgacagccaggccagccaagccctcccttctgtctcccttcccagcagtgttccgtctccaatccagtttgggggcctgtttcccttttgtcccatcctttggtcatctctacaccacactctacctccatgtacacataaagacacttttggacttattgagacttggaagaaaaagagttaggatagcccagagattaagagcctgggctcagaagctagaccgctaaaggttcaaaacttaaacttcttaactctgtgacctcaggcaggtgactcttcacctctctgtgccaagttgtgtgcatctgtaaaatggggctgagaacaaaacctagctgttcggattattgaaacaaatgagtgaatacctgtgacacgcttaaaacaaggcatggtacattataagcactcaatgaatgtcagttgttatgattcaaatgacatgttactcctcagataggatgtcactcagagtgactggaacccaacaggttccatcgaagcacttccagcccagagagcacatgtgactctttgggattttaacttatgctccaggctggtttgggctggtctaattgggcatttgcctcctctctgcccatcaacacccctctatctcgggttgtctcggtaaatatgaccaagttccagttacacaccaacatgaatagatatttgctccatttatctgtggctgcaaaacaaactaccctgatcatggtgggcttaacacaagcattttattaactctcacagttcagtggttgactgagttcagctggttggttcttctgctggtctcactagggatctctcaaggagctgcagtcagatggcagctggggttggcatcccttggagcctcaattggcacccagggatagctagacatctcttcctctctgggaacccctaagagttaccctctcttcaaggtctgtccgcattgtctctccagcagggtagtcaaactttctaatagtggctcaggttcctcaaaacaaaacaaaaaaatagaagcttccaggccttcttaaggcttaggcctggaactggcaacagcattccttctgctgcttctattggctttgcagtcacagcacaggctcagcttcagaaagtaggggaaacactccacctctcaatggagaaagtgaccaagaatttgtggccatctttaatccatgcaacaatcacaaaagagaagattaaaacaaaactaatgtgctgttttttaaaaaaaaaattagaattccttttggagagcaaaataaaactgatttctcttctttcctgagattcatctccagttgataatgaaaatgtaactttccatgagccacaatgaatgatcacacattcattccttccatgactatcaagacctactatttgccaggcacttgggctgcaaagatatgaccttggctctgtattcaaagggttcataatctaatctggggagtcacaaggggaggagaccaacggcatgccatgtgacaaggcagcctgggaaataaagagatcatgagagagtttgaaaactacaagaaacattcattgagcatgtactatgtgctaaaccctttcttttcataactcacttaatcttcacaacaaccaggcaagacaatttgttggctgggcatgatggctcatgcctataatcccagcactttgggaggtcgaggcaggcagatcatgaggtcaggagttcaagaccagcctggccaagatggggaaacaccgtctctactaaaaatacaaaaattagccaggcatggtggtgcgtgcctgtaatcccagctactcaggaggctgaggcaggagaattgcctgaactcaggaggtggaggttacagtgagccaagatcacaccattgcactctagcctggtcgacagagcaagactctgtctccaaaaaaaaaaaaaaaaaaaaaaaagacaaatctgttcaccctgcttttacagatgaacagtgagctggccaaggtctctcagctagaaaatggtgcagctactgctgaaccagatatacctgggtccaagacctaggtccttgacctgaatcactgtagaagccacaaattgcacagatgacaaagagcagaggccattttcacacctatgtcatgttctggcttccccaagactggccatgaagcctgctccctagaaaacaggaagagaaatatgcataaaccagggcagctcatttctctcttccgtgttctgtccttcagccctgagacccagctggtctcattttcttgggccaggcgagtgtcctggccaatgtctctcagttccatgtgtcctgctgagtctccacacctgtttgccctgctcagtcctttcagccacagggccacttggaccaagccacctgtcccccatcccagccagcatccctgaaagtgatccctagcttcccagacctctgcttttcccatttttatttatttgtattgggatataattcacataccataaaccccaccattttaaagtgtacatacggttcagtggtttttagtataatcacagagttgtgcaaccatcaccaccgtctaattccagaatattttcttccttctttctttctttttttttcctttctttctttctttttctttctttcttccttccttcctttctttctttttttaggtggagttttgctcttgtcacccaggctggagtgcagtgacgcaatctcagctcactgcaacctccacctcccaggttcaagtgattctcctgcctcagcccccctagtagctgggattacaggcgcacaccaccacatctgataatttttgtatttttagtagagacggggtttcaccatgttgagcaggctggtctcagactcctgacctcaggtgatctgcccgccttggcctcccaaagtgctgggattacaggcgtgataagccacggcgcccagcccccagaacattttcatcacctacaaaggaaaccccaaatccagtagcagtcactccccattctccccttcccctgtccctggccacagtctactttctgtctctatagatgcctattctggacatttcctataaatagaattgtatatggtgtggccttttgtgtctgtcttctttcactcagcatcatgttctccaggtccatccatgttgtagcctgtgtcattgcttcatccttcttatggctaaataagattctgtgtatgaatgtaccacattttatttgtccattcatccgtcagtggccacttgcatggtttccacttttttggcgattctgagtagtgctgctataagcattcgtgtgcacattctggtggatatcgaatcacttctccacatcttagtaacacacgtcacttactccccactctgtcatccttctatctgcagtatcccacccgcaggacgctctgttcctctgaccgaggttgtaaaaagggatggatggacccgcagagcaaaggtaccttctgtttcttttcccgagaccctaggggtggatggtctggcatcttggtgacatttgtgatgcccaggtcaggtcttcagcctctgctctcagctgccctcttccaccatcaccaagccataggcgagtctgcccatgcttcggctctgtccccagcagaccagctgctgactgtaaacatgactccagttttccagtgagagaagaagctcctaaaaacctagcaggttcaggattctaatcggtagaaaattcacatggcctatagcatcatctgagtattctaaactttccccctgaatttcctcaaaggttgaggaccatgaacttttacccccagggaacctggcagcaatacccatattaacctgcagaattttttttgttttttattttattttattttttaaacattttttgcactgttttattttgattttgattttgattttatttatatctaagtgcagtgctattgcgatacctgcagaatttctttatctcacattttaacttaaaaaggcacagggcagcgagcgcagaggctggtgcctgtaatcccagcactttgggagggtgaggcagatggatgcttgaggtcaggggttcgagaacagcctggaaaacatggtgaaaccccgtctctactaaaaatacaaaaatcagccagacatggtggcacacgcttataatcccagctacttgggaggctgagacgtgagaatcacttgaacctggaaggcagaggttgcagtgagccaagatcatgccactgcactccagcatgggtgacagagcgagacccctttaaaaaaaaaaaaaaaaggcacagggcaattttaaaaatactgcaaatagtaaaaaaaaaaaaatcagtggttataatgcaaacacacacaaaaaggcatatgcccattactgcattctactccatactgtatgtgtatttgagttagtataaaagttattttaacattgctcactatttaattaattctcccttggaaactgattaatcatcctggcactccaggaagatgtgccatgctgatttcatggctttgcacatcctgggcaggctgtgtaccccttgagggacttgtgcccctttgagaggccatgttctagtccatttatactaagtgagagcatacacctgttccgctcccctcatgggcaccttttcttataaagaaacaaaagagccagcagaatccacagtctttctgtgttctctctgatctttattatgttttgcttgtttgccttgccttgtgttcgttgtggttaggatgggcttgatggaagctgaagctgcgtgggttggaaagcctggtcaaagcctagtctctcgcccgggttgagttaatgatgtccctcctggagaacgtcctctctgcagttctttcacatctgtggttctacgatgctttgacccctataggaattcagaccggaaggtgtgtagtgcatgaagggaaccagaagacctgtgaagtctctgcctggtgtcccatcgaggcagtggaagaggccccccggtgagtcgcatggggagacagacacagtggccctcagcggcgaccagatgaggccttgccgaggctgcttgggccttcccctctcagcacagccctgcaaagtcctgggtcctaccggcttggggacccctgcgctctggatgcactgcttggcacaaactagtatctctgggagggccatggtggttggtaaactgttgtaacaatcctgtaccaactggtaaatagctactaccctgagcatccttgggtgtccctggccccttccttcccccagatcttccagggtacccccagaccccctcctgtagtgccacagcaggatcccttctgacttgtcagtgtccatactgagtgatcaaggatagaaaggaaggagggagatggaagggaaggacgaagcgaggaaagagaaggggaaggggaggaaaaagcaaaaggggtgagggtaaaaggggggggaaaggaagttttctcagattaaatgcttacaatgacatacagatttggtggtcccttgtattgatgcttcgcttcaatacacaaagtcacaatgttaaatctcagaagccacaagggctgatgtatttcagcagagaatagttagaaagacctggattcaattcctagctctaacaccattttgctgtgtgtccttgggaaaatggcttaacctctctgagtttcagtgtcctcacctgtaaaagcagaataataatttcaccaacttcatagggctgttgtaaggattaaatgagatgatacttgtacagttattgtaaggtaagccccatgcatgcctggcttacacacacacacacacacacacacacacacgcacacacgcacacacacacacacacacacaatctacccctagaagtgtggtggttctagaccagcactgtccaattgaacttgatgcagtgatggaaatttctgtatctgtgctgtccaatagggcagctactaggtacatgtggctattgagtacatgaaatgcgactactgaatttttgaaagagatgatagatgatagatagaaagatagatagatagataaatagataatagatagatagacaggtagatagatagatagatagatagatagatagatagatagagttttgctatgttgcccaggctggttttgaactcctgggctcaagcgatcctcctgccttggcctcccaaagtgctggggttacaggtttgagccattgctcccagcctgaatttttaattaaatttaaatttaaatagccacacatgtctagtggctaccatattggacagcgcagttctagaccgatgtgattcaggatcattccctcagcatcgtggggcaaagagaaaactgccccaagctggcctgtagaaggctcaggcgaaggtttcccaatgccgggatggggggtgcgctcagcagcatcaccccttatgattctcaatcgctaatagctccactcaggttcatttctcggtcaggggcatttctttgggaatcacccagctctgggagatacagcagcctccactcaggtagtccttgttcacgacaagcggcccttgactgactgcagtttcagttccagctctgctatcaactcactcattaaataaactgcatctccagtgtgcctgcctctgggctggattttgacgtgacctgggcaagcaactccctgaacttcagtttctcatatattatatgaattagctaagatggttcgtttaatcattcattcaacacatccatcaccacgtagtaggtgttagatatttatttcatacgtaactacgcataagagactttgctaagttttaggtaaaatacaagtcccagatacggagcaagtctcaaccactgtacatacctgaatgtgtaattacatcactgtaagaggtgccacagtaaatgccactgggtcttgtgttagtccattctcacacaaagaactacctagccaggtgcggtggctcacgcctgtaatcccaacactttggcaggctgaggcaggcggatcacttgaggtcaggagtttgataccagcctggcaaacatggtgaaaccccatctctattaaaaaatgcataaattagccaggtgtggtggcacacgcctgtaatcccggctactcgggaggctgaggcaggagagtcgcttgaacccgggaggtggaggttgcagtgacccgagatcgcgccactgcactccagcctgggtgacagagtgagactccatctcagaaaaaaataaaaataaaaataaagaactacctgagaccaaatactttacgaaaaaaaagaggtttaattgactcacagctccacaggcttaacaggaagcctcaggagacttacaatcatggcagaaggcgaaggggaagcaaacacatcttaccatgatggagcaggaggcgagtttcgggggatgtgccgcacacttttaaatgatcagatctcgtgagaactcactcactatcacgagaacagcaaggaggaagtccgcccccatgattcagtcacctcccaccaggcccctcctctggcacatggggattacaattcaagatgagatttgggtggggacacagagccaaaccatatcagatctcaagaagggagaaattcttcttggaggagctggaggggctttgtggagagtttcagaatgctttgcccactaggtttgctgtatccatttctcttcatgcatcccaaagaccaagccaagaaaccagaagcctctggtcccactggcccatgggctccctcggtccccaccgtcactaatggccattttgcatgtctctctcccaggcctgctctcttgaacagtgccgaaaacttcactgtgctcatcaagaacaatatcgacttccccggccacaactacaccacgtaagtgcccaggctgcctggctgtcttagttatctactgctgagtaataaattatcccaaacctcagaagcctgaaacaacaaacgcctattgtctcccacggtttctgtgggtcaggaatctgggaatgactttgctgcgtggttctggctcaaggtctgtcaggttgtagccaagctgtcaaccagggctgcagtcatttctaggcttgactggggctggagaacccttttccaagctctcacacagttgctcgtgggagagctcagttcctcaccacgtgaacctcgccctagaccacttgagtatccttggtatatggtggctggcttctcccagagcaagtgacccaagagagacagagcaagcaaccaagagtataaccaagatggaagccacagtctttggggggagaccccaacacttctgccatatgccattggtcacacagatcaaccctggtccagtgtgagaggccactgcccaggggtcccaggaggcagggatcatttggggctttcatggaacctctccaccacactggctcactcctgggaaagagacagatctgttttcaatcgagatgtttgtttgtttgcttttaattatggacaggagaaacatcctgccaggtttaaacatcacttgtaccttccacaagactcagaatccacagtgtcccattttccgactaggagacatcttccgagaaacaggcgataatttttcagatgtggcaattcaggttggtggtgctttgtacactgggatgtggggctgtgtgtctagggatggaggatgtcaaacagccaagaggccgggccactgggtcttcataatgtggctcacatttactgagcatttagtaaatccacccgctgcgctaaggtctttacctacgctacctcgtcaaatcccaaaacaatccttatgagtgagagctacttggtgtattcctttcctgtggctgctgtagcaagttatcaaagcttagtggcttcaaacaacacatatttgcttatgttgccagagatcagaagttggagatgattttccctgagccagggcggtgctccctccgggactttaagggagaatccagttcctcagcttttccaccttctggagctgcattccttgcatttcttcaaagccagcagcataacatcttgcctcagtggccactttcactccctatcctgtgtccaatctccctttgcctctgtcttacaaagagagagagcatttacaagagggggcatttaaggaccaactggataatccaggataatctcccatctcaagatccttcatttaggctgggcacggtggctcatgcctgtaatcccagcactttgggaggctgaggtgggtggatcacctgaggtcaggagttcaacaccagcctggccaacatggtgaaagcccatctttactaaaaatacaaaaaaaaaaaaaaatagccgggcatgattgcaggctcctgtaatcccagctactcgggaggctgagacaggagaatcgcttgaacctgggaggcagaggttgcagtgagccgagatcgcaccactgcactccagcctaggtgacaagagcgaaactccatctcaaaaaaaaaaaaaaaatccttcatgtattcgcatctgcaaagagctttccctaggggagtactaggaggtaaagcagaaaagatatttgatagagtgccctgaattccagtctaataagtttggacttgatctttaatgggggcgtggggggcattaaaggtgtttgggtacaggagtggtctgttgaaagttgtattttaggacaatgagtttaacggtgatgtgtcccagacgggggtagggagagtgaggagatgcgattgtggctgccacaataacacttgtgcgagttaggtggggctgtacatatggttcttcaatcagcatttttcctctaaaaaccttaagcaatcctggctatgcagggagatgtctggcggttgcgtaactcacacccagcagccatagagactgtcccttgttgatccttcagggcggaataatgggcattgagatctactgggactgcaacctagaccgttggttccatcactgccgtcccaaatacagtttccgtcgccttgacgacaagaccaccaacgtgtccttgtaccctggctacaacttcaggtaactccaaggcccaggtcaaactcacccagtggctgaatcgcattcccaggaactggtgagactaattttggtttccaaggcaacaagatgaatgaaaaaagactttctctaagaactaggtgataactgaattttttccataattttttaaaattctcaaaagagatgcacactctttattttttacttatttttttttttttgaaatggagtctcactctgtcacccaggctgaagtgcagtggcgccatctcagtcactgcaaacttccgcctcccaggttcaagcgactctcctgcctcagcctcccaagtagctgagattataggcggatgcacactgtttataaaacaaaactattgggaaacagaaaagcatagagggggatcaaaatcacccataattcccctaccctgaaataatcaataacaaccctcgggggaattttcctcatctgtaccaattatttcatacagctcctatgagataatagcatatatatatatatcttgtggtattctgcggggtttttcataccacagccactcaaaattctttgtaaccatcacattaatgatcataacattccattttgtaggtgaacaaataacaactgctacaattcaggcagtgttttcttttcttttcttttcttttttttttttagatggagtcacactctgcttgcccaggctggagtgcagtggcatgatctcagctcactgcaacctctgcctcctaggtccaagcgatcctcccacctcccaagtttctgggaccacaggcatgtgccaccacacccagctaatttttgtatattcagtagagatggggtttcactgtgttggccagtctggtctcgaactcttgacctcaagtgatcttcccgccttggcttcccaaagtgctaggattacaggcatgagccactgtgcctggcccaaggagggttttccatataccaagcactccccgtcgccatccctaaatctcccaacaaccctggaaggaagatattgtttctggaagatgatttgcccaagacccacagctgatagtacatgttgcataattctaacccacgtcactctgaccccacactcacactccatcccttccttcccatctcatgattttctcacctacgcctccatgattgaatatttgagttgcttccagtttttctattacaagtaaccacagtgtgcatctttgcacataaacttctctttgaattccaggttacttccttaggataaatttctagacttattgaatcaaaggttgtgaacattttatcatatgctttttatttttaaaaatatctatagttataatgtttcatttttttttctgagacagagtctcactctgtcacccaggttggagtggaccgggtgcaattatagctcactgcaacctctgcctcccaggcccaagtgatcctcccacctcagcctcctgagtagctaggactacaggtgcacgccaccatgcccagctaatttttaaaatttttttgtagagtcggggtctcactatattgcccaggctggtctcaaactcctggctcaagcaatccgcctgccttggcctcctaaagcgttgggattgcaggtgtaagccactgcacctggcctataattttcatttctaggatttttatttggtgctttttcaaagtcatctattattgttccagtgagtcccattcttaccttaaggatcctactccttctgtccattctactgtatcattcctttcataccgacctattatctgaagtaacttgggtgggagttctcctcgtgggctttgaaatactgtcttcagtagaaaagatcttatgcaaagttctgcatgtgctgtgtgttatggagtattccttatatattactcaaagcagctccataaactggcaggcagccccttaaatgtgtttctgtttctgtttttttgttttttggtctgcatgatgttttaaaacttgagacaggccaggtgcggtggcttatgcctgtaatcccagcactttgggaggccaaggtgggaggatcacttgaacccgggggtttgaggctagcctgggcaacatagggagaccccatctctacaaataataatttttaaaacatcagccaggtgtgggggcatgcacctctggtcccagctactcaggaggctgaggcaggaggattgcttgaacctgggaggtggaggctgcagtgaaccgtggttgtgccactgcactccagcctgggtgacagagtgagacccttacatggtggccactggctggagctgagtatcagtggtcctatttagaaaggggctgggctttctggttcatcactgtccccgccactccttagtgcttatacctggcccacatcactcatttctgtcatctgcctggcccctgtgtagacgtttgagtttgaaacccttgactcaaaggcgggctgatgctttttgcttcctctggatcaatggaatttcatccaaggcaatggaaccagctcctaattgtgataactttttgatcatcccctgccgctgtgctgaataggcttatggccattaagaagagaggacaggatgaatggtcccctgactgactgcccttccagggtgtttttttagctgtcagcagaagcatgcggggcagtgtaccaatcaggtgtcagcaagtgtccttccagcgactgagttgagcacaaaaacatctgctcctggagagacctgagccctctgaaggcctcagccagttatgatgttaatgttcttttagaacaaagtggtagagcatttgttgtctggaatgagcaccagaagaaatctctggccaaaaataaattgttgagggccgggagcagtggcttatgcctgtaatcccaacactttgggaggccgaagcaggaggatcacctgaggtcaggagttcgagaccagcctggccaacatggtgaaaccctgtctctcctaaaaatacaaaaattagctggacgtggtgacaggtgcctgtaatacagctactgggaggctgaggcagggagaactgcttgaacccggaaggtggaggttgcagtgagccggggtcatgccacttcactccagcctgggcgacagagcaaagctctgtctttaaaaacaacttaaataaataaataaattgttgaggtctgatgagtaagtggacaagttattttccagcagacacacaaaagagaaggaaattacaggttatacgaggtatttcagaaaatataactttctaaaacataggaagttgaagaagttgatcacattacagaattctgttgtttagaaaatgacctgtggcgaaatgtccttattcagtgaataggtgattccgcttatgcacgacctgtgtgaagtggatcaggccacccagaatgcacgacgcgcttctcaggcccagcaggagtatgtgtctgtgttaatttcctgtggctgttatgactaattgccacaaatgtggtggcttaaaacaacagaaattaatcttcttatagttctggaagccagaagtttggaatcaagatgtcagcagggccacactcgctctgatgctctacgggagggtcctctcttgcctcttccagcgtctggtggctccaggcattccataactttatagcagcgtcccacaaatctctgcctccatcctcacatggccttctccactgtgtctctatgtcttcaatctcttttttttttttttttttttttgaggcagggtttcactccagtctcctagactgaagtgcaatggcgtaatttcgggtcactgcaacctctgcctcccgggctcaagcgatttgatctctcctttatcttataaagatactagtcattggatttggggcttaccctaaatccaggataatctcatcttgagatgtttaacttaattatatctgcaaacactgtatttccaaataaggtcatatcacagccactagggattagatacttgaacatatcttatttgggggctcaacccattccagtgtacgaaaaacactcttgttcaaggcccgatgtttctcagggcatagcccactgactacctgcatcagaataatcacttggtacctgtactggaaatacagactcctagaaacatctcagagcttctgcaaccactctttgagtgaggggctcaggagtctgcctctgaacacactcaccccaagtgattctttctttctttttttttttttttttgagatggagtcttgctctgtcccccaggctggagtgcagtggcgtgatctcggctcactgcaagctccgcctcccgggttcacacgattctcttgcctcagcctcccgagtagctgggactacaggtgcccgccaccacacccggctaattttttgcatttttagtacagacggggtttcaccatgttagccaggatggtctcgatctcctgacctcgtgatctgcctgcctcggcctcccaaagtgctgggattacaggcgtgagccactgcgcccagccatcaccccaagtgattcttgccttcagtttaagagccactgtaacaagactctggaagcagaaattcacgtgcttactacacaatgttaaccttcccaggcaaaccaactcacatagggagataatgccaatcccagggcaggcagtggcaatgcatgcttgcttgcgaattaaaaaacaaatcactgcctgggcacgttggctcatgcctataatcccaacaatttgggaggctgaggtgggtgcatcacttgagctcaggagttcaagccagcctgggcaacacagtgagaccatcatctctataaaaaaattttaaaaattagtcgggtgtaatggtttgcacctgtagtcccagctgccgggaggctgaagtgggaggatgacttgagcccgggaggcggaggccacagtgagctgtgttcaagccactgcactccagcctggatgacagagccagatcctgtctcaaaaaaaacaaaaacaaacaacaacaacaaagataaatcactcaatacatcagcaagagaaaaagctctcttgaaatagtcacatgcaaagaaattgaattccctccagtcagaaagagccactaaagtgcctgagaatatctgatcgatttcaatgtcaggttttgagaggttttttaaaaacagtttcagatgtttcttactattttttggcagaacatctgccatctgctttcttctctccctacatcttgtaactagacggtgaattaataactcagaaaaaataaacatgtatatgtaactttatctaaaaagaatcatcaaagtgtggtgagaagaaggggcagatttaaaagttttatgaagcgttcattttaagcctccttaattattcttgaaaaacaaaacacaccacttttcctgactgcagcactggtgagggttgcatatcacgggtgactgtgatgatttgtgcctggcgcttaatttttaaagttagtactgagtgatgacagagagaggtcaatgccactcaaagaatattttgtttgtttgtttgtttgtttgtttgagaggcagtcttactctctcactcaggccggagtgcagtggtgtgatatcggctcactgcaacctctgcctcctgggttcaagtgattctcctgcctcagcttcctgagtagctgggattacaggcgtctgccaccacatccagctaatttttgtatttttagtagagatggggtttcatcatgttggccaggttggtctcaaactcctgacctgaggtgatctgcctaccttggcctcccaaagtgctgggattacaggcgtgagccattgcacctggccaagaagaatttattacatacttttcccaagagatggggccacaccacaccataccaggccataccaggccatgccatgctagacagggccacaggaggaagtaccagatccgctcaagaggcagaataaagggtaaagaatggtccagagctttattgtgttactcagtggaagggcaaggcaggactagggaaacagcttagggttaactactttgaataatgccagtaggttctgagttacaggaatggtctctaaatgtctggccctcaccctacctgtccctaaggagaaatactggagagttagaaaaggaggtggttgagggattggttggagggtttgtaatatgattttcacaccctcacaaaagctggattgcagaggagatgtaaacaacttcagccttgggaggccaagatgaaaggatggcttgaagccaggagttcaaggctgcaacaagctatgattacaccactgcactccagcctggttgaaggaatgagatcctgattctacaaaacatttttgaaaaaaacttttttattttttcttttcttttctttttttttttttttttttgagacagtcttgctctgtcacccaggctagagcgcagtgatacgatctcggctcactgtgacctccatctcctgggttcaagtgattctcgtgcctcagcgtcctgagtagctgggattacaggtgcctgccaccatgcacggctaatttttgtatttttagtagagatggggtttcaccatgttgtccgggctggtcttgaactcctgacctcaagtgatccacccgcctcggcctcccaaagtgctgggattacaggtgtgagccacggtgcccgaccaaaaaatttaaaaataaaaattagccacctgtagtggtgcacgcttgtagtcccacccagctacttgggaggctgaggtgggagtatcacttgggcccaggaggtggaggctgcagtgagctctgatcatgccagtgctctccaacctgggtgacagaacaagaccccacctcaaaacaaaacaaaacaaaaaacacaacttcagcctttagtttggccctgtgattaatgattgccaaataggcatacacagaatctaagaaaatacagtttgctgaggtgtgcctgtctccagtccagtaattagtatgcaagatttaccaccgcccactcccactttgttctagatgccaaacctcttcttcccccttaaggaatagtcatattgcttgaagttttttttttttaatttctctgcttgttgttaatcctgtgttggtttaaaatgtgcattttaatcttaagcgacaagctgattttccgtcactctgagatgatgcaggtacaggtggtgacatggggaggggggactgctctttggttccaggtggttggagagagacccagggctttggattgtgttccttcccctgccacctgtcacagagccaggggacagaccaggaggactagacaggccactgttttggcttttccttccataaaataccagcattttttgccagatgcagtggctcatgcctgtaaccccagaactttgggagcctgaggcaggcaaatcacttgagctcaggagttcgagaccagcctgggcaacatggcaaaagcccgtctctacaaaaaatacaaaaaattagccgagcacggtggtgcatgcctgtagtcccagctacctgggagactgaggtgggagaatcatctgagcctagcaagtcaaggctgcagtgagtggtaatcctgctactgcactccagcctgggtgacagcgtgagaccctgtctcaaaaaaaaaaaaaaaaaaacccaaaacccagcactttcaaagggatcttacaaatacagatccttttcttcctacagatacgccaagtactacaaggaaaacaatgttgagaaacggactctgataaaagtcttcgggatccgttttgacatcctggtttttggcaccgtaagtctcgtttcccagctccgggcaccggcatcctatgactgtgtcctaattactgctgtggggcctccatggagggaagggttttggtctcagccttcagctagcactgggcatttcgcacatgggataaaagaggaagaagatgttctcgggctgctgtccctgaatgagtcatctgacgagtacaggagtgggcctggaaagcaattctaacattcggctttaaaaatactctgatacttaacaagagagagaaagaaatctctctgtaaaatagtttgtaagtaacagaatccaattcaaattggcttaaggggaaaaaaaaagttttgagtgggcttttttgggttcacgtaactgaaaaaatccaggggttatttttaagctacaagcatggttggatccaggtgttcaaacaacaacatcatcatcaagaacttgccaccttccgtgtcttatatacgtcctccttggtcttggcagccatctctctatgaaggtatcaggcagcaccttcgatctgaccagtttagcaacctcagtgaaaagaaaacacctctttgccagaaggttcagcaaaggtctcagacaaatgtcattggctctgattggcccactatggatgacatgcccactgctgaactaatcactgtgaccagggtcatgccatactcccagtggttagtgtcgaaccagccctaacctagcccaggggccagcagagaggccaacaccccagccccttcaacacacacacacacacacacacacacacacacacacacacactacatggactgaaaagaaaattggagtgttgccttctgaagatggaaggaaaagatgccagctatgcaaaaatcaacatatcccacgacatcctgtccaagagcatgttatctatgtaagacagtgataagcaggactagaagcaataagatatagctgagagaatgcaaagaccgctgggaataaaaaccacaaggctgggccgggcacggtggctcatgcctgtaatcccagctctttgggaggctgaggcaggtggatcatgaggtcaggagctcaagaccagcctggccaacatggtgaaaccctgtctctactaaaaatgcaaaaaattagctgggcgtggcggtgggtacttgtaatcccagctacttgggaggctgaggcaggagtatctcttgaacccaggaggcggagcttgcagtgagccgagattgcgccactgcactccagcctgggcaagagtgcgagactctgtctcaaaaaaaaaaaaaaaaaaaaacccacgaggccacccagacattccttccctctgcttctgaagtaatgtcaaaccttttggaggagaagcttgtctgaaaccctcaccttgtatggagaaatgatagcccttcagtgggtctccccttaatgtgtgggccccagtgcttgctcatgtaaaacctttatgggtccaagcacaccctgcacggctgaagcaggatgcctgagagtcagtttcagtctgcgtagtctctgcctcagccagcacttgaacgcatctatccaagtcacagcatgaggctccgctccctgatagaaccaacaattgcacgttgaagcaaaagagcgttgctctgaatttcacctgagtaaactctcccactctgtttttagggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccggtgaggccgctgtgttcacaggacaccaagacatggagagattccatgaaatcactcagaaatgcacgaaaattaggcccaaatcacaggcttcatcctgtagtggatacgtcgctgggttctaccccgatcaaccaactctcagataaattttttggtcttagagaagaatggaaacaaaaatggaggggcaagatagagggaaggcaaatttttatgtctaggacttgccaattttgtcatttatttatttatttatttatttatttatttatttatttatttattttcagatggagtcttgctctatcacccaggctggagtgcagaggcatgatctcggctcactgcagcctctgcctcccaggtttaagtgattctcctgcctcaacctcccaagtagctgggactacaggggcacaccaccacacctggctaatttttgtatttttagtagagatggtgtttagctatgttggccaggctggtctcaaactcctgacttcaaatgatccacccactcggcctcccacagtgctgggattataagtgtgagccactgagcccagcctgttttgtcatttattaaattggtatagccaaaaaagaaaaaagaaaagaaaaataacaactttggagaacaatttggcagtgactaatgtttaaatgggacatactttacagcctggcattttcagttctccatacctgccctagagaaacactcacatgagtacccgcagtacatgagtacaagatgttcaaagcaggattgtttattaaattatcaataatatatgattattaacagtgaagaaatagcatctaaccaaatatccaacaggtgaatggtgaaactatggtaaatccatagaaaggaataccaggcaccagcttaaaaaaatgagatagataataataatggcaaacatttacacagcacttctaaatgctttatctattaactcaatcttcacaacaacctgatgtagacagatgctactattatctctttctatatatgaggaaattgagccacagaaaggttaaataattggcccaaggctgggcacagtggctcacgcctataatcccaacactttgggaggccgaggcaggcagatcacttgaggtcaagagttcgagaccagcctggccaacatggtgaaaccccatctctactaaaaatacaaaaattagccaggcgtggtggtgcatgcctgaagtcccagctacttgggaggctgaggcaggagaattgcttgaacctggtaggcagaggttgcagtgagctgagatcatgccattgcactccagcctgagtgacagagggaaactctgtctcaaaaaaaaaaaaaaaaaaaaaattataggacttgacaagagcagatctccaagacattttgttaaaagaaaaaaagcaaactgtagaacaatatatgttatatgatatataggttaaaaaaaaatcactagacacagaagctaatctgtatattttctgcatgtatattctatatatacacaagtgtacacacacacacacatacatatacatatgtgtgggtgtatatatgtacacaaaattgtaccagtggctgcttctggaaaggagcttagggtgggggagtaggagtagtcaaagagattttagcgtcatctgtattgttttgatttgattaattcagactttatcaagcaggtcctctgcgttcaactccatgattttccccaaagataaatctctggtacctaaaaacaaagacgattggctagacgtggtggctcacgcctgtagtcccagtactttgggaggccaaggagggtggatcacctgaggtcaggagttcaaaaccagcctggccaacatggagaaaccccgtctctactaaaaatacaaaaaattagccaggcatggtggcgcatgcctgtaatcccagcttctctagaggctgaggcaggagaatcgcttgaacccaggaggtggaggttgtggtgagccaggattgcgccattgcactccagcctgggcaacaagagcgaaactccgtctcaaaaaaaaaaaaaaaacaaagacgatttctttgtctttccctcatccaagaacatgattgtcctgttccagcagctgatgcataattcactgtccattgtatatgcattcacaatttgaaataaaagttcatctttgcagctaaaactaatcaccacttcatggcccaagatgagatgaaatttaacaaacatgtaaataatttaagttgcaatagtacaaatttctggagatactgaatctagagttactgaaattgacagaatacaacaaagaaattttatgcagcaactggggggtccaatgtaaaaacattaagcagtaagctgtggctgtgttgaatttacaagttaagatgcatggggttccgcctggcgtggtggctcactcctgtaatcccagcactttggtaggccaaggcgggcggatcaactgaggtcaggagttcaagaccagcctgaccaacatggagaaaccccgtctctactaaaaatacaaaattagctgggcatgatggtgcatgcctgtaatcccagctactcaggaggctgaggcaggagaatcatttgaacctgggaggcggaggttgcagtgagccaagatcatgccattgcactccagcctggcaacaagagtgaactccaactcaaaaaaaaaaaaaaaaaaaagcatggggttccatttctgatttatctttagactcagaaatcattaattcttggttaatgagagttttgagccagcttgttcaatagtctatcatttggcaaataggaattacagttgcctttagataggcaattcttgataattctgtacaaaaatgggtaaactttcaaaccatcttttcctagacattaaagtatgtgtcctttgtggatgaatcccacattaggatggtgaaccagcagctactagggagaagtctgcaagatgtcaagggccaagaagtcccagtaagttaaatcattttgtcttttttttttttttaagaaaatttactgttaaatataaacacatctagaaacttgtacaaatcaaaactgatggattttaacaaagtaaacatactcatataaccggcactcagattaaacaattgaaaattactagcaggagtcccttttatgcccccctccaatcactaccctctctttctccttttttaatttttaaaatttggctgggcacggtggctcacacctgcaatcccagcactttgggaggccaaggtgggtggatcacttgaggtcaggagttcgagaccaacctagccaacatggtgaaacctcgtctctactaaaaatacaaaaattagccgggtggtgtggtggcacacatgtaatcccagctactcagaaggctgaggcaggagaactgcttgaacccaggaggtggaggttgcagtgagccgagattgtgccattgcactccagcctgggtgacagagcaagactccatctcaaaaaaaaaaaagaaaaaaatgtatattcttaaattacaaacgaggtctcactatgttgtccaggctggtctcaagcagtcctcccacctcagctgtaccaagcccaccaactgccctctcttaaaagtagtcattatcctgtttccaaagattaattttactttggctagaattttctaaaaactgaatcacgtagtatgtaagcggtatatacgcggttgagtgtctggcttcctttactcaacattatttttgtgagagttgttcatgatgccatgtatagttcattctcattgtataattctgttttataaatatccaacttattcagccatcctactgttgatggacatttgggtagtgtccagtttggggctaatgccaataacgctgctatgctcaacatatggcactctactggacagttacctaagagtggaattgctgagtcataaggcagacatatgttcggttttaggagatactaacaaacggtgctgaaaaatggttgttcacatttgcactctccccagcagttctggttgctgggcatcttcaatttcctagggctgaattaccacaaactaagtggcttaaaacaacagaaatggccaggcatggtggctcatgcctgtaatctcagcactttgggaggctgaggcaggcagatcacctgaggtcaggagtttgagaccagcctgaccaacatggagaaaccccatctctactaaaaatacaaaaaaatagccaggcatggtggcgggcgactgtagtcccagccactcaggaggctgaggcaggagaatggcatgaacctgggaggcagagcttgcagtgagccaagattgcaccactttgagaggccaaggtgggcggatcacctgaggtcaggagttcaggaacagcctggccaacatggcgaaaccctgtctctattaaaaatacaaaaattagccaggcgtggtggtgcacacctgtaatcccagctactcaggacgctgaggtgggagaattgcttgaacctgggaggcagaggctgcggttagctgagatcacacctctgcactctagcctgggcaacagaacaagctccatctaaaaaaaaaaaaaaaaaagtcttttctgctccttttgaaatatcagtgagttttcttctttttttctgttagttgaattgtactgattgattttcaaatattaagccaaacttgcattcctgaagtaaactcaatttgaatgtgttgtactattctttgtatttattgctgaattccattcactaatatttaggatttttacatctcttcttgagaaagactgaccaaagtgtttccattcttgtaatgttcttgttggatttgtgtatgaagtgaactacagtcatgcatcacttaatgatggggatatgttctgaaaaacgcatcagtagctgattctgtggttgtctgaatatcatggactctatttacacaaacctaaatagaatagcctattatacttaggttatatggtgtagtctattgctcctaggctgcaaacctgtacagcatgttactgtactgaatacggtaagcaactgtaacagaatggtaagatttgtatatctaaatatagaaaaggtacagtgaaaatatgatataaaagcttaaaaatggtacatctgcatagggcacttaccatgaatggagcttgtaggactgaaagttgctctgggtgagtcagtgagtagtgagtgaatgtgaaagcctaggttgttaccgtgcactacagtagacttcataaacactgtacacttaggctacactaaatttacttcaaaatatttatctttcttcaataataaattaatcttagcttactgtgactgttttactttataaatttttaaattttttaaactctgtacagtggtataaaaatattttctttctcaccgggagtggtggctcatgcctgtaatcccatcactttgggaggccgaggcaggcggatcacaagatcaggagattgagaccatcctggccaacatggtgaaaccccatctctactaaaaatacaaaaaaatagccaggcatggtggcaggcgcctgtagtcccagctactcgggaggctgaggcaggagaatggcgtgaacccaggaggcagagcttgcagtgagccaagatcacaccactgcactccagcctgggcgacagagcaagactccatctcaaaaaaaaaaaaattctttctctatatccttattctatatacttttttctatttttaacattttttatttttatttttactttttaaatatttttgttaaaaactaagtcatggccgggtgcagtggctcacgcttgtaatctcagtactttgggaggctgaggtgggtggatcactcgaggtcaggagttcaacaccagcctggccaatatggtgaaactctgtctctactaaaaatataaaaattagccgggtgtggtggtgcgcgcctgtagtcccagctactcaggaggctgaggcagaagaatcgcttgaacccaggaggcggaggttgcagtaagccaagatcatgccactgcactccagcctgggagacagagcaagactccatctcaaaaaaaaaaaacaacaaatacacacacacacacacacacacaaaaaccatttccaatagtgctaagtcctatgaagaatgtggaataccacagtgtgataagggaatcatgtgggagaaaagctgctagatagggtggtcaggacaagaggtgacatctcaacagaggcctggcttttctgaatttcattttccaaaatctgtaaaataggccaggtgcagtggctcatgcctgtaatcccagcactttgagaggctgaggcaggtggatcacctgaggtcaggagttccaaaccagcctggccaacatgttgaaatcctgtttctactagaaatacgaaagaattagctgggcatggtggcatgcacctgtaataccagctacttaggaggttaaggcatgaaaattgtctgaacctgggaggtgaaagttgcagtgagccaagatcacaccactgtgctccagcctgtgcgacagagtgagaccctctctcaaaaaaaaaaaaaaaatctgtaaaataaagacaaggatacattatctcacaagcgtcttcaaaggcctgaatgaggcaatgcttacagaacacatgcatggtcctgatatctacacctaataaatgacggctactataaatcatgtaatattaaacgtaactttataagttaataaaattaaagaacctagaacctgagggcttgtcatggctaataggtttggaaacttgctttttcagagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccaacctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccccaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgactgaaggccgggcgtggtggctcacgcctgtaatcccagcactttgggaggctgaggcgggtggatcacctgaggtcaggagttcgagaccagcctggccaacatggtgagaccctgtctctactaagaatacaaaaattaggtgggtgtggcggtgggcgcctgtaatcccagctacttgggaggctgaggcaggagaatctcttgaacctggaaggtggaggttgcaataagccgagatagtgccactgcactccagcctagataacagagcaagactctgtctcaaaaaacaacaacaacaacaacaaaacaattctatgactgaaagtgactaaaaagctggctttatgccattaacactctgtactttgcagccaatcagaactgacgcagtctgggtgctagctgcttcaaaagcaacccacaccacacttttaccatttccatacatcaactgctgagaatatgaaaatgcacagtgacaggttttaggatcctgcttcaggatttccttttcctggtttggtcactagagttggctatttatctgtttctaaacaatagctattttatcgaatagtttagagaccactattaaatattgtgactgatgaaggatctgtgaatttttttatatatgttctaagagttaccattttgataccttttaaaaaccagcagctttctactatattcatgtaagacagcatgaataaaaccattttttgatacagggttttatttggctttaaactcaggaaccaagttaattatgccagattgaactttgatttttactaccttttcaaagatattttaaaaagtggattactacatatgatttctttggagcttacatttctttacttcacgaattctatgtcactgttacaagtttccattctgatggcttctgggcctttgtacctttgtttttggtgccttattcctagtatgtttctatcaccttaatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataatttatttaaatcttcatttcctttcttttcagaaggtccccaaatcacagttaactcattcattgacgcattcactcaacaactattcaatgaggcactctctagagaccaaggataaataaggtagccagtctcatagagatatgaggagatggaaattaatcaaataattcaagcaaatggcatcttgcaacttgtgctgagtataatggtgaaaaggcaaatgatggcatgagagcttatagtagggaaatttggcctatttggggagatcagcctacctgaggaaggaatgttttagctaaaatctgaaggatgagtattacttaactagtgaatgcgggaggaaagagcattctaggcagagaacagtatgtgcaaaggtcctggggcaggaaaagcagagcaggtttatagaacttaaaggagaactgtatgactgtgccataaaaagtacagagaagtaaggcatgagttacggttggacaagcaggcaggggctaggctgcctggagcctgtgggccatggtagagtttgtctgtatcctaagacctaagccacataagggttctaagcaggaacctggtaagatcacatttaattttaatttttttatttttatttttatttttgagatggagtcttgctttgttgcccaggctggagtgcagtggctcaacctcagctcactgcaacctctgcctcctgggttcaagcgattctcctgtctcagcctcccaagtatctgggattacaggcgcctgccaccacacccagctaatttttgtatttttagtagagacagggtttctccatgttggctaagctggtctcgaatgcctgacctcaagtgatccaccggcctcagcctcccacagtgctgggattacaagtgtaagccaccacacccagccatattaatttattttattttattttattttatttattttgagacagagtttcactcttgttgcctaggctggagtgcaatgccactatctcagctcactgcaacctccacctcctgggttcaatcaattctcctgcctcagcctcctgagtagccaggattacatgtgtgccaccatcacgcctggctaatttttgtatttttagtagagacggagtttctccatgttggtcaaactggtgccgaatgcctgacctcaagtgattcaccagcctcggcctcccaaagtgctgggattacaggagtacgccacagcgcccagccaccaaattaatttttaaagatcactatgatcgctgtgtggaaaatgagctgggagtggtggtggatacagtttttgtttttgtttcagtctttccctactccatgaaacatttgcgctatatatgcggccaaatggaatgtttctcttttctcccctcctcttcctcttgggaagtcaccaaaaaaaaaaaaaaagaaaaaaagaaaacaaatcagcagcaagagaaaaggacgaaaagctctggtggccttgaattttggaatggcccctgtcccaagctggcagggatgaggctgtgtgttgagcttcagatcacaggaaggagtgcaccaaatcaggagatgaagggcagtcagcaggacccactgggtacccaccgtgcagtgtaaggcctaaaattaagctctaatatgaggtgctgctttgacatcaggtgaaatcaggagtgcctcaccccaagtttctctcccagtcctcccttggcaaagggcgcccagtgaaacagccttccttatcaaaaagaccagatgcagttcctgctaatccctgagcggcaggtgtgagtctcctgccaacccacggagttgtccaaatgagccagtcacatcctccggggaaccagggcctcctcaccctcttggtgctacaaagcctgccccgcactggccctggttgttcactctgtttctgtgtggccctgcacggcaagtggggtcttcctccccgagctgtgagtgtgtgtgaccaaaaactgctgccaatctcatttgcccagtgttgggtgtcatgtgttcagctaccgccataaccctggggtgggaactgggaatccctccctcaccactgaggtaaagaggttattaaaacatccctacttcagctgggtgcggtgactcacgcctgtaatcccagcactttgggaggctgaggtgggtgatcacctgaggtcaggagtttgagaccagcctggccgacatggtgaaaccctgtttctactaaaaatacaaaaaattagccaggcgtggtggcgggcacctgtaatcccagctacttgggaggctgaagcaggagaattgcttgaacccgggaggcagaggttgcagtgagccacgatcacaccattgcactccagcctgggcaacaagagcgaaacgctgtctcaaaaaaaaaaaacaccctaattccaggccaaccagcagccctaaaaaattaatcttcgtttggcttctaccaaaagtcatggtctacacaaagccctgcctactagaggcaataaggaaccatgaccaccacccccatttattcaaattacccactggaatgcaccgagtggggtttcaccctctgctgcttgtatgtttctcaacccatgttctaatcccatgcagtcatcattcaggaatccctgaggatcccctgattcaacttctcttttttgaatagattagaaattcctatcttctttcacttttactgtgacttttcagcttcctgttttccattcctgagggctatgaatcatatttccaaaataaatgatgatctatggagaggattttgcatttccaacatccttagctaattttaatgaattatcatggtcacatgatcctaaggcttcaggaatcggaggaagtggctgacactgacttaccattttaaccaaacaatcactgcacttaagcttggataagggtcaaataaaactaacagggctcttatgcaagcccttccagtctggtaagttatgagtatttatgttttatttccccccaaaaacaataagaccctcagaggcaaggaactcatcttggtttttgtcccttacacacctatctcagtccagtggtatgatgggcactggaaacaaaccacctggttcaaatcctggcttggtcacttattggccaagtggcctgatatggtttggctgtgtccccacccaaatctcatcttgaattgttagctcccataattcccatgtgttgtgggagggacctggtgggagagaattgaatcatgggggcggtttcccccatattgttctcgtggtagtgaatatgtctcacgagatctgagggttttataaggggtttctcctcttgcttggctctcattcttgttttgcctgccaccatgtaagatgtggctttgctcctccttgcctttgtcatgattgtgaggcctccccagccctccccaggtgacacattggaactgtgagtcaattaaacctttcctatataaattatccagtctttggtatgtctttattagcagtgtgagaacagactaatacatggctttgggcagcttctcatgtctagccatggtagctattcttatgatttggatggtgcccaagcattgctctcgagctccaggcccatatatttaaccacctccagatattctatacttaaatggtttagaggcaattcaaacagctacaaaagacaaatcatgatctcagttcaccccacccacatgtgacttccagagctcccaagatcagccagtagcaccacctgccatcagttcaacttcccaagccagaaattcaaaggataccttgatgtctcccttctccttccccgttctgtccaatctcatctgttcattcagcaaacacttactgagcaccccagcactgtacaggagctagggatgaacaggtgaataagagaggctctttgggaggttaggtgcagtggggcagacaggcaatcacggtgaaaagaaatgcagtgaggacagcttgggatacagagtttgaaagaaacaagcaggatgctgtgataggagcaagggagttacttctgacaaggggcagggatagtgtctccaaggaagtgacatttacactagatctgaatatcaagaaggagccagctgtaatgagttgaaagaagggcattccaggaagagggatggaaaacataaagctgaggggtgagagagaaataagagtgttccagagcctggtgcaggagcacacacatgtagtcccagcgacgagagatcatcccttaagcccaggagtttgaggccagcctgggtaacatagtaataatctatctcaaaaagaaaaaaaaagaaaagaaaagaaatgagtgtgctccaggacctgtcagatggccagtgcaactatgcggtgagagacacagtcttgcttgttttcttactgcctcctaaactgggtggttccatctcactgaaacagacgctcaaagaaaggcgaaattcacaggcaagcacagccttgggagggttatgaagctggtgagatgtaagcgggccctcactggaggaaggggctggaaacagtgggatgagaggaggcattcccaacaggaccagcagcacaagccaggcccagaaacaaatgactatcatagtggagggagattaaatgggactgatttggggaaaccttcaaaaagaaaaaaaggctgagatgtttgaaccagttgcaaagttaagatggagccgttcttggggctgacagaggacatgagaaaagcagtgacttaagaaatcccagccgggtgcagtggctcacgcctgtaatctcagcactttgggaggccaaggcgggcggatcatgagatcagcaagtggagaccatcctggcttacacggtgaaactccgtctctactaaaaatacaaaaaattagccaggggtggtggcatgcacctatagtcccagcttctcgggaggctgaggcaggagaatcgcttgaacctgggaggcagaggttgcagtgagccaagatcgctccactgcactccagcctgggtgacagagcgagactccttctcaaaaattaaaaaaaaaaaaaaaatccctcagaccgacatgaggacgtgggatgggaggggaagcctggggaagtgacatcatttagaagtcagctgggattatataggagtgactcagtaagccacctgtgctactgaattggtggtggtgatagaaagaaaaggaagagagatatatatatatggggggttttgttgttgttgttgttttttggttgttgttgtttttgtttttgttttgtagagatacggtctccctatgttgcccaggctggccttaaactcctggcctcaagcaatcctcccgcctgggcctctcaaagctctgggattataggtgtgagccatcacccccagcctggctaaatgaatttttaaaaattcctctgagtccaacaggaggagattggttaagtaaattatggcacagtcatataacaggagggtatgcagctattttaaatgatgccatagcaagatagttaatgggccaggcacggtggctcacacctgtaatcccagtactttgggaggccgaggcgggtggatcacgaggtcaggaattcgaaaccagcctggccatgtggtgaaaccccgtctctactaaaaatacaaaaaccagctgggtgtggtggtacgcgcctgtagtcccagctgctcaggaggctcaggcaggagaatcacttgaagtcgggaggcagaggttgcagtgagccgagatcatgccactcactgcacaccagcctgggcgacacagcaggactccatctcaaaaaaaaaaagaaggaaaatccgattgataaaaatctacatttacaaaaaaagtaaatgggaggggcgagagtaatttttctttacaaaggagttcataagaagataagattccttcaagaacatctgaatgaaattgtaagaactgagtcctccttttcaggagcttgtctatggaagaggcacagggatgcgcagaccctggctgtgagaacactttagaactcttcttcgtttccttatttgcaaaagaaaaggattaggctaagcatgctctctaaggtacttttaaattttttatttatttgatttatttgatttttttggagacaaggtctcactctgtcacccaggctggagtgcagtggcatgaacacagttcactgtagcctcaatcttctgggctcgactgatcctcctgcctcagcctcccaagtagctgggactacaggcacatgccaccatgcctggctaattttttatgttttgtagagacgaggtctcaccatgttgcacaggctggtctcaaactcccaggctcaaataatcctcctgacttggcctcccaaagtgctgggattacaggcatgagccaccgtgcctggcccatacattcttttttaggatgcacaaggaagggttataacaacagatatgcattagatcatgtattttcctcaatacattcccaacagcaatatgatacagaccaggttctctaaccacatttcaaggaaattagaaattcattttcttttttttctttttttttttttttcatttgagacagagtctcgctctgtcgccagggctggagtgcaggggtgcaatctcggctcgctgaaacctccacctcctgggttcaagcaattctccctacctcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactagtggtactcaatgcagataattatgcagagcacaaatcatctatagtttcacccttcccagaaaaaccagttaagattttaatttatgatctgccacacttttttctataaacacaaaaatttgaagacccagtacacatattgccctgttatatttttccatttaattatctcaaatatctttccacagcatactatcattattttattttattttatcttgagatggagcctcattcagccgggcgcagtggctcacacctataaacccagcactttgggaggccaaggcgggtggttcacctgaggtcaggagttcgagaccagcctggccaacatggggaaaccccgtctctactaaaaatacaaaaaattagccaggtgtggtggtgggcgcctataatcccagctacttgggaggctgaggcaggagaattgcttgaacccaggagatggaggttgcagtgagccaagatcacgccattgcactccagcctgggggacagagcaacactctgtctctaaaaaaataaataaataaaaaataaaaaagcttttcaatagttttgccttgctggactcactgggttatgtctgtaatcccagcactttgggaagcagagctgggagaattgcttcaggccaggagtttgacatcagcctgggcaacatagtgagaccccatttctttctttttttttttttttttaagaattttaaaaaacgggcggggcacagtggctcacgcctgtaatcctagcactttgggaggcccaggtgggcagatcacctgaggtcgggagttcgagaccagcctgaccaacatggagaaaccccatctctactaaaaatacaaaattagccaagcgtggtggtgcatgcctgtaatcccagctacttgggaggctgaggcaggaggattgcctgaacctgggaggcagaggttgcggtgagccaagatcgcaccattgcactccagcctgggcaacaagagcgaaattccgtctcaaaaaataaaaataaaaataaaaaaagttaaaaactaaaaaaaaaatcataaatgttacacattttcaaccaagtaaaacgaaataaaatatatagattttacattatttccattctatatattacaattttttcttcgtggcacagtgacatgaaatttcattgtgaaatttaaaaagaaacaaacaaaaatttgttgtgaaaatcacatacaggattgatgaatttggggctgcctcttgttttcagcagtatcagacaattcccccacactgcctcttgcagtcacaggttattccccatccaccttttattctacgctgcctatcaaagggtgtgatctctgaggtcttttacagcctaaagaccgaatgtcaaatgtgctaagatgtcaagatccaggtattagaatatgtccagctcatctgcaggaatatcatccttccccatctcctccatttcaacaacctgtaattcctcccacccactgaatgggagaaaacatctatagatcatatatctgatatggaatttgtatctagaatatataaagaagtcttacactttaaaaccataatacaagtggccggcatggtggctcacgcctgtaatcccagcaatttgggaggccaaggtgggtggatcatctgaggtcaggagtttgagaccagcctgatcaacagggtgaaaccctgtctttactaaaaatacaaaaattagcagggcatggtggtgggtgcctgtaatcccagctactacttgggaggctgaggcaggagaattgcttgaacctgggaggcggaggttgcagtgagctgacatcccgccactgcacaccagcctgggcaacagagagagaccctgtgtcaaaaaaacgaaaaggacgttgggtctgatggggttgagaggattatctgtgatcaacatatggcctgttagataagagtcagggtttttctgttctgtttttttgctttttgttttttttgttgttgttgttccacaatagattcagtctcaagcactacccagggaaagcaacagcaaaattataaaataatttattcctcacttctgctatcaacttgttctttatttagacgttctgtttctggaagtatatataattatactgtgtgccacacgtatctgtcattctgttatacaatgacgtatttcacaatgtctatgtgccagataagcgagtcttacatctttaaatgcctaaacatttaatttaaacattttttcattgtagattctcctaaacaaatgacactgtctcttctgactggccttttgcggctcaaggccattgtaacaaatgtcagtcttacataaccataaccaaatgacaccctaaggcacactgaggtctctaaactaaatggccccagactgatgagcttttcggagttcttggctctgctttttatagaaacatttcttttttatgggctatttgtgtatcgctgctcttagtattggtggcctggggcaacgcgtcccacctccttctaatttgctgcattcaaacaaatgtttgttttaccacctacgttactggtgacataatacattttttatctgttagatcctagggctatagacatagtcttttcaattccaagtttcagaaggctactaggttaagtaaaaaatgaacacttattatgagattatgggggtatctcaaaggtaaaggtgaacggggggaggaggcagaaccaagaagtggaagctcaacagaaaccagaggccgttcccttcgtctctctcacctctgtgcatctttgcccggctgtttcatacttttgcttctgcagattactgttctcagcttctccatgcatacgatggttatgtcaaatcagttccagtcacctgcagagaagaaagagttgtcactatcccaatgccaaagccagaggagagactggcccggctgggtcagtttcccacctgtggtccagtcagctgtggccaggaagataaggtcacatagtataaaaacagctgctgcaccacctctgcgagaaatgacagcctagagaaagcaggtactgatgaactggcttcaccagcaacaaaggaaccagaaaatcgaaactgctccaatcgcatctgaactaaaaagaggccgggcgcggtggctcacgactgtaaccccacgctttgggaggccgaggcagatggatcgcttgaactcaggagttcaagaccagcctgggcaacctggtgaaaccccatctctaccaaaaatacaaaaaattagctgggcatggtggcgtgtgcatgtagtcttagctacttgggaggctgaggtgggaggattgctcgaacccaggaggcggaggttgcactgagccgagatcatgccactgcattccagtccaggtgacacagggagaccctgtctcaaaaaggaaaaaaaaaaggtaagcttggtgtgagggcctgagatgctcccctgtgaagaaggaatatgacgtctggccccatggattcgtggtatatactttgcttttcttgagaccttggttgtttactccctgtttactggaattattactgagacataactcacataccataaaatttactctttttaaatgtacaattcagcggcttttagtatattcacaggttccgcaactatcaccactttcttttccagcacattttcatcaccctaaatggaaaccttgtactcaccagcagccactttccatcctttctttcccccagcccctggcaaccactaatctactatcagttttgttttgttttgttttgttttgagacggagttttgcccttgtcgcccaggctggagtccaatggcgcgatctcagctcaccgcaacctccgcctcccaggttcaagcgattttcctgcctcagcctcctgagtagctgggattacaggcgtgcaccaccatgcccagctaattttgtatttttagtagagatggggtttctctatgttggtcaggctggtctcaaactcctgacctcaggtgatatgcacgcctcaggcctcccaaagtgctgggattacaggcgtgagcctccacacccggcctctactttcagtttctatggatttgcctattccagacatttcctatacacagaatcatacgataagtgccctgtggcatctggctcctctcactcagcgtggtgttttcaagggtcatccgtggtgtggcgcgtgtcagtgcttccttcctgtggctgaatcatgttccattgtatggatggaccacattgtgtttatgtgttcattagttgatggacatttagattgtttccactttttggccattatgaatgctgctatgaatactcatgtacaagtttttgcatgaacatttttctttttcagaggaggggtggaagtttatttgaaatgccttaggatgggaaaggaagctgtgcttggaagaggcccaagtgggcatgggaaggttaaagagacaaggtcagatgccaaacatagcttttcttttcttttttttttttcttgatacggagtctcgctctgtcacccaggctggagtgcaatggtgcgatctcggctcactgcaacctcccaggttcaagtgattctcttgcctcagcctcctgagtagctgattacagggattacaggcatgcaccaccatgcctggctaatttttgtattttgagtagagatggggtttctccatgttgcccagcctggtttcgaactcctggcctcaagtgatccacctgcctcggcctcccaaagtgctgggatgacaggcgtgaaccacggagccccgcccagaacatatctttttaattctctggggaaatcctagaaaaggaatatcttggtcctacggtaatttctatgtttaacattttgaggaactgctgttttccaaagcagctggcccattttacattcccacgagtaaaaagcagctggaccattttacattcccatgagtaatgtgtgagggttccagtttctccacatccttgccagctttttgattgtccatctttttaattataaccatgctagtggggaggaaatggtatctcactgtggctttgatttgtatttccctaacgataatgatatcgagcatcttcttgtgtttattgatctcatgtgtatatcttctttggagaaatgtctattcagatatgtttgcccatttttaaatagggttgtcatgttattggtgagttttaagagttcttacgatatctgaaatactagatccttaacagatataggatatgtgaatattttatcattctgtgggtttttccctttcttgatggtaactttgaagcacgaacttttcagttttgacaaagtagtccaatttatctatttttttcttttgttgccttgctttaggcaacaaaatctaaatctaaaaaaccactgtctaatccgaggtcacaaagatttgcccctatgttttcatcagagagatttataattttagctcttatatgtatgtctttgatccatttttaattttctctctttccttattatttttattatattattttttttaagacagagtctcactgtgtcacccaggctggagggcagtggcacaatatcagctcactgcagcctccgcctgctgggctcaagcaattctcctacctcaacctcccaagtagctgggattacaggcatgcactaccacacccggctaacttttgtatttttagtagagatggggcttcaccatgttggtcaggctggtctcaaactcccgacctcaagtgatccacctacctcaacctctcaaagtgctgggattacaggtgtgagccacacctggccaatttatttttttaaaaattttatgtagctgggactacaactacaggtgcgtgctaccatgcccagctaatttttgtactttttgtagagatggggtttcaccatgttgcccaggctggtctggaactcctgagctcaagtgagccacccacctcggccccccaaagtgctgggattacaggtgtgagccaccgcatcccgccttcttatttatttttgagacagggtctcactctgtcacccaggctggagtgcagtggcacaattgcagctcactacaaccttgacctcctaaactcaagtgatcctcctgcctcagcctcccaagtagctgggaccacaggcatgcaccagcatggctggctaatttttaaagtatttatagagatgggggtctccctatgttgtccaggctggtctcaaactcctgggctctagcaatcctcccaacttagtctctcaaagtgctgggattacaggaatgggccaccatgtctggtcaataaagttattttttaaaaagagataatccaagagcaacagtgtaaacaaaataacttttccaaatcattttttaggatcagcttctttggtcaggcctaatgatgttaccaactagtaatttataaaaacttgcatttctacatttttcttaactgaccccattccaaaacacaagcaaaccatctaaattcaagatttgtgaggttgggactaactcattactatagggtaagtatgaatgaaggctggaaatgtgttttgattgctgccattattttttatttttattttttctgagatggagtttcactcttgtcgcccaggctggagtgcaatggcgtgatcagctcatggcaacctccacctccccggttcaagcaattctcctgcctcagcctcctgagtagctgagattacaggcatgcgccaccacgcccagctaatttttgtatttttagtagagacggggtttctccattgttggtcaggctggtctcgaactcccaatgtcaggtgatccacccaccttggcctgccaaagtgctgggattaaaggtgtaagccacgtgcctggtgttttttggggtttgtttgtttgttttgagatggagtctgtcacccaggctggagtgcagtggcacaatttcagctcactgcaacctccgcctcccaggttcaagcaattcttcctgcctcagcctcccgagtagctgggattacaggcacctgccataaggcccagctaagttttttatattttcagtagagatgaggtttcaccatgttggccaggctggtctccagctcctgacctcacatgatcatccgcctgcctcggcctcccaaagtgctgcagttataggtgtgagccaccgtgcccagccatgttttgattcttaaggaaatgatttttaagtccccttccaatgaggatttagcaatggagttttcttcttctacagataatttgaggcttcccaattgcaccaaactccatttgggcagatacctcacctgtccactccatagccctagcatcaagaaaagtgccaagcacacaacaggcactcagtaaatttctgtcaaatgaatgaataaaataccaccaccttttcctgagaccattttggaccaaggctggcatgggcatctctgttcctccctctaacttaagaattccatctcttagaggcagatgctgcctgttttctgcaaattttattattcacctttctatatttggaaaaacaagttggtgtggcttacttaggaatctcatatccaggaaatgagctaaaaatgttgtatcaaagattatgcataggatccacaaactaagaagcaagcagatgagagcggttagagacatcgtggtatattttccggaagaaatggtccatggattaaaaattgtcattatgatgagtctgcagtaacacagaaaccacgtagtgcgaatcagaaaatgaaaagcacagccattgactatgattacaaaccaaaactttataccaattacctgttggaatttatgctgcatgaaggcaggatattttgcttgtcctgttcactggacagtacttggcataaaggatgtgcttatgaatattttctgggaaactaaatataacattcacctgtgaaaacacatctgggccaggcgcagtggctcacgcctgtaatcccaacactttgggagcccgaggcgggtggatcatgggaggtcaggagctggagatcagcctggccaacatggtgaaaacctgtctctaataaaaatacaaaaattagctgggcgtggtggcgggcacttgtaatcccagctactcaagaggctgaggcaggagaattgcttgaacctgggaggcggaggttacagtgagccgagatcgcgccactgcactccagactggacaagagtgaaactccgtctcaaaaaaaaaaagaaaaagaaaaagaaaaaacgtatctgaagggaatgaacaaatacacatgcggaaaattgtattcatggggtagaacggtggctgtttccccccctttcactattttctctcctaaagttgtgatagcattttctcagtggaaaggatgaccacagaattatctcccctgggctgcaactaaggaagtatttggagtgagaatgcgaccaggcttcaaatccaggaggggtattttacagggcgtgtggctctcacccagggctcacaggacacctgatatttaggctgttccccaagaggctaaggacagcgcggccccagctcccccaaccacagctgcccaagtttaggagcccgcactcgtgagcgatggctactccgcacagccccggggtcctctacggaaatccctggcacctatcagtacccctaagggaggtcgctcgttacccctcacttgaactctgtcccaaatgggaggtcactctctcttcgcggaccccatcttccccgaaagggtctcttgttctctctggccctcctgagaaggtcattactccccaactcgccttttttgttgttttttggtttctggtttattgaggcagggtctcgcttcatctcccagactggagtgcagtggcgcgatcacagctcacacggcagcctctacctcctgggctcaagcgatcctctcacctcagcctccctgggactacaggcgagcgccactacgcccgctttttttttttttttttttttttttttgtatttttgatagagacgaggtctcgctatgttgtccaggctggtctctaactcaagattcctctcacctcggcctccgcaagtgctgggatgacaggtgtgagccaccgcccccggcccctcgcccgccttttgaaggagcctttcgtcctcaagggcgaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgagcgtggggccgcgcggggggcgcggcgggtgctgccctcgcgtccgcgccgtgcggcggctcatcctggcctcggtcacctgggcgagtccgggagcggcgagccgaggcggtgacaccttccctgggccccagccgccgcgccggggccccgggggcgggaggctgcttgctgctgttttaaaaccacagcctgggccaggcgcggtggcgcaagcctgtaatccgagcactttgggagcccgaggcgggaccatcgcctgagcccaggagttcgaaaccaatttgggcaacatcgtgggaccccgtctctgcaaaaaattaaaaatcatccgggcctggtggcgcgcgcctggggtcccagctactcaggaggctgaggtgggaggatcgcttgagcccaagaggctgaggctgcagtgagctatgatcacaccacttaactcgagcctgggagacagtccgagacccgtctgtttacaaaataaataaaggcaaagcctggctaggctgttaccctctcctgcctgaccccccatagtgccccttggctgtaggggcttcgccctgaacgtctcaatcttcgctctccacttcccatcctgctgatttgctgacaaaaccaaagcttggaatttccgcttggttccttctgggtgggtggcttttggtcatttcttttgatcactatgcggtgtcactatgtggtagtagcgaggtcagactgtagcgagtgtttaaagtttgcttcctttgttttctgggcttgtggggctttttgtggtacctgccctagcctagtcagtcattccccatgctgcccccttaggctagagatgccctaccgccctcaggcctcgctgaatgtgccattgtacttgaaggcacctgttacttttttaatttttttatttttttgagacggaatttctctcttgtcgcccgggctggagtgcaatggcacgatctcggctcactgcaacctctgcctcccgggttcaagcaattctcctgtctcagtctcctgagtggctgggattacaagtgcccgccaccacgcccggccaatttttgtattttttagtagagacggggtttcaggctggtcctgaactgacctcaggtgatccgcccacctcagcctcccaaaatgctgggattacaggcgtgagcccccacgcggggctggcacctgttacaattgaatacaacgcgagagagaagatgataattaccttgccacctggggccactttaaaggcttacctggggtgttctggtgtctacagctgctgggctgacacgtattgcctagtgcagtggtctccaaactgcacattggaaccatctggaaatctttggctcccatccccagacccttttttatttttttgatggagtctccctctgtcgcccaggctggagtgcagtggtgcaatcttggctcgctgcaacctccacctccctggttcaagcgattctcctgcctcagcctcctgagtagctgggattacaggcacccaccaccatgcccgggctaatttttgtatttttagtagggacagggtttcgccatgttggccaggctggtctcgaactcctggcctcaggtgatccacccgccgcagcctcccagagtgctgggattacaggcgtgagccaccgcgcccagacgcatccccagaccttctgatttaattgctgcagagtatgatcggctgcccaggtgattctcatgttcagcaacgtttcggaaccaatgaactgtgtttcccaagtttacctgatcatggaagactcatctgaggaattgtttaaaagtaacagatccccccgtctttggggtgaggtttggaatcttaacactgcccaagggaagcccaagcaggtttggcttccaatatctgtcagcagcagcagtagatacagacagtattcaagaggatggctttccaggtgcagactcaacatcagaaccacctggcccacacccagatttggactcattggctcacacctgtagtcccagtgctttgggaagccaaggtgggaggattgcttgaggccaggagctcaagaccagcctggacacaagaccagcctggacaacatagcgagaccccatctctaagagaaaaataaagtttaaaatggtaaattgtactgatggagcagtgcaaaaaaaagaattttttttttttttttttctgaacacggtggctcatgcctataatctcagcactttgggaggccgaggcgggtggatcacctgaggtcaggagttcgagaccagcctggccaacatggtaaaaccccgtctctactaaaagtacaaaaaattagccaggcctagtggctaatgcctgtaatcccggctacatgggaggctgaggcaggagaatcgtttgaatccaggaggcggaggttgcagtgagcccagattgcgccactgcactccagcctgggcaacaagagcaaaactccatctcaaatatatatatatatatatatatatatatatatattttttttttttttttggagactcactgctagccagttaactgaactcacatccctggttggacctgaagcatttgggggcaggagctcccctgcagctttttgcttttggcgtttgctgctagtgggaggatcagtgcacatctaccttagggtacctgtaaaattacaactgcggaaaatatccatagtggtgttgcactgtatggtagccactagtaacttgcacctgttgaacacttaaccgttcctactctacactgagatgtgctataaccttaaaatacacactggatttcaaagacatagtacagaaaaagaggctgggcacagtggctcatgcctgaaatcacagtactttgggaggctgaggtgggaagatcgcttgagctcaagagtttgagacaaacctgggcaacatagcgagaccttgcctctacaaaaaaatacaaaaattagcctggcatggtggcacacgcctataggcctacctatttgggaggttgaggcagaaggactgcttgaacctgggaggttgaggccacagagagctgtgatcacaccaccctccagcctgggcaacagagcaagacactgtctcaaaaaaacaaagagtaccactatcacatgaaaacattttttattgatgacatgttaaaatattttggatatattgggttacacagaatatatcattacaattaatttttcctgtctcttttttctttttttctttttaaacggcgccttgctttgtcacccagactggagtgcaatgcactgcaacctctgcctcccaggctcaagtgattctaccatctcagcctctggaattatgggactacaggtgcacaccaccatgactggctaattattgtgtttttgtttgtttgtttgtacagatgagaaatctcatctctacaatcatgaggtttccatgttgcccaggctggtctcgaactcctgagctctagcaatctgtctgcctcggcctcccaaagtgctgggattacaggcatgagccaccgtgcccagccctttctatttctttttactttttgacatggctactagaaacttttaaattacagggtcttgccctgtggtagctcacgcctgtaatcccaatactttgggaggctgaggcaagtggatcccttgagcttaggaattttgagaccagcctgggcaacgtagtgaaaccccatctctaccaaaaatacgaaaaattagcttggcatagtggcgcacacctgtggacccagctacttgggaggctgaggtgggaggattgctgtagcctgggaggcggaggttgcagtgagccaagattgtgccactgcacttcagcctgggcgacagagcgagagcctgtctcaaaaaaaaaaatatgtggctcgcgttatgtttttatgggacagcgcagctctgtaggattccttatgacgcattcactatctcggtcatgagaatctttaaagcagtaaatgctttgcttttgtccgtcttgctataatcaaaactgactcaggacctgcattaaggctctttttttttttaacctcatctcttaactttttgatgcaactcatcttagtgaaattgtggtctcctcctacagcaaccctccctcaaaaaaagaccgaacacgcaattctcatctatctaactctgttaacaatcatatgaggaggaaataatcacatgataatgagtggcatgaaaccctgtgtctctaaattaagcaactcactgtacttgatgagtacatcagtcttcctgccccaagcttttgtgtgtcagactggaattaaatggaagcttacactgcagctgaattcctagaagccctggacttgtcaggggaaaagcccatggggggaaagcccatctctaggctgggcaatgaacttggagactgctcgatcacacacactcataagtaacaaaaccattaatttcttttcttttttttggtggagggacagagtctcactcttgcccaggctggagtgcagtggcatgatctcagcccactgcaatctccacctcccgggttcaagtgattctcctgcctcagcctcccgagtatgtgggactacaggcacccaccaccacacccagctaattttgtgtatttttagtagagtcggggtttcacaatgttggccaggctggtcttggactcctgacctcaacaaaaccagtgaatttctgaagtctcagcatctaggacttagaagaaggagaagcctagcatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaatgaggttaagcaccttggccaaagttatgcctcgtgaatggtggagctgagccatgaaccaagacctctgcctccagtctgtcctaacccctataagctaatgcctgtagatggttttttttttttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggattccttatgacgtattcactgtctcagtcacgagaatctttaaagcagtaaatgctttgcttttgtccatcttgctataatcaaaactgaccatgcccggctaattttttattttttgtagagatccctatgttgcccaggcttgtctcgagctcttgggcacaaatgatcttccccccttgacctcccaaagttctgggattacaggcgtgagccactgtacccagcccctttggatttttaattgttcaaactggtagtcatagtcccacttcagaggagagaaccatatatgtgaccagaattcttgggggaaaagtaagaaactactcttaaaagttccttaaagggtagaattctcttttctagaaagagtagcctagggttgtccaatcttttggctttcgtgggccacactggaaggagaaattatcttgggccacacattaaatatgctaacactaacaatagctgatgagctaaaaaacaaactttttttgatcacacaaaaaaaaatctcataacgttttaagaaagtttacgaatttgtgttgggcctcattcaaagccatcctgggccgcatgcggcctgtgtgctatgggttagacaagcttagagtagagcatagtgggtgagagaagaggcttcagatgcttctggcttgagttcaaatcctgactctgccactcactagctgtgtgacctttggcaagtgacttaacctctctgtgtttccatttcctcctctgtaaaatggaaataataataatgatacctgtctcataaagtggtcaggattaaatgagttaatacatataaagagcttagatcagtgcctggtgcctataaacactccagtggtaactgttataatttgtattatctcttggtgattcccataggtcacaggcattgaaagtgctcaaagggccaggtgcagtggctcacgcctgtaatcccagcactttgggaggtcgaggtgggtggatcacctgaggtcaggagttcgagaccagcctggccaacatggtgaaaccccgtctctactaaaaatacaaaattagccaggcgtgttggcgcatgcctgtaatcccagctacttgggaagctgaggcaggagaattgcctgaacccgggaggcggaggttgcagtgagccaagatcacaccattgcactccagcttaggcaacaagagcgaaacatcgtctcaaaaaaaaaaaaagagaaaatgctcaaatgtaataaagacagtattcatcgagcgttttctctgtgccatcagtgtgctgagtgctttacctgcaccatctcatttatttcccgcaaaccctcctgtggtttaggtgctaccatccccatttggcagaagtggaaatggagtcccctagaaggtacgtagcttgtagaaagtcatgtaattagtcaacatcgtacttccagccactggccagcagaagcttccccatcaattcaaatccattgaatcctaatggcaatttaagaggcctgttttattttataggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggtgtgtctcccactgtgtcttctgtctaacactgacaccttgctctttactgactttgcacacttgattaatgattgacgtggcctgagtcctgacatcaccaatgcccagaatgattgttttagtccaagaaaacggtgcagccagatctcttttcagcttaggatctaacagagtgtatccaggcagctgtggttcctcagcttgaaagcatggcaggctgaaagccctgaaagatgagaaaacaaatgtcttaaatcctgatagaaattcaagtggaaatatcacctttccacattttgggtttgcattattgtcccaaatacacgaggtaaatcttttcagacagtgtaaaaactttaggccgggcacagtagctcacgtgtgtaatcccagcactttgggaggctggggcgggcagataccttgagcccaggagtttgagaccagcctgggcaatgtggtgaaaccccatctctataaaaaaaaaaaaaaagaaaaaaaaagaaaagaattagagaccattagagaccaaaacccaaacaagaaggaaacagagacagcagcacaggactccatcgggagcgaaaggaagggaagacattgtttactgctgcatactagtcttcaggctgttaatctgcaaagctccaagttaaacattgactctttagtcctggtaacagctctgcaccacacagtcaaacccgacatagccctccagatggcctatgtgctaagggaccgagggcgaccagtagagataagctgccaactcttggctcagagctcttgccagggaaaacaagaactccagaaactctttcttcaggtgtgttcttccccctgccttctcaagagaagggtcttgtggggtccccagagaggagaccgagctaatgagccataaaagtcaggaggaagggccaggtgcggtggctcatgcctgtaatcccagcactttgggaggccgaggtcggtgtatcatgaggtcaagagattgagaccatcctggctaacatggtgaaaccctgtctactaaaaatacaaaaattagtggggtgtggtggtgggtgcctgtagtcccagctactagggaggctgaggcaggagaatctcttgaacctgggaggcggaggttgtagtgagccgagatagtgccactgcactccagcctggtgacagagcaagactccgtctcaaaaaaaaagatcaagtggaacaggggatttgcagttggctggagggggcagtcctgttagcatgtacctgtctcagcagagagacggttgcctcctgtgcaggcatagccttgtcccggtgagctctgggaatgtcatgctcggtgtgtttactgggcagatgaggaagggcacaagccccgcttttgtcccttggtggaaaggagcaccccacaactcagccttccgtggtggatctgggcgggggccgtgtgagttccccagggctttcctcatgagctttcacgacgtctgtgttctttgtagatggaacacagtcatctatttgcagccccttggctcatctccagactgaaattacccttaatttgaagtagataagtgataggaaacaggccagatgtggtggttcatgcctgtaatctcaacacttttggaggccgaggcagaaggatcacttgagcccaggagtttgaggctgaagtgaactgtgatcacgccactgcactccagctagggcaacagagcaagaccccaactctaaaagagagagaaagaaggagagataggaaacgaaaagtagaccatactggattgttccaagtataactcaggagagtcgtaggagcggccttctctaacaccaaatgcagagtgtgtttgtacattgaacacctgggaacgtgacaggtggcgggagagaggctgcagctcatgccacatcctcacgcctcctcctgtggccttctccttgtctcccaacatagtttgccctaggcctttggaggacgccagctatttctagagcttccaccacttgtcagaccgtggggttggggatgtctacagactggttggtttctgagttgccctgatccccaagatggctcccactactgactgttatcctcaggagtgtgaaatgctaaaagctttgggcatctccttttaaaatgcctgggcccagccaggcgcagtggcttacgcctgtagtcccagcacttttggaggccaaggcaggaggatcacttgagctcaggattcaagaccagcctgggcaatatagtgagaccccatcttgattggatgggtggtggatggatggatggatggatggatggatggatggatggatagatagatagatagatagatagatagatagatagatagatggaaagaaagaaagaatagataaatgataggataggagaaagaaagggaaagaaagaaaagagaagagaaaagaaagaaaagggataggatagatgacagatgataggatagattagataggtgatagataatcgataaatagaaaacagatgatagatataggatagattagatagatagatagatagatagatagatagatagacagataatagatagattagattagatggatggacaccagcccccaatgagaggaggatccaactagaatcttttggggtctttgccttttattccttatatgaggaggtcattatcagcaattcttcagtctcatccctagcaaattgctttccagaaactctaaatcaattatttggcacctttatacatataaggaggaaacagaaccttttcaaagagaaatgtcacttgctgaccctgaccgagtcttctctagaatgtttgatttataatttcagttaggaaagaaaaccagccagatttgagccccatgaggcctcatgtttttattcctctgagataatctggttggcagggaatgtttttagcacttgttggctctttccctcagtaagtcaagtttgattgagaaaccattgtttcagtttgcagacccccccctttttttaactgcagtcaaattcacttatagaaactaaccattttaagtcgggcacagtggctcatgcttgtaatcccagcactttgggaggctgaggcaggtagatcacttgaggccaggagttggagaccagcctagccaacatggtgaaatcctatctctactaaagatacaaaaattagccaggtgtggtgatgtacacctgtagtcccagctactcaggagggtgaggctggagaatcgcttgaacccaggaggcggagattgcagtaagccaagatcgtgccactgccctgcagcctgggcgacagagcaaggctctgtctcaaataaataaataaataagaaagaaattaaccattttaaaatgaaaaattcagcacatttagtgcattcacagtgttatgcaagcatcacctctatctagttcaaaacatttccatcaccccaaagggaagcctcgtatgttacacaaccactccccattccccacttctctcactccctggcaacccgtaagtgctttgtctctatggacttgactgttctggaaatttcacatcaatgtaatggtatcctgtgtggcctttgtgtctggcttctttcactcagcatcatgtttttggggttcatccatgttgtagcctgtatcagtgctttattcctttattttattttttgagatgaaatctcactctgtcacccaggctggagtgcactggcgtgatctcggctcactgcaacctccacctcccaggttccagtgattctcctggctcagccccctgagtagctgggattacaggtgcccgccaccacacccggctccttttgtgtgtgcgtgtgtctgtgtgtgtttgtgtgtgtgtgtgtgtgtgtgtgtgtgtgtttttagtacaaagtttcaccatgttggccaggctaatctggaattcttgacctcaggtgatcctcctgcctcagcctcccaaagtgctggaattacaggtgtgagccaccatgcctggacccttcattcctttttattcatggctgaatcacattccatcatgtgactagactaggacagacatttgggctgtttccaccattttttttttttttttgagacagagtctcgtgtcatccaggctggagtgcagtggcgcgatgtcggctcgctgcaacctccgactcccgggttcaagcaattctcctgcctcagcctcccaagtagctgggactacaggtgcccgccatcacacccggctaatttttgtatttttagtagagacgggggtttcactgtgttgaccaggctggtcttgaactcctgacctcgtgatccgcccgcctcagcctcccaaagtgctgggattacaggcttgagccaccgcgcccgacctgtttccaccttttggctcttgtgaaaagtgttgctctgaatatttatgtacaaggacttgtttgagtcactgttttccattgggttataaactttgatgggagagagcgggagagcacgcggtcagtgtttgagttgtcctcttcagtcagcgtctgcctttcttggctctccgtgagtcctctgagcgtggcttgcccgtgctgtctcccctctgcaggaggaaaactccctcttcgtcatgaccaacgtgatcctcaccatgaaccagacacagggcctgtgccccgaggtaggaggcccccgggaagagccccaggccccacacccctctccacgcctgtccacctgtgtgtggggccgggccacgtggactttcttttcgctccttctttttccagattccagatgcgaccactgtgtgtaaatcagatgccagctgtactgccggctctgccggcacccacagcaacggtacgagcttgtggcctcctggggagggcggcccctgagcagatcgcccccactgtggagcgtctctgatagagaaatcttcccaattccttcacatgaccctgggtgagccaggtgccgaggctggggtcctggagcccctctacattcactgctgtcattggagccccacaagccatcccagctcttgccctactgtttttttttttgttgttgttgttgttttttcttgtttttttttttgttttgtttttttgtttttttgagccagagtctcgctctgtcacccaaactggagtgcaatggcatgatctcggctcactgcaacctccacctcccagtttcaaacaattctcctgcctcagcctcccgagtagctgggattacaggcatgcaccaccacgcccagctaatttttgtacttttggtagagatgggttttaccatgttggccaggctggtctcgaactcctgacctcaggtgatccacccgcctcagcctcccaaagtgctaggattacaggcatgacccactgtgcctggcctcttgtcccattctttagcttggcatcaccctggctgagatgtggctggcacacaggtaactgtcttcctccgattctaactcctggacagtgacactgtctaaatcccagatttgcacagctcaagactggctgcatgggaggctggatggggctctcactccctactccaaaaaggtagaaaataggagacccctgtggacatgggacccccctgccacccttgtgcttgtaggagtctcaacaggcaggtgcgtagctttcaacgggtctgtcaagacgtgtgaggtggcggcctggtgcccggtggaggatgacacacacgtgccacagtgagtccagccctagggaaggaagtgccttttgttttgttttgttttagacacagtttcactctgtatcgccaggttggagtgcagtggtgctatcttggctcacgacaccctccacctccagtgttcaagtgattttctgtgccacagcctcccgagtagctgagattataggcacccaccaccacgcccaactaattttttgtatttttagtagagacggggttttgccatgttggccacgctggtctccaactcctgacctcaagtgatccacctgccttggcctcccaaagtgctaggattacaggcgggagccaccacacccagccagaagccaccacacccagccggaagcaccttcaactctgcgtgtcagccttgaacagaggtggtcaaggagttacacctgtgtgttgtggctttttgtgtgtttctggtgtctgtatgaagtcaggctgccctaggatggctgctctcaaccacaaggcagcgaccatcagtggcaagatgggccacaagtagtctgtcactcacgagaagggtgcaggtgactgacttccttgtatgttaggactctgtcagttgcaaataactgacaggaaacagttctcagtgccttaagcacatgtgcacaaacacatacacacatacacatgcgtgcacagcgggggggcagtgtattgtccggctgaccaaaaagatccagcgtggccaggagaatctcgtgccaggctgaggcagaagaatctcttgaacctgggaggaggaggttgctgagctgagatggtgccactgcactccctcctgggcgacagaggccactgcactcctgcctgggcgacagagtgagagacaaaggacaacaccctagtctcccttcctggctctgcatcccgccgtgccagcttcactcgcaggacccacagcatagcccgggaggcagcgctgcacttacagccccccaagtctgagtctccctttccagctgtccctggagattctagacctgtccatcatcgtatcaatggccatatctctcaacccatctctgtggctggggaatgggttttgcttatcagcttgggcctgggtcacatgcccacctctgcagctggggctagagtcagacccacccaagtgacataggcaagcattggggagatatggcttccaaaggacatttggggttctgttaccagaaaagctgggagcagatgctgggaagaaaacaacggatgtttgctacagtgtattttaaactaaactagacaggttcatcctggcgcggtggctcatgctgtaatcctaacactttgggaggctgaggcagtcggatcatctgaggccaggagttcaagaccagcctggccaacatggagaaaccccgtctccactaaaaatacaaaaattagggttagggtggcgcttgtctgtaatcccagctacttgggaggctgaggtaggagaattgcttgaacccgggaagtggaggttgcagtgagctgagatcgctcttctgcactctagcttgggcgacagagagagactctgtctcaaaaaataaaaatttaaaaaaataaataaataaaaatttaaaaatcaactaaactagccaggttcaaggttgctctagaataacattcttcgtggttgtaattggctgtgcttcatggggtggagtccgggcagcgctctgagaagtgcgtgcagcctagggcctttctcaccgagagctcagaccgaggtctccatgagccccggggagcaggaagccactgaacctcatcctgggtgtgttgagacagaaggaaaggctgagaactgcagatttagagattgctaaggcaaaggaaggagatagaaaaagaaaaggaatcctagcatcttagagctggagaggatctcacagagctgtgctctccaacacaggagactctggccacgcgtggctattgaaaattgaaatatggctgggtccgaaaggagatgggctgtccataggaagtgcacttatcatcaaattggattttttttttttttttttgagacgaagtctcgctctgtcgcccaggctggagtacagtggcgtgatcttggctcaccacaacctctgcctcccgggttcaagtgattctcctgcctcagcctcctgagtagctgggattataggcaccccccaccacaccttgctaatttttgtatttttagtagagatgcaggtttcaccatgttggccaggctggtctcgaactcctgacctcaggttatccacctgcctcagcctcccaaagtgctgggattataggtgtgagccactgcacccagcccgattctgtttattatttatttattttttatttatttgtatttatttatttatttgagatggagtctcgctctgtcgcccaggctggagtgcagtggcgccatctctgttcactgcaagctccgcctcctgcgctcacgccattctcctgcctcagcctccccagtagctgggactacaggcgcccaccaccacacccagctaatttttttgtatttttagtagagagggggtttcactgtgttagccaggatggtctcgatctcctgacctcgtgatccacctgccttggcctcccaaagtgctgggattgcacgcgtgagtcaccacgcccggccctgaatatttattatgaaaaaaagaatgtataatatctcattgatttttgtatgttggttacatgttgaagtaatattttgggttactgtataaaattttacttgtttcttttactttgtagtgtggctattaggaaactttaagttggagtgtggcttgtagttgtgtctcataagatactttttttttgacacaggatcttgctctgtcacccagtgcagtgataacgatcatggctcactgcagcttcgaactcctggactcaagtgatcttcccgcctcatcctcctgtgtagctgggaccacaggggcgcaccaccatgcccagccaacttattttttgtagagacagggtctcaccatgttgcccaggctggtcttgaactcctgggctcaagcaacccacctgccttagcctcccaaagtgctgggattacagcgtgagccaccacacctggcctcacaatatacttttattggacatcactgttgcagatctaatgcggtgtaaaatgatttttaagtgcacactgatataagaaataacattggccaggcacagtggctcatgcctataatcccagcactttgggaggcagagacgggtggatcacttgaggccaggagttcaaaaccagcctggccaacatggtgaaaccccctctctactaaaaatataaaaattagccaggcgtggtggtgcgcacctgtaatcccactactcaggaggctgaggcacgagaattgcttgaacccgggagatagaagttgcagtgagccaagatcatgccactgcgctccagcccgggtgacagaataagaccctgtctcaaaaacagaacaaagactaaaacgttttggaactagacagaggtgatgattgcacaacattatgaatgtactaaatgccacagaattgtccagtttaaaatggttaattttatgttatgtgaatttcatctcaatttctctaaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagatcgcggcattgcactccagcctgagcaacaggagcaagactccatctcaaaaaaaaaaaaaacctgagagaagccccttggtcccagcctttctctgacagcagtggtgacaggctcagctctcctccgagtgcagccctgtcactgaccttgctcctgtctcagggctgggaagactgttgatgttgtcattccaaagatcccacctggatcaggggaacatcccccacagaagggttagccatacagtgccagattctccaggagaaattcaccaaagaaatggagtccccttggggacagattcaacttgtattgtcagccaggagctgacgtggcacttctgagaagaggccggcgcacctgctggcgggtgctttgtgcacttttcagacaggtcaggatccagcctgtaggcaaatttacttttgctttgacctgtaaaaccggatctgcccagccttcattctctccctggagaacgcctgcggccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcatgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggtggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaaaaatatatatatatatatatatacacacacacacacacagacacacacacacaatacatatatatatgtgtgtatatatatatatataacatggttatgtgagtatttgtatgtattttattaacagtaatgttatcattgtttttcagacctgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgctggcatctcggtgtcctggggcagatgtaagcgagtcccacaaacagtggcttgcaactacaggacttgattctctcacagttctcacagttctagaggccacaacctaaaatccaggcatcagcagggctgtgctcgctctgaaggctctggagagagtccttacttgtctctcctggcttctggtagcccacggtgttccttggcttgtggatgcatcactccagtctctgcctctcctgtcatgaggccttctgccttgtatgtgtctctgtgtcttttcttcttgtaaggatatcagtcactgaatttagggcccaccctactctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccatctctactaaaaaaaatacaaaaattagctgggcatggtggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgtaattgtgggatctgctgtccttttgaaccttctggctcactgagtaaagcagatatttgaatttttcttttctagcagttagatttgtgttattccatctctactgtcacacacttcttgtggaaacctcaagcttaggtcagagccctaaaacggaaagaactcaggacgcctatcccccaacctcgggcagcaccaggccctgcctgtgtctcccaggcctggcccatggcgtggaagttgtgggccagatagagcatggagctagggtgcgggccgaggctcctgatggatccctggagaacatggggcagcagatggtatgtcttgacggttcttcaccaaccatccatcccctgctcatgcgtgtgcgctctctcgcgtgctcgctctctctctctctcatatatgtatatgtatatatgtgtatatatatatatagccattatatatatagccattatatatatatatttttttttttttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattggccagggtggtctcgagctcctcacctcaagtgatccacctgcctcggcctcccaaagtgccggaattacaggtgtgagccaccgcacccagccatatatttttaaatggtcttactgagatgcaattcacatgccataccgttcacacatttgaagtgcagaattcatagttttcactatattcacagataagtgcaggcttcaccacagtcgattttagaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccatcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgagcgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaatccctgtctgttgtctcatagcatgtgctagaactttccttcctacccttttacgacaaccagtaaatccactattccggctcactgtgctcagaaaaggtccatgggatggtctgtttctggcacttatgcacattttcccctacttctttatttatttattttatttttgaggcagagtctcactctgtcgcccaggctggagcgcagtggtgcaatctcggctcattgcaacctctgcctcccgggttcaagcgattctcctgcctcagcctcccgagtagctgggattacaggtgcatgccaccatgcccggctaatttttgtatttttagtagagacagggtttcaccacattggccagccaggctggtctcgaactcctgacctcaaatgatccatctgccttagcctctcaaagtgattggattacaggtgtgcgccaccacacctggcctatttattttttttattacccaggctggagtgcagtggcgcaatcactgctcactgcagtctccacctcctgggcttaagcgatcctcctacctcagcctcccatagtgctgggattacaagcatgagccactgcacccagctgcctactttttaaagcctaataatttgtcattagcttgtcttcctgcacagttcacaggacactttttctctagtgacatcttacctgtgcctccattttgacataaaattacaattctatgctgtgggtaacacaatttttggtaacatggaagtggcttcctctcccttccctgtttgcttcccaaaagtctccaaccaaaagcagcagcacgcatacctagctccgcacaggttcgaaatgttcatgaagctatttccagctgcagcttcacaccaactaaatgtttgtgtttttttgtttttgagacagagtcttgccctattgcccaggctggagtgcagtggcatgatctcggctcactgcaacctctgcctcctgggttcaagcaattctcctgcctcagcctcccaagtagctgggattacaggcatctgccaccacacccagctaatttttgtatttttagtagagacagaggttcaccatgttggccaggctggtctggaactcctgacctcatgatccaccgcctcagcctcccaaagtgctgggattacaggcgtgagccactgcacccagccacacaccagctgaattctgcatcaggtattcagaatccccctagaggaagcagtttgcccttcgcctctgccatgaattcacttccaagtactgagaggaaccattattttacaaatactctgcttctgctggataaatggccaacctgggcttttcttgcttttggaaaaaaaaaaaaaagtttaccaactccctttattgaagctctggttcatgctgccttttaaaaaaaaatgcttgttgcctgtaatcccaggactttgggaggccaaggtggatcacttaagcgtaggcattcaagaccagcccagtcaacatggtgagaccctatctctacaaaaaattaaattagccgggtgtggcggtatatatctgtagtcccagctacttgggtggctgaggccggaggatcacttgagcccaggaggttgaggctgcagtgagctatgatggtgccactgtactccagcctgggcaccaaagtgagaccctgtctgaaaaaataaaaagtgcttgcttaggcacatgggtcaaatgaagctggaatgtttaggaatggtgatatgggctgaatgtgtctaccaaaattcacattttggaaacttcatccccaaggcaaccttattgggaggtgaagccttggggaggtgactgagtcaggattgcgctgccctcatgaatggggttggtgccctatacgagggctagagagggagctcatcccccgtctgccttgccactgtctgccacgcgaggacaagtgttcctccctccaaaggatgcggcaccaaggcaccctcttggaagcagagagcagccctcaccagataccaaacctgccagcaccttgatcttgaacttcctggcctccagaaatgtgagaaatcaattattgttctttataaattacccagtcttaggtccctgtaacagcagcacaaaacagacttaagggcaatgggtgtgtttatgatcttgctcgtcaaggagtgatggtcactggctgtcttccgaagtgggggagatgctgtttagcctcttttctaaaacaaatgtgaaagcaagccagtgttggggtgaggggcgggtgtgtttctagatgccatgaacaccagcaggaggctgggtgtggtgatgcgcgcctgtcatcccagcactttgggaggctgaggcaggaggattacttggtccaagagtttgagaccagcctgggcaacaggtagtgagacctcatccctacaaataatttaaaaattagccaggcatggtggtgcacatctgtagtcccagcaactcgggaggctgaggtgggaggactgcttgagtccaggagtttgagaccaggcctgggtaatatagtgagattctgtctctataaaaaatttaagaattatctgggtgtgggggctggtgtggtggtgggcccctgtggtcccagctactttggaacccaaagtggatggatcacttaagcctgagaggtggagattgcagtgagccgagactgccactgcactccaggctgggtgacagaacgagaccctgtctcaaaaaagaaaaccagaagggttttgctggcaaattctaacccttggacaactgacttaactttctggagcctcacctcacagacgatgatccataaaacgaggttaatccctacctcgtggggtaaagtgtcatgtggcataccaggccatagttcagtgtgactgagactgctcgggggctgcccacctgtctggcctccaccagaatcttgcaattacctgcctgcgaaagcagtgctgctcaaacttcagcacacggacgagtcacctggggagcaggtttaagccaagcctgggtatctgcatttatttttttcttttaatttttgaaacagggtctcgccctgttgcccaggctggtgtgcagtggcatgatcacagctcactgcagccttgacctccagggttcacgtaatccccccacctcagcctcctgagtagctgtgggaccataggcatgcaccaccacactcaattaattttttaatttttttttttttttttaagagatggggtcttgccatgttgtccaggctggtctcaaactcctaggctcaagcaatcctcccaccttggcctcccaaagtgctgggattgcaggtgtgagccaccgtgcccggccggcacctgcgtttctaacccactcacaggtgacactggcgctactggtctgggagccacactgagtagcaaggtcctaggacatgctctaaattagagatttgctgaatacattagccttgacttgggcatctgacctcgctgtcagcctgaggaaggaatacagacatcagggcaggcggcctaaataaacaatcaccaatacaaacctccccaagaggcccaggcttggcaccattttgctgtctgtttatttcaactgtacagagaagcttaaacacctgtggaaaaacacgaaaggcttagttgtctcttaagttcatgtactttttagtgataaatacacagtatttaactttatacacctgataaaaggaaaatgcatagtagaaagggtcgggaatgaaacagaagcatcgggcattgaatcgatcacagagtagaaaaatctgcagtccccagaaactcggcctccagctggagaggggaaccagcgtaccctgaaacttccctagcaccttggaagcaagtggaggtcatggttcttccactcggcaacgtgaagctccccgctggaagacaagtgagagcgacaggccaggcctgtgtgtccacctgcacaggcattctccttgttccagaaaggctctgaggacggaagacctgcctctcaggaaaggccagaccagtagggagaggcctccgcagccccaagtgtcaacaaggggctcaataaggctttctgggagccactggcagctggtgggatggaagggggaggtggaaaagggcagaggaaatgggaagtggatggagggtttgtgcttccttcgaggccacaagtgcaggccacaggttgcttacaccaaattggtcccacagatgagctagcaatggaagaaattatgggcgtcctctttgcccactggaagagctgctcataacagcacctcctttcctgacagagctggcttttgaaaaatcaatgtgctccaagagtggcagctcaaatgctctgtgtttacagccatcttggcttatccttttcatgtggggcaggtcctttccacagctttctttggtgtttcttcattaaaagaaaaaaaaaaagtcatcaatgtgggtctcccccaccccactgcccccacagctgggtgctgcctgattgctggcattccctggaagaaatcttagatggaaggttccgtggtggggagaaatggcattgtctgatgcagctgtgtaaacaagagaagccctgcagaagctctaagcactgctgccccctgggccagccaccaggccaggccagagcccacacaagcaggctgggcctaagactagggacccgctggctttaacctctgcaaggtgcttattgcaaactaaccaagccccatctggtgccagaaggggtggagctattgagtcctctccccataaacataaagccaggagggcaagaggaagtgctgggttacaaagacccagcaagcaggccagacgaccctctctagactacctgtcctttgctcttcaaaaccagcattccctaattctgaactgcttataagatagcaaaacaagtctggctaaactacagtcaagagcttaggatctatggaagccaagaaggcccagggctccatgaatgggctgggcaggggcacgaggccttgcctttgtctgagaagtcctcacaccacagctgatcagatggaaacaatggggaagcagagtttcccggtgccgtctttccccagcccagattccaccaagcgctggaaagcagagctgggaatctcccaaggcagagtccttccagctttcctccccctcaacttcacactcccctacctgtggctctggaaggagtcacacttgaacctcaaccaaacttcccaatatcagttggaagtcaaaaagatgaaccctttctttctggacttttagctacaaaggggaacttcctgtgccaagccctggtttcctcataccccaacgagtgctgtgggtttcaacagtcttctctaaaagggtgccccaaggttattgtgtggagtctagggaagctcagatcctcaggatgatcatttgtgtgttggtccagtgaaagcatttcccacctggccctccagaaactgggtatttcattgaccacaacaatcagctaggatttaaaatgaaaacaaaaccttagcagtctttagaatatacaggttatgaactagctaagctgctaatatatatacaggcgggcataggtttcatcggctctaactgatcacatgcctgaagctgtgaaatatatcctggaagctctaaatagtttctgaactactgtgctctagagttcactctagttagagacttgaaaaatgtttttgtttaatcttaagccatgtaatgtacatggaagcataggatttcaccctgaagttttcgtaatttgacaaagagatttaccagagctcggtcagctatctcagaaacctgctttgagcagctgtcatgaagaaacacgttcagtctttcaggagaaatgtttccccaccacagctgctgaatacccttccaggcttggaaaatccccttccagcagcacttattaaatttcaagccctttctgttttcctgactacaattctacccataaaaaatttaaaaatccttcttacaaataagttgcatcaaagctccctgcagctactgagggccagccctgctctgactccttgagaccacggctctggaaggtgccatggtttccggtttgcactaggagccacatctagccccctactccctctcaaatgcagcaaccacctccatggcctcagaccgccggagttttctgctcgcctttccacagttgtcaaaccccacacacagtcacttggtatatctgacgtggttctgaaaatcacaatgaaggatttttggcataaaaacgttttaaaaagcaattgtcccaaaatgcacgtgggtttgggtctgcaactcctcacacccgcctgtccagccagccagcggccacggtcgacgtcatggagtcaagtcctttttttttttttgtcccctttaaaacaacaaaggaaaaaacaaataaccagagatgacgatcgaggctctacacacgtgctgggtttccgtaggacatgctgctatggaaacgcggtgcagcagccccccagaggcgacgcggcgcgcatgcgaggtcgagcgatccaggcagctactcgggctccatggcctcctccggccgcagtggatgcatgcgtgcgggggagccgggggcgggggcccagcaactttccacgcagggactgcctctcacaagagcacttcctcctcccccacggggggcgggtcggtgccctggaggttgtcttcgctgccttgcttcctgctcaccgaacagaaaaccaacattaagactctgagaaatgccagcgaggccctgagccagctgctcccacatctgggccccctgcccaagtgggccgtcgcgcaccccctggaacgtgatctacgtaacccagtctttgagatcctctccccttttccttgctcacataaatttttcaaaggagactttgcacgcagcccctctgtaaatgaaagaccagcatcatttgccaaaaatagcaaggacccgtacaacagttccaaaactatgtaacaccaaaattcactgcacaaatcccaagtagaaggcaccccccaccccacggcgcctgtcataccaggtttttaggtacttcgatcccccacttaggctatgagcccttacagggaagggactgtgacgcttgtcctcagtcaccagatgttgagttccttgtgtgtgggggtgatcagagcctcccctgcctggcctggcacacagctggccctcaagaaagggcagatgacaactgctccagggatcctcccgcctcagccctcctgcagccagccctgagggaggagcacctcagacagaagaggaggccccttccctcttggaagtgggaggaggagagcccttgtttccctgaagagcccaggctggagccgccggtgtgacagcgtggatggcgtgacaggtgcgaggggaatccccgagcctatcccctcaccaccatcacacagctcccctgttcttagggaggtcactgggcatgccacatgggttactgtctgtccttcccccacaacaatccgtgtctcctgtccaggagggagactgtccttacacaagggaaaggaagcgtgatgtctggcttgctatgtttctgatggagaatgtgggtaaggtccctggggaggggggcgctgtaactagacgttaggtcaggccctcagtctctgccctcgcagttgcctgttggtaggggttgggtcttactgcagacggcaggcaggcccccagtccaagacccccagtgcctgaatcagctctgtgagctcccatgaccaaggcatcctacctgctgggggctgagggcaggggatcccaggtgaagaaaggaaggggcagcatagccctttggggccagtctccatctgctggtgtcttgcaattttgatctcattgaaacgaaggccgggcacagtggctcatgcctgtaatcccagtactttgggaggctgaggcaggcagatcacccgaggtcaggagttcaagaccagcctggccaacatggtgaaacccccatctctactaaaaaaatacaaaaattagctgggcatggtggcacatgtctgtaaacccagctactcaggaagctgaggcaggagaatcgcttgagcctaggaggcagaggttgcagtgagccgagatcacaccactacactccaacactccaacctgggcaacagtgcaagaccctgtctcaaaaaaaaaaaagaaagaaagaaagaaagaaagaaaataggaaagaaaccaacagcagacttgctcagagacaggaggcagccccggtttggcaaaccctaaaatggagattgagaggaggaaggccgaggaaaggccagcccgctgggtttccactccatcatccgtgaggctcacacccaaggcggggctgcccaggcgtctgtctgggcacaagctggggactgtgtctgccttctgagactgctgaagaccggttctgaaggactgccattttccctgctctatgctggagggcaaggtttctctcaaaagcataaataattcccaaacaggtgttcctcctagattaccatataagccctgactcccacgggatgggtggccaatccatttctttttcttttcttttttttttgagacggagtctcgctctgtcgcccaggctggagtgctgtggcgcaatctcggctcactgcaagctccgcctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtcattcgcctgccttggcctcccaaagcgctgggattacaggcgtgagccaccgcgcccagcctttttttttgagacagatttttgctcttgttgcccaggctggagtgcaatgacgtgatctcagctcaccgcaacctccacctcctgggttcaagtgattctcctgcctcacctcccgagtagctgggactacaagtgtgcgccaccatgcccggctaatatttgtatttttagtagagacggggtttcaccatattggccaggctggtctcaaactcctgacctcatgatccacctgcctcggcctcccaaagtgctgggattacaggcgtgagccactgcatccagcctgctagtcaatccatttcatctcgtaagccaactcctaacactttgtacacaaatgttcatagcatcagtcttcattcgatagccaaaaggtggagacaagtccatccacagaggaatggatgaacaaagtgaggtgcatccaaacaatggaatcttatttggccatgaaaaggaatgaagcactaatacatgtagagcatggatgaaccttgaaaacatgatgctgagagaaagaagccagacacagaaggccacgtagtgtatgacgccatttatacgaaacgtccagaataggcaaatccatacctattctgagtggttactggggtgggggagttggatggggacagctaaggagtgtagggtgtcttcttgggctgatgaaaatgtcgtaaagttgacggtggtaatggctgcagaagtctgtattagaaaccactgaatcatacacttcccgtgggtgaattacatggtatgtgaattgtacctcagtaaagctatgtttaagaaacagaagtgactgcctggagctcccaccaagtcaggtagccatgatgtgctcagtgggaagggcagtggggtccccacccaccacagcacctgcagcaggggtgcccagcaggttctcccagtctcataaggacacaaagcctcatctgtcctgggaggttctggtcacctgggctggctatgtgtatgaaggaagggtggctgacagcaagaaggtctgcatccactcgggtgagggaactcttacgttactttgcaacaggcaggaaggggacttattttctaggtctaaacacatcaaagaaagagaagtggaggctggagagcccctagcgaagagccacacagtgcagcatgcctgacctatgtgctgaccatgcggactcgggggggcacccatgggccctgtgacagagcttcaacaccattgacgtgcactgagaagacatgggtgccacacaggatcttcagacctgggtgcattctcaggcattccagctggagcgccatgcacccgcagccccagcccacatgcatgacccaccattgggtccaagcccccgaggcccctcattctaatactgggtctggaggcccgcggtgagccgggccacagcagcccaggctggaaggagcatctgcccgggtggggatgcccccgtgctctgcagctgcccacccgcccccctcaggccccagcagaggctacggcacaggcaggcgggcgttaccttgagctcagacagggactcacattccctggttggttttttgctggaatcaccagagggagggaaaagggaagtgagaagggacccttgggatccacgggatgcccgttcccccaccctgagacactcagaccccaaacaccagcttcatagagctggagccagggtggcgttgacagcagatgagtggacacctctctgcatggacacacagggtcctgagtgagaccacactgctcgcccagcacagagcctcaaacctccccatcaggcactcacggtcccgggccacaaaagtgcttttcttctgactgaccaagagccccccagctacagtgcaagttcccgagaaaggtaaacttcaggtggattagctgtcagcaaaaggaggtgggctgagcccaggttggggtgctgactgtcccagtgcaccaggtgggtttcatctgagtctctccagatggcaccacttcagggaggacctgtgcagagtggtctgggcagggctgccccaagcctagcctccagccaccactcccccacccaagaaggcaggcggccactcacgtgagcaagtttccaggcgctgacagtgagcgttcctcccgccggctgccctcgaatgggttcccaaaggagcgtttacgtatcatggtcttcaccaggatctgaagagggagaaaagaggaggtggcaggcaactgcttggccatgtgggggcgattctgggcaacatcctccctcttccttctccccagcccctgccagctcccagggctggtgaccgatggcagactttgagagaaactgggcagcaccaccccgcaaccaacccccgccgaaagaatcctctgggaaaaggtgctgtcctgcaccacaccctcagccactgctcagcgtctctcccaggcctccctgctttccacctccctccctcccatcccttccaaaacccagatctggtcccctcactccctgactcagcatccccacccagaggggtctggaacttggcctgtggtcagccagagagccccggaaagttctggagcaaggacgtgaaccagtcattcttggtgatgctcttggctgccatttcccatgaagggaatggcctgagggccccataagagtcactgggcccctcaccccaccccaaccagggcacggtgccccttcaagctgttttgggaattcacagagcttctgactttttaagcatttgctgctaacaagaaaaataagtgtttaagaaacactgatttaccaaaagatgcaaacacccaaatgcccatcaactgaagaagataaactcaaagcggtctgtctgtgcaatggaacatgattcagccataaggagtgaagcactgatccatgctacaacacaaacggaccctgaaaaccttctcctacgtcaaagtagccaggcccgaaaggcctcagagtgtaggattccaccagaatacacaaatctatagacacagagggcaggtgagtgggtgccagggctggggggaggtgaatggagagtcattgctgatgggcgggggtgtgaagtaatgaaaatgttcagaactattgaggagataattgcatgtcactgtgaatgtcccaaatgtcactgaattgttcactttaattttatgttatgtgaattctacctcaatttaaaagaaggagcggggggggggaggcgggcgtggtggctcatgcttgtaataccagcactttgggaggctgaggcaggtggatcacctgaggtcaggagtttgagaccagcctggccagcatggagaaaccgcgtctccactaaaaatacaaaaattagctgggcatggtggtaggcacctgtcatcccagctacatgggaggctgaggcagaagaattgcttgaacctgggaggcggaggttgcagtgagccaagaccacaccactgcactccagcctgggcaacgagagcaaaactccatctcaaaaaaaaaagagagagagaatgaaggcctcttcccctactgaggttcttacagtcactgggacatgccagcccctctttcctctgtgtctgagcagatgtcactccccaggtgagcccaccctgccgcctcccctgtggccttgtcaacccagagcaggagctcctcctctgtgaagcccccagcccttgcatctctctgcactggcctctgatcacacaggaggctgattcttcccaggtccatctttcttataaggccaggagcccctcccccagccccccagccccctacccctgagagcaggcactgggctaagctcatctttgacacctatgcctggcacacactggctgctccgtgtttgctaaatgatgaacacatgcagggggcctggaccttgccatcttgtcccaagtcagaccacttcccagtatctacccgcccatccctgctccagctgccctggttcaaaccctgattcaaacccatgctcttggagtaaacatgtaaaacctcgccacaccctccctccaccttccttgccctgcttcagtggccccacccagtgtgttagcccgtccgccctctctcggcggagttaacaccctaccatcctctcggtgtctatccacttcttcccagtgggtccaagtgtgcctccattaggggcatgtcctgtggtccctctactgcactgtacatacatttgttggtttgaccagcatctgcctctcaagcatggcagaggccatgggggttttgttcatcactccacccagcccctgctcccagcacaggcctgagaaaccactcggtgttcaacaagtgtttcccgtataatgaatgcctactccagacctccagggccagacgctttctcccaagaacccgtcccagagacccaggaaggaaagggagggcaactgattcaggactgagaacctcctgagcctggaacacagtaacccacggtgggtgcagagtccgacgccagctgtctcctcgtctacaggcacaaggggtggttgaggaagggtgagtgggtgtgggtgggtcttcaacagtgaaggtcctgcacagccccaggtggggaaagagtggaggaagatgtggatggatgccccagccagggctcagctttgggaggaggagagaggaagtgtgtggggaagcagagaagagaggtgcaaagctggaggagcaggagcagcatctgggctcctacaggggcaatccttcacagctggaccttctgtgcctttccagccagtctcaagggtccctcccagagcccaggggcccgccggcccactgggactagtgctggccaactgcaaccaggcctttcgaggtggctgtggtgggacaacctgctggtctctgtccccaagcctgctgcctggaacctggatccctgggactcttggtctctctcttggagctaactgccctcctggacagggacttggtcagtggcgattcccagagcctccaaggttaggcctgaggactctacattctggctccttcttcctgggtcaggatccaaattcaaggccataaaaggggacctacttgctcctaagcaattctcactctcaggagatgggcagaactttctgagtgtgtgcgtggaagtccctgcccctacccctggtggctgcccacacagcagacgtgagatatgctacgccatccaccctggagcctaaaattccagctaggcgggaatcctggcttagagacctgggctccggctcccaacccttgcccctgcctggaacttctcctagttcctctcccctgatgagctctgaaagcaggaattccagaaggataatcttccccttcctatggtaacatggaacctggctcagaagatgcaggggtcacctggcctgatacatgaccaaggcccagaggccagcagctgtggattaggggtggcccccggacatctgactcccgggcacccgcctgtgtccggcctgtcctggccaggccccacctcaggctcctgggtccctgctctgggtcaggggtccatccaccttaccacggttgccaagctgggaatgtgtttgactgagttctcgacctcctcttcagtcacttcgaccagcgtgcagttctcatcctccgacggcaacggctccgccccatgcctcgtgacccaggggtgcagcttcaacgaacgacaggaggggtgaggggcaggtgtggctggctaccggggggccctgccagcgagcggagccacaagggcatgcaggacggagaggcaagggcctgtggtcaggcatgcaaaacagctggcgagcagagggcaggggtgagcaaaggggcggaaacatgaagacggagagacaggacgggaggagctacaaggctgaaatggaagtggggcgattctccatccggccccgggtcttggccgaagtgatgggaatttggcatctgccttgcctggctgcccaaggagcatccatcactcctcagccacaatccctgacacctgggaggctcagtgcacagcaggcagcattctccccatctcacagcaggagaggcttggaggcatggtgggaccagctggcaggacaggatcaggagaggacccaggcaggggtctgcccccttgggtccaagccccaatccatgattttttgggctgccttctgttaagaccttcaaatgccagttagctagctgcctaggaagtcccagggcaaatctctagatttcctagagggccagatatatgtgtgtggcattagtggagatgtgtaggggaatacactttcctaaaagtgctttctgcaagagggtgggattcagcaggctggggaggtcgaattgctcattaatttcctcccatcctcactgcagtttctcaaagggacgggcctttggaaaggacctgagctctgggaatagggtgtggagcacggaggccccatgccggtctgcagagggtggatcccatcagcccacgccaatcagagcaagtgcaggctggcgggtcatagatcccactcccacagtcacagtgcacacaatgcccaaatcttcctacccagccctcaacagcccccagcagctcagaggccctggggcataggagaacagcggtgccaaggagggtgtggtgctgtggacacaagggtgtggggtctggctgaggcatggctgagccaaacaattccgagcacggggcacaggctgagccaagggtaccttgatttccggcaccacgatcctcgactcggggttcttgtccagcatacgggtgatcaggtccttcaagtcctcagctatgtcgggcctggggatggagaggcgtcagggtggcagacacgggaccgccaagaactcggacaggagagatgcgggacggcgggagatactcactggtctggaaattccagggcctgactcttgatcttactgtgtaaacacatgatccgctcgtccatgaatgggcactgcaaagaggccagggacagagtggcagtcaatggcggccacatctgcccttcgagggccacctgtgctgtgccactccacataggatacagcagagaaatcaacaattgcggcccaggctagggggcaagcagttcccattctccccgagaatggccaagacacaggggtgtggggcctggccgacgcagggcagagccaggaatggccctctcgaagggctagagcctttcccaagcacactgcaggctccctctgtagctgggcctcagtttacctacttacaccaaagcaaacactgctcgtcacctacttgccaggtgaacaacaggaacaacaagaataacacaaaagactttgtgttatttgtggcagcagcagtgattttcaagggcttagcctggatcgcgccacgccctgccctgaggttttcattcactgttccccgtccctggaatgttcttctcaccaacatctacgtggcttggtctctcccaccatgcaggtgtctgactaaagctcaccttctcagggaggacttcctgaagccctgtctaaaacagacaacccccaatgccgccaccgcccacatcactcctcatcgtagcacttatccctgacgttatcgtacagatttgtttattgtttaacccctcccacgggaacgttagctccaagaaggcagggatttctggctgtcttgctcactgcggactctccgtgcctaggagcgttcctgcacaaagtaagggctcaataaatatctgctgaattaatggatacttgaattatttctgtcaatcctctcagaagtcatcagaaataataagtagtattctcattttacagaagagaaaaacagaagttcagagaaataatgtgtcccaggaagtacgaagagggatttaagcctagattcagctgactctgaagcctatttttgcaccaccttctgggtgacaaatcgatgctttcacccagctgagggcctgactcaagagcagcttggtcatgtgtgctggaaaaggaatccttacacgggacactgaaaatgttggagaaggtggcagagaggtacctgaaccacccgtctaaggaaaacgatttcattaagagcagtgacttgagctctacctaatcactgccttctaaggcatttggaaggaagagtggagatggtggtaacttactctgaaatacattaagaaaccagatggactgagggatgggtaaggaatgaacagacaagcacaggaaaaggttaatatagtagaatccaggtggtgggtatgtgggtgttcactggacacttcttccagctttgctacatgattgaaaaattttctaatcaaatattgagaggcaatcggtataaactcctttacttcttcatgggaccagtttcttaggctttcctcaataagaacacaagctcaggaaagggaaaaatctacgtttttattgctcacataatcaaactgaacttcagagttaaaacgagaaggccaggcgtggtggctcacacctgtaatcccaaatcccagcactctgggaggcccaggctggcagatcatttgaggtcaggagtttgaaaccagtctggccaacatggcaaaacactatctctacaaaaatacaaaaattagccgggtgtggtggctggcatctgtagtcccagctactcaggaggctgaggcaggagaatggcttgaacccgggaggcggaggttgcagtgagccgagatcgcaccactacactccagcctgggtgacagagcaagactccatctcaaaaaaaaaaaaaaaaaaaatagagagagaagcccccagatatcaataataacaaaataacaacaacagaaaagcccaaacagcactccctaaatcaataatggtaaacagcttttaacttccattccaatgctacccctctgacaaaagcttctaggaataccctgacggaaagaacatcagagcagtatcaggctcaggaggaacgagcacagttattgattagtgatgtctgccttgggctcagaaatgggagaggtggcagaactgctgtccttgccctaaatttatcaactatttataaactctagagcctctgccaatccttctgttttaacagatcattttttcatagatatgatcatgacatacatacacatgtatatttaggaaggcatcctttttcacattgagatctaggtgtagaaataaaataactcttctcttattttattttttgagacggagtctcgctcttgttgcccaggctggaatacaatggtgcaatctcagctcactgcaagctccgcctcctgggttcaggcgattctcctgcttcagcctccagagtagctgggactataggcatgcgccatcacgcctggctaattttttgtatttttagtaaagacggggtttcaccatgttggccaagctggtctccaactcctaacctctgcctcagcctcccaaagtgctgggtttacaggcgtgagccaccatgcccagcctaaaataactcttaaataagtaagtactgtctccccgcaagggtgactattaacccaggggccacccagcagtactgaggggacagacaccccgccctcttacctggccaaagacaaagcagtatagtgtcacacccatggcccaaacatccaaggcctgcaagaaaaagagcttagtgtgagggcataaggggtggtccagcctccaatcctccagttttcctttggggaaccacctcttgactttcagcccttggagttggggcgggaccaatcttgtctcctaggctctggggcaggcacaggatccaggccaggccaatgagagcaccactacccccagccacagtgattggttcaagcatgggcacatgacccatgttgggccaatcagagccaaccccagggttttcacaggcactattcagaatgaggaatgctcttgccactgaggttggcaaatgatagaaagtaacctggtccctgggtgcctgacccacctgtggaggaaaccaaataagaaaaacaactgaaagatggcgggagatggtttctgtttgagtccctggatctagccaagcctgaagcctacccctcagtatcttgatccaggggattcactgtttaagcctgtgtgcgttgggtttctgctgcttacaatccagaagacactaacacaggcagaactctgtggctgaggcaggcccaagcttaccttcccagagaagatcttgcgggtctcagagagcgactcgggtgccatgaaggcgggcgtgcccacggtgttggagaggagcgcgtcactgcccttgaattcattgctcacaccaaagtcagcgatcttgatgtgcccatcttctccgaccaggaggttggaaggtttgatgtcacggtggatgatcttctggtagtgtactggggaggcgtagacagcaggtgggagataggggcaggaaaacctcgtgagcacctctatgcggccacatggcctggagacacaggcatggcacccctctgatgccttgtctcccacagccccaggccttttccaaccttccactccccaaacccgctgggcactgacatgctctaaaagatgaggggaaaagtgtcttcaaggaagtcccagcccaccatcaccccaccccttctcaacaatgacacataaaacactgccaatagcaattcgtaatcgcctgttatttattaagtcacaagtgacagtgcatggaaagtttttgctgggcttggctcacagctagttgtgaaactgacagtgaaacatagtttcatttaccaacagccaatactcaactgatttaccaaaccgacaatgacctgagcaggccgatttgaaatgtgaaccacacacagaactcggggcttggctaactcctcctggctggatatcagcccatggtacaggacagttctatggcctggaagacccaactgccatttctggggtgatgatgatgatgaagacgatttcagtgaaagcagcagcagagcaccaagtgaggggcccggccctgcgttgtgtttcacattcacattttacatttaattaaacctcacaaccatcctatgtgacaggcagggataagagataacgtggtggccgggcacggtggctcacgcctgtcatcccagcactttgggaggcaaggcagggggatcacctgaggtcaggagttcaagaccagcctggccaacatagcgaaaccccatctctacaaaaaatacaaaaattagccgggcatggtggcgtacacctgtagtcccagctacttgggaggctgaggcatgagaattgcttgaacccaggaggcagaggttgcagtgacctgagatcgcgccactgcactccagcccaggcaacagggcaagaatctcaaaggaaaaaaagagctaagatgtttaacaagcagaagcagaaaggacacctgccaatcaaaccactgatgtgtactggctgatctcagccctggtgagagatatgttatccccattttacagatgaggaagctaaggttccaggaggtgaacaggaccctgatcccagggtcactgggaggaataagagacaaaaaaaatagagccccaaacagtgcctggtgcacatagaaagtgctaaatagtcactattgctactgctcttcattttgccaagtggcaggaagaagggttttggctcgcctggaccatggccatagggtggctctctgcagctggccctgattctgcatttcacacaattctgtttcccactatgatggttgatactgagtgtcaacttgattggactgaaggatacaaagtattaatcctggatgtgtctgtgtgggtgttgccaaaggagattaacatttgagtcagtgggctggggaaggcagacccacaatctaatcagctgccagcgaatataaagcaggcagaaaaacgtgaaaggtgagactggcctagcctcccagcctatgtttttttcctatctggatgcttcctgccctcaaacgtcagactccacgttctttagttttgagagttagatgggctctccttgctcctcaagcttgcagacagactatattgtgggaccttgtgatcgtgtaagttaatacttaataaactcccctttatatatataattatatatataattttatatatatataattttatatatatataattatatatataattttatatatatataattatatatataattatatatataattttatatataattttatatatatataattatatataattttatatatataattatatatataattttatatatataattttatatatatatatatatgtatctcctattagttctgtccctctagaggaccccaatccacccgcccacctccctgtgctccaggaagaaaataagacactttccactttgcacccacgctcagaatgctaactacccactgggtgagagccctcccgcaggccctgctcacagtactcgatgcctttgatcagatcctggaagtagaaacgggcctggtcttcagagagtggtttgagggtgggcacttccatcacgggcctgaaaggtcgacactcatgtgaaacacaaagcagacccgccagcccttgccctctctcatgagcagagcccagtggcacctcactcagctatgcagctacagaagcttcttgcatcacccctgctgggagctgggacactcacccttggttgaccagttcgaacactgtagggaagaaaagggtgaaactgttacatgggaaactgaacatccatctctctctgtcctccccacctcccaaccacctccagaaacaccaagaaagacagaaactagtattagagctggggagaggaacagtccactgaaccaagctggccaaggtcctgctttgctaaatttccatcagaaggcaaagaaccagggatttctgacgtccccaggcccacagtctggcttgacttctagtgctcaaattggcccaggatccactggtcaaagaaaacacggcagggggctgggcacggtggctcacgccagtgtaatcccaacactctgggaggccgaggtgggcgaatcacctgaggtcaagagctcgagaccagcctggccaacgtggcaaaaccctatctctactaaaaatacaaaaatcagccgggcgtggtggcaggtgcctgtaatcccagctacttgggaggctgaggcacaagaatcacttgaacctggacagcggaggttgcagtgagccaagattgcacccctgcactctagcctgggcaacagagcaagaatgtcccaaaaaaaaaatttctttgagatgaaatttacgtaacataaaattacccattttaaagcgtgcaattgagtggcatttagtatattcacaattttgggcaatcatcacaactatctagttccagaacattctcatcacctcaaaagaaaacctcatacccattagcagtcactccctattcttccctccctcaatcccctggccaccaccaatctgtttcctgtctctatagatttgcctgttctggacatttcatataaatggaattgtacactatgtggccttttgtgtctggcttctttcacttagcatcattagcacgtttttaaggttcatccacactggtgcatggatcagtgcttcattccctttaatggctgaataatattccattgtatggatagaccacattttctttgtccattcatctgttgaggggcatatggactgtttctactctttggctgttgggaagtgctgcaatgaacgttcgtgtacatggatatgttcatgtgtggatatctgtttttggttcttttgggtatatacctaggagtggaatttctgggtcacgtggtatagttatttaatttgattctgctatgacaagcataaattggaatacaaggctgtactttaggaagttaaaaaaaaaaagagcacagtcgatttcaaaatccagtggaggatgactctggggttgcttgttgttctggaatcatacacccacaatgagatgagcatgtaatagaaaccagaggggataccccattttccatgatgggattattatgcactgcatgccggtattaaaacatctcatgtaacctatgactatatccacctaccatgtacccacaaaaattaaaaaaactttttttttttttttgaaatggagtcttgctctgttgcccaggctggagtgcagtggcacgatcttggctcactgcaacctctgcctcctgggttcaagcgattcttctgcctcagcctcccgagtagctgggactacaggcacctgccaccacacccggctaattttttgtatttttagtaaagatggggtttcaccgtattggtcaggctggtctcgaacttctgacatcaggtgatccacccacctcggcctcccaaagtgctggggttacaggcaaaaaaattttttaaaaatgaaaccaaagggttgtttcaaagctctccaagggctgaggtggccaaggggaacagggaagctactcagacaaaaagaaggcttaaaggttctgatcaggaaaagaactgaactctcccaggccttccccatcttcagtttcatcaaccagtgtgagttagggcagatttgctattgcttcaggctgtagttaaaaacaaaggcaatgctgctaaggtacagcttctacagacaacccagcgctggccccctcagctctggcctttcctgccttggttatttaagtcttcacttgcaagcttcatgaatttctgcaccatcctcccacccacccaagcaccataaatcaggtggcatgagggagggtggcctgttgaaacaggtctattttcagtcgctaacagttcaaccacttttggggctgagcagtgggtgggaattttttaacctctagaaatagagatcgagttttctacttttttttttttttttttttgagacaaagtctagctctgtcacccagactggagtgcaatggcacgatctcggttcactgcaacctccgcttcccaggttgaagtgattctcctgcttcaccctcccaagtagctgagattacaggcatgtgccaccacatctggctaattttgtatttttagcagaaacatggtttcaccatgttggttaggttggtctcgaactcctgacctcaggggatccacctgccttggcctcccaaagtgctgagattacaggcatgagccaccacacccagccccctcctccacctttttttgttttattgagacagggtcttactctgtcgcccaggctagagtgcagtggcacaatcatagctcactgcagcctcaaactcctggcctcaagcaatcctcccacctcagcctcccaagtgctggggttacaggcatgagccaccgcacctggactgagttttctgccctttgcatgtcaggcctgtagctgcagaccctttctgatacctactacccggcctcatgcactgccctgtctgtctcagtctcacacggctgtggctggaaagtaaaatataaccgtgtcaggattttcaaaaccactggaatcacataccccaaattagcatggctttctgcaactgccacctcgagttgtgaaaaactatccctgcagctgcccagctcaagcagatcacgaaactcttctttgaggcttggaccatgttctctttattctcattccacccgtcagctcaaaccccccaatggcttccatcactctcagagtcaaagccaattttttttttttttttttttgagacagtctcactttgttgcccaggctggaatgcagtggcgccatcttggctcactgcaacctccgcctctcaggttcaagtgattctcgtgcctcagcctcccgagtagccaagattataggtgcacacccccatgcccagctaatttttgtatttttagtagagacggggtttcgctatgctgcccaggctggtctcaaactcctgagctcaggtgatccacccgctcggactcccaaagcgctgggattacaggggtgagccactgtgcccgatccaagttctttacaatgttgtaaaataccttctgccacctggtccctgctgttctgcccaaatgtcaccttggtgagacattccctggggagccactgtatttctccatcccccaacccaaaactagcagcccctcgtgtcctgctcggggtttttgttttgttacggtgttgtcgctttcaaaacccacgcatcacactcaggtgcgctccccaaggacaggggtttttgaatgttgtccctgatgaacctacagcagggtctgacaaattgtaacatttgttgaatgaacaaaggcacgcctcagaaagagctcaaagccattctgacctggatctggggtcccaagtgagagaattacgctaagaatgccattctgggctaaaatgacttttggcatattgtgatttctgctgtatctccccaaacttcatttatttgcctactatgtttataatctggccatacctatatgccacatcaattatttattgaatgtttttctttaaattgactcagtttttaattttttagccttgtcctagatgataatatccatgaaactatgagtttggggtgctggttatagtttttcctatacaatgttaaattaaatataaaattgtttttctaccttttttctgtgtaccacctagaacagtgcccaccatataggaggttgtcaatatatacatgctttgggaggccaatgcaggaggatctcttgggcccaggcatttgaggccaggctggacaacatagtgacactttgtctctagaaaaattttaaaaattagctgggtatggtggcccatgcctataatccagctactcaggaggctgaggtgggaggatcacttgagcctgggagatcaaggctgcagtgagctgtggtcacaccactgaactgtaagcctgggcaacggagcaagaccctgactcaaaaaaaataaatacatgcaaatgaatgaataggatcagataaagttccagcaagaactcccttccacctgctgatcccaaccaggggtgtggcctccggtggggccagctggaccaggaaagggaaagctgtctttggtggaaggtgccagggcacaggctgcctcgagaggacccctgggcattggcaggtgtggtgcctgggtgagggtggcagaagaaaagggcttccttacccatgtacagatggtcctcattggggtcatccaggaccttggcacagccacatggaataggcaggagacggatggcgggggagaaaaagagagaatagatatgagcagggaggaggcagcatccacgtggctgcgtttgccaacaggagggctgcatttggcagcgtgtttcccagttaagatggaagatagggaaaacccccagagtgtgagatcctaatggctattcggaaaataaatgcctctctgtctgatcctcgaggatctgaacactcaggaggtcgcaaaagggaggggccaaaatactcccctggaaatatctcatgcttgaataagaatccagcctatctccggctgggcgcagtggctcatgcctgaaatcccagcactttgggaggccgaggcgggcggatcacctgaggtcgggagttcaataccagcctgaccaacatggagaaaccccatctctactaaaaatacaaaattagtccggtgtggtggtgcatgcctgagtaatccacctactcaggaggctgaggcaggagaatcgcttgaacctgggaggcagaggttgcagtgagccacgatcacgccattacacttcagcctggatgacagagcaagactctgtctcaaaaaaaaaaaaaaaagaatccaacccagctcctaggagacaacggtgttcagggtgaaaattcaaatcctatctgggctcaagtgactccacgaagcctccccattgcccctaaccccacaggaaatgatgtctccctgcccagaacagccacagcactttctctctctccaaagggcaggcatcaggctacatccaccttgatttcctcggtggcgtcctgtacagggcacggcatacagaaggtgcccagggaatatctgatgaatgaacaaacagatgggctggcaaagagtcttgttgggtgaaaaggccaaatgccatagggcagcggagagaaaagacaccctgccaggacccagggcccctcgctaaccaaatgcccttgggcttcctggaaaatggccaactctagcaccagtgagtcgagattgtgtcacttagtgtgaccggtggtgatggcctgcaactgctatctctcttctttgggaagaaacaaatgcagcctccctggctagactagtccccctgattcttccctcatcacgtccgctttctccagtcacccaagatcaataagacaacaggccccaagaaagggaggcaccctaggcagagcctgggctagcagcctgaagccctgagccatgccctgtggggaaggcacacccagggccttgtccgcctagagttctgcaccagatgagtcccaggcaaagtggtagctagccctcacatctcccgaaggcaccatgtactcccccaaacagaggcttccagccctttccacatgcagctccctgccctgcaatgcctttccgtgacttctcatccaggaaccaccacggccatctcaaacatcacttcctctaagaggcctctcccagcttctcccagtgagctggctgcccccgctttgtactcccatggcactctgaacatccagcacggtgacaagtccttgtcgtctagaccagaggtgctccaaacacaatctggagatgtctgcagatccccaagatgcttcatggagtttacaaggttcactattttcactttaaaacgaagacagtatttgcctttttgactatcattctccactagtctacagggttttccagaaacctgatgatatgtgatgtcacaaaacattgaatgcaaaagcagagatgagaatccaaatgtctcctatcaaaccaaacagtaacccaaaaaaaggcaaaaatgaaaaatgaagccactcttctactttttatttttcataaaaatgtattactcggccgggtgcagtggctcactcctgtaatcccagcactttgggaggccaaggcggctggatcacgagttcaggagatcaagaccatcctgactaacacggtgaaaccccatctccattaaaaatacaaaaaattagccaggcgtggtagcgggcacctggagtcccagctacttgggaggctgacgcaggagaatcacttcaacccaacaggcagaggttgcagtgagctgagattgtgccactgcactccagcctgggcaacagagtgagactccgtctcaaaaaaaaaaaaatgtattactcatgttaatacgcaataagcggattgttttcttctcttttagngaaacagggtctcactctgtctcccaggctcagttgcactggcaagatcaggcgtaagttaccacaaagagcgtttaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagataatagttcatcactagcagccttatcatctagaccacacacatggagctaccagcaactaaaagtgctaaaagccaaggctgcctataggagaaggaaagaggtcagcaagaaactggtctccatgatgagccctcctgtgctctggcctttttttttttttttttttttttttttttttggtagatataattcaaatacctcgtggtatttaaatttttttaatttatcttttttttttttttttttttttgagagatggagtctcagtctgtcgtccaggctggagtgcagtggcgcaatctcagctcactccaacctccgcctcctgggttccagcgattctcctgcctcagcctctcgagtagccagggatttacagatgcatgccaccatgcctggctaatttttgtatttttttagtagatgcagggtttcaccatattggccagaatgatctcaaactcctgacctcgtgatccacccaccttggcctcccaaagtgctaggattataggcatgagccaccgtgccctgctaaatttaccattttaaaatgtgtattttaatggtttttagtgctgacaaggttgtgcaaccatcaccattatctattgcatatttttttttctttttttgagatggagtcttgctctgtcacccaggctggagtgcagtggcatgatctcggctcactgcaacctccacctccttggttcatgcaattctcctgcctcagcctcccgagtagctgggattacaggcacacaccactacgctcagctagtttttctatttttagtaaagatagggcttcaccatgttgggcctggctggtcttgaactcctgacctcaagtgatccactcgcctcggcctcccagagtgctgggattacaggtgtgagccaccgtgcccggccaactgcagaatattttcaatgcctccctaaatatctatatacatatctgatatctatcagcattcacccctcatttcccctgttccccagagcccccagcaatcacaaatctacttttgttcctatggattggcctattctgggtatttcacataaacagaatcacataatatgtgagcttttgtgttaggcttctttcacttagcataatgtcttcaagacccctctgtgttggggcatgaattggtacttcattacttttcatggctgaataatattccattggatgcatatatatatatatatactctattcatattacttttaatggatgaatattccactggatgcatatatactctattcattctctgaagccgtgtgtgctgtttccactttttagttattgtggctaaacctgctatgaacattcacatacaagctcctaggtgaacacggatgtcctgttctcttgggtatataagtaggagtgaaattactgagtcatacggtaacaccatgtttaactttttgaggaattgccagtgttttcctctattggattttttgacttgatacctatataactttaataaatatttttattttattattttttgagacagagtcttgctctgtcacccaggctggagtgcagtggtgcgatcttggctcactgcaaactcctcctcccaggttcaagcaattcttgtgcctcagcctcccaagtagctggaactacaggcatgtggcaccatgcccagtgcaatggttcccattcagggggctctgccctgtcttgtcccagcccctgtacctaacaacaaaggcccgccaaactcacgtggaaagccggcctgccggatcagcttctttttggacagcaccttcattgcctgcaggaaaatgaaggacagcacctttagccaggtcctgtttaaagcagggaggaaaaggggaaggagggcgcagtcggggttcctctactccaaagccggcccaagctcctggccccctggcaggctcaggtcaacagagtgagcccctcattaccagagagggtcaagcagccatggggttgtagggaggctggactcctggggtgcctccagctctgaggtgttcctgaggctcacggtcgcctctctcagctgggaaaccacgagcctcaggacttgctgccatcgaatcaaaacacaagtgagctggagcaatgggcaaaggaggggcaggactggttgttttacacacggggaaactgaggctcagctgttttacacatggggaaactgaggctcagctgttttacacatggggaaactgaggctcagctgttttacacatggagaaatatcacttgtcaaggtcacatggttggcacacgatagattcaggttcaaaactacgctggactgactccaaagccacccacacagacacctgtctcactgctgccttgttctcaatactatggaggatgcagagatgacagctcagaggaagggcataaaagccttttgctgaatgagtaactttttctgggccaatcccctcacctccccattttcctatctgtaaaatgggcataccacttccttcctaaggcacaaaataaacatgacctaagaataaaatgagacaacagctaggaaaactttccaggaagctgagtgctggaaaggaggctcttctgtggataaggatgggggcagggaggagaatgcggatactcacatagtaggtattgtcattttcattgtaggccaacttgacgacaccataggagccctggataaagggagatgcccatgacatactatccagaagttaagatctgcaaaatgagaaccctaatacagacgttgcaaaccggcagcccattggtcaaatctgtcccgcaactgtattttgttggagcccaggtttttacaaagtttggattagttgccaagatttaaaaacagaaagatctgggcggagcgcagtggctcatacctgtaatcccaatactttgggaggccgaggcaggcggatcacttgagttaaggagtttgagaccagcctggccaacatgatgaaaccgcgtctctactaaaaatacaaaaattagccggggcatggtagcaggcacctgtaatcccagctactcagggggctgaggcttgagaatcacttaaacccgaaagcagaggctgcagtgagccaagatttcggcactgtactccagcctgggcgacacagtgaaattcagtctcaaaaaaaaacagaaaggtctgatatagaaatctatattccttgccaggcaaggtggcttacacctgtaatcccagcactttgggaggccgaggcgggcagatcacttgaggtcaggtttgagaacagcctgggcaacatagtgaaaccctgtctctacaaaaattacaaaaattagccaggtgtggtggtgcacacctgtactcccaactacttgggaggctgaggcaggagaatcgcttgagcctaggaggcagaggttgcagtgagccgagattgcgccactgcgctccagccttggtgatagagcaacaccctgtctaaaaaaaaaaaaaaaaatcaagattcctagtttattttgaaaaaatggaaagatctagctatatgtagccctcatttccatatgttaatggtttgccactgtccttaccactccctactaccttacagctggcatgcctcactcctttatattacttacttgttttctactggcatttggagttttgaccatggtgatgataccccccattagctaaaacaaaagcaaaactagatgtcagagtacctcggggtgaaacaaaaccccaaatgtattggggatgtaactatcaccaaggcgatatggaatttcgttggaagctttctgagcttctgcagaaacatatttaattttaagatacaagaaaacaaaactaaaccaaaaacctagatcattaatgacaaaaccctctccaccaacctcgccttcaaagactcctctcctgctcccagctttaccccgttccctccacagtatctgaacgcccctggtgaatgcagaaagccagcctagccccagggatatttacctttccaatttcatccttcagggtatactgattcagctgcacacagtcctagagagtaaggagagacacgtgcaaaatgaattttaagtttgcaactagaggccaggcacggtggctcacacctacaagcccttcaggagaccaaggtgggaggatcacttgagttcaggagttccagaccagcctggccaacatggtgaaatcccatctctattaataatataaaaattagccaggcgtggtggtgggcacctgtaatcccagctactcaggaggctgaggcacgagaatcgcgtgagcccaggaggtggaggttgcttgagcggagattgcaccattgcactccagcctgggcaaaagagtaaaactgtgtctcaaaaaaaaaaaaaaaaaagtttgcaactagatacatttctccaaattaaacacatacaggtaaccagaacccaaatcaagaaagagaacatccccagctcccagaagccactcgcacctctgccctcccccaggtggccactctcttgacttctaacaacgctgattttgcttgttgtactttgtcaaaatgtaaccacacactgtggactcttgtaaaacccattttttaaagaaggttgttcctacttttaaaaagtaaattttaaatcaaacaagtaatccttggctacattgtcctgtaaaaacataaagtgatacaagaaaagcaagtctgtgcaaccttggggtagacaagggtttcttagataatacaaaaaaggtacagacaaaagaaacaaatgataaattggacttcaccaaaattaaaactttggcttttttttctttttgagatggagttttgctcttgttgcccaggctggagtgcaatggcacaatctcagctcaccgcaacctccgcctcccagattcaagcaattctcctgcctcagcctcccaagtagctgggattacaggcacccaccaccacgcccagctaaattctttgtatttttagtagagatggggtttctccatgttggccaggctggtctctaactcctgacctcaggttatcctcccgccttggcctcccaaaatgctgggattacaggcgtgagctactgggcctagcctattttgttttttgtagagatgggtcttcctatgttgcccaggctggtctcaaactcctggtcttaagtgatcctcccgcctcagtctcccaagtagctgggattacaggcataagccattgtaccaggccttgacagtttcttaacaaacatctaccgtaccacaggccactctacccaatagaagtgaaaatgtgtttacaaagacttgcatataaatattaataacagctttagttgtaataataaaaaattggaagcaatccaaatgtccttcaacaggtaaatgaataaacaaactgtggtacgtccatacaattgaaattattcagcaataaaaaggaactacagatatacgccacaacatggataaatctcaaaatcatgatgctgtgaaagaagctaagctaaaaaggagccattgctcataggtcctagctctgtttttggctcatgctgtgaattctccctcctctcaactctccagggcccaattttcatctccaattatgaaagtttttcctggccttcaaaatgtagtccctatagccccttcaaaatcagcccctttggcagtgcacagtggctcatgcctgtaatcccagcactttgggaggctgaggcaggtggatcacctgaggtcaggagttcgagaccagcctggccaacatggcattaccccatctctacttaaaaaaaaaaaaaaaaaaaaaaattaactgggcatggtggtgcacacctgtagtcccagctactcatgagctgagggaggagaatagcttgaacctgggaggtggaggttgcagtgagccaaaatcacgcaactgcactccagcctgggcaacacagcaaccctctgtctcaacaacaacaacaaaaaaaagcccctttagaaaggcatcctgatgttgggtcttcttccaattaaattcattcgttccttcaacaaatatttttgcgctcctactatgcaccaggtactgtgctaggctctggggatgggatagggtgtggaggtggatgaaatgatcctatggagcttacgttctggctgggtggagacaggcaataaacaactaaaccaacgcacagataatcagatgctgattaacgttatgaaggaaagcaaatagggccatggggcagagagaggctggagggtgctttagggatggtggcccgggaagccttttggaggaggtgatactggagttgagacttggacattatcggaataggccttacaaagttggcatggggtggtgggggaggtggttccaagcagaaggaacagcgagagtacagacccaaggcaagagcttggattccgaggaatgtgaaggcaggaacagagggagcttagggagctggcagcagaatggcaggagggatgggaaagggtcagaccacacagggccctgtgaaccctggtgaggatctgagttctctgtatccccgcagggtttacggtaagggtcctgtgagaaatgcacagcaagtgctgaacccagtgcctggtgccaacacacgctcggccaggcgggtcgtcgccaggctctcagtgacccgcctcattccatcacaccttcgcccacacctcagtctctttgctggaggctccctccggccctgcaactgctctgtccacacccacagggggtcacacacacctgccccagcagccctcacccatgagtataaataccccagctcccttgcccctggtgggatgactgaggctgctgctctgtgctgttccccagggtcccacggaaggaaaaagccccagcggcccacactccacactggtaatcggctccatgacccaccctttgctgactgccttcccttccccatgctgattcacgacccccctagggcccctttttggccccagccgcccccaaggttccctggagtcaactcctaggtcaaccgtggcactcagatccttctgggggagcccaaccttccacagaggccctgctgggggcagggaagggcaccagggacccctaggacctggctcaccaccggctcacgcacctgcatacccgtgatggagacgtggtgagactccactgtcggccgccggggcagccgaggcgaggactgcggggagctgacgggtgagtagggcagggacgggcagatgcagcgtccgttcatgtccaggctgccaccggctgccagcccaccctgggaccgctcttgcagagacagcttgcgaccggagaggtggggccgggcctgggacccggaggtgtcaagggggacctcttggccatcggcctccaggggccggtcccgcgccaagccgaggtccacagcacagcccggctcacactcggtgaccacaatgaaggactccatgcccaggtggatgctcaaggatgagaggccccgcagggcctcacagggcttctggctttcgctgctgctgctgcccctgccccccagctcatcctggggggcggcccggttgctgctgggctggctagagacacatgatgacatggtgcatgcgccagcttcatccagcacactggggcactcccatccggcagcggagccacctgcagaaagagaaagggtcagctggcccagctcctacgggcagggacaggaaaggatcccctctcctcctggcccaggctgctgtctaattcctgcctccagttgacatcctaaaaaaatcttgcaaaacatggtgtgatctgatctctgagtctatacagaaaagcagagtctgcatcttcttatattttttcttttattattttttctttttttttcttttttttttttttgagacaaggtctctccctctctctgttgcccaggctggagtacagtggtgcgatcatagctcactgtacccttgaactcctaggctcaagtgatcctcccatctcagcctcccaagtagctggaaccacttctcacataccatgacaataattcctaactcaattcctataggaacaagtataagaaaacccccaaatagagcacacatatcccctacagaattgacagctgcttccagctcaagccaattgttgctcggcaggaatctgggcctactattgctggtcttccctttgtttttcccaagagaagccctaaggaggttaataagtttgcctgactttttatttttaaatgctgggcattaacaatgcaggtcagggctggacacggtggctcacacctgtaatcctagcattttgggaggccaaggcaggcagattacttgaagccaggaattccagatcagcctggccaacatggtgaaacctcatctctactaaaaatacaaaaattagccgggcatggtggcgtgtgcctgtaatcccagctactcaggaggctgaggcaggagaatcgctggaatccaggaggcggaggttgcagtgagccgagatcatgccactgcactccagcctcagcaactcagcaatagaccaagactgtctcaaaaaaaaaaaaaaaaaaaaggtcggggggaatcaagtatatgccacaatatggatgaacctctaaaatattatgctaactgaaggaagccagtcacaaaaggtcacatatatatgattctatttatatgaaatttttaaaatatgcaactccacagagacagaaagtagactaatggttgcctaggactatgggggtggtgacattagtgggtgtggggaatggctgcttaatgggcacaggttttccttttggggtgatcaaaacgttttgaaactagatagaggtaatggttgcacagcattgtgaacgtactaaatgccactgaactatacacttcaaaatggccaacttatgttacatgaacttatatctcaattttttaaaaaaggccaggcacggcagctcacgcctgtaatctcagcactttgggaggacagggcgggtggatcatgaggtcaggagttcaaggccagcctgaccaacatggtgaaaccccatctctactaaaaatacaaaaattagccaagtgtggtgatgtacacctgtagtcccagctactcaggaggctgaggcaggagaatcacttgaacccgggaggcggaggttgcaatgagccgagatcacgccactgcacttcagcctggatgacagagtgagactccatctcaaaaaaaaaaaaaaagagagagaagtcggacacagtggttcatacctgtaatcctcccagcactttgggaggccaaggcaggtggatcacctgaggtcaggagttcaagaccagcctggccaacctggtgaaaccccatctctactaaaaatacaaaaattacctgggcatggtggtgggcacctgtaatcccagctactcgggaggctgaggcaggagaatcacttgaatccgggaggtgaaggttgcaatgactgagccgagatcgcaccactgcactgcagcctgggtgactgaacaagactcatctcaaaaaataaaaataaaaaagattaacacatccccttaggctgtcaattcttaccgtctctgggacagaacattaacctttgcttaacgtgtttgacaaattctgctggacaaatgtcacaggtaccactggaattcagggagtacatttgtggacagacacctgtggatgatggccactccatgctaatcacccacatcacaaagggtctctctggaccatcctggccaacatggtgaaaccccgtctctactaaaaatacaacaataagccaggtgtagtggctcatgcctataatcctagctactggagaggctgaggcaggagaattgcttgaacctgggaggcggaggttgcagtgagctgaggttgcaccactgcacaccagcctgccaacagagggagactccatctcaaaaaaaaagggcggggtggggggggggtctctctagatgtcccaggaaaacagtgagggctcagcagagattttatgaatgaataaaatggtatctccgatgacattgggaggtagtggggtaaaagagaggaaggtacagacagcggaaagccagagctccctggaggatctggctgagaggcagaaaatggccctcagcgctctcggaacggtccttccagaagaactgatgaaatagctactacgccaggcacgtggcagggaaagcccaacaggaaaggcaaaagggaaaacccaacgccccagccctgacacgggcctgactcatgcacacagagtgtgtggtaagagaacgccaaagagtccaatcatgcggcaagatgttcaacctcacagtaagagaactgcaaattcaaactacaatcaggcagcctggtggctccccaaaaagttaaacgtagagttgccatataaccagcaattcctctcctaggtatagacccaaaagaattgaaggtagggattcaaacggatacttgtacactaatgttcatagcaacatcattcacaatagccaaaaggtataaccaagtgtccatcaacagacgaatgaataaacaaaatgtggcagagccatacaacagaatactatacagccacaaaaaagaaggaaactctgactcacactacaacacagacgaaccgtgaagacatacgctaagtgaagcaagccagatactaaaggacaagtgttgtaagatttcagttacatgaagtatctagaatagtcaaattcaggccagatgcagtggttcgcacctgtaatcccaacaccttgggaggccaaggcaggcagatcacttgaggttaggagttccagataagcccggccaatatggtgaaaccccatctctactaaaaatacaaaaattagccaggcgtggtgttgggcacctgtcatcccagctactcaggaggctgaagcaggagaatcacttgaacccgggaggcacaggttgcagtgaggcgagattgcgccactgcactccagcctgggtaacagagcaagactccatctaaaataaataaataaataaaaagtgttttaaaggaaagaaaatacctgtaaccatgatcggagttatgatgataaggcctaggatgctacgggatcagacggggcaggaggtcaggagaggggagcagttggtcttatctcctatttctctgtcccccattcccccttactgtatctcagaaagaaatcatcaactctgtccctgtctcagtttccccatcaatgagagaatacaactcaagtttgatatttctctatggccctagctgctgctactttacttctccttctcatggtccttatgtcccagaagaggaaactcaagataccctgaagttcaacagcttaaggtcattgacatcctgtaaagttggtgcccatctgatagtcataggattagatgaaccaagcactcagaatcatgccctgcaagtggttaagtactcaaaaactattacttcaacaaacacctgttggatgctatggtttgactctgtgtcctctcccaaatctcaccttgaattgtactcccataattcccgtgtgttgtgggagggacccagtgggagataattgaatcacgggggcgggttcccccatactgttctcatggtggtaagcctcacgagatctgatggttttatcagggggttccgcttttgcatcttcctcattctcgctgcctgctgccgtccatgtaagaccggacttgctcctccttgacttccgccatgattatggggcttccccagccaagtggaactataagtccagttaaacctttctgttgtaaattgcccagtctcgggtatgtctttatcagcagcgtgaaaacggactaatacagatgcccatggcctgctctggtaggtagcctatgctctggaatgttcccacgaggaccaatgtccaagcgagctggcctgctcttaagtgtgtccctcagccctggctgtgtggcctgcgtcccccagggcaggcagtcagtctctcccctatcctagagctgcctctgatagggctgcaagagttcctgagaagaaaatgaggctgagcagtgcctgggaaagtcaatggagatttgtttttttctcaccaacaggaaaacaattgcttatcgaactctacaccaggccaagggcactgagccatccgcccccagcaaggctgcttttaatcggcctccttggcaagctggcatctggcccgggcctccctcacagctctgacggagtctcggcctctgcggtctgttggaggatggagaggagagacagctcagaccccgggcagggacgtcggcgctggcagggcaagcgtgaaaccccagagctcagcagagaggagccccagggacgcaggccctgacaggaagagatgcatccaggggcttctggcctcacagacacctagagtctaggccagtgtcctgaacggtttgggggtcacagaccctacaaagatctgatgaaagctaccaacactctgtgcagaagaaatcatgcaaaaagacaatagtttagcctggaaacagcaacggctaacattcaactgagctctcatcaggcacccagcacggagataaccgcctggccatgtaaccctcacaggaccaggccctctgccagggaaggacagtgaagcattcgattccagagggcggagcgtgagaggaggacttttttgcaaagttgcttggatttgacaaaatgtcagccctggccctgcatccttccccatgaaatccaggcagaggccatcccccaaggccttgcctctaccctgttccctctcacagggcagctcatcacgagccaccagagccttcctggagcagatggacccgggacccgggccaggatgagggaaacgctccttcctctgccaggaagctgagtggcgcaggcctccaggaaacaccttctcatttcctaggggctgtttccaacctgcatccgctacctcccgcgcagcaagctgccagtgggtgccaaagaggtgctcccgagcccggacacacctgtgcaggctcccccgaggttgcctcatcctgggcacaacaaaaaggcccaaaacagctccgaggatcctgccaaggccacggacgatgtcctgcccgggacatcaatgtcctccttgggaaaatgggctcagccagccaaagtcagggaccccaaacggagggaccggctaaagccatggcagaagaacatggattgtgaagattttatggacatttattagttccccaaattaatacttttgtaatttcttatgcctgtctttactgcaatctctaaacataaattgtaaagatttcatggacacttatcacttccccagtcaataccctcgtgatttcttatgcctgtcttatttaatctcttaatcctgtcagttgaggaggatgtatatcgtctcaggaccctgtgataattgcattaactgcacaaattgtacagcatgtgtgtttgtgcaatatgaaatctgagcaccttgaaaaaagaacaggataacagcaatcgttcagggaataagagagataaccttaaactctgatcgccggtgagccgggcagaacagagccatatttctcttctttcaaaagcaaatgggagaaatatcgctgaattctttttctcagcatggaacgtccctgagaaagagaatgcgtacctaggggtaggtctctgaactggcaccccccggggcgtacctgtctcttatggtcgagattgcagaggtgagatagactccagtctcccatagcgctcccatctcccatagcgctcccaggcttattaggaaggggaaattcccacctgataaattttggtcagaccggttgatctcaaaaccctgtctcctgataagatgttatcaatgacaatgttgcccgaaacttcattagcaattttaatttcacctgggtcctgtggtcctgtgatctcaccctgcctccacttgccttgtgatattctattaccctgttaagtacttgatgtctgtcacccacacctattcgcacactccctccccttttgaaaatccctaataaaaacttgctggtttttgtggcttgtggggcatcacggaacctaccgacatgtgatgtctcccccggacgcccagctttaaaatttctctcttttgtactctgtccctttatttctcaagccagccgacgcttaggaaaatagaaaagaacctatgtgattatcggggcaggtcccccgctagacgcgggcctccaggaaacacattctcatttcctaggggctgtttccaacctgcatccgctacctcccgcgcagcaagctgccagtgggtgccaaagaggtgctcccaagcccggacacacctgtgcaggctcccctgaggttgcctcatcccgggcacaacaaaaaggcccaaaacagctccgaggatcctgccaaggctacggatgatgtcctgcccgggacatcaatgtcctccttgggaaaatgggctcagccacaccctgtctcacatggggaaactgaggcccacagaggtcctcaaggaaatgcgttcattcattcattcattcatttgttcttacatgtagtaattataaagcaatgatcacgtgctggataaacaaaacagatgtggtttttgccctcgaggggactgacagtccaatgagggggaccaacatttaaaagtaggtgcacaaggccgggtgcggtggctcatgcctggaatcccagcactttgggaggccgagacgggtggatcacctgaggtcaggagttcaagactagcctggccaaatggtgaaaccccgtctctactaaaaatacaaaaatagccaggtgtggtggcgggcgcctgtaatctcagctacttgggaggctgaggcaggagaatcgcttgagcctgggaggcagaggttgtggtgagccaagattgggccattgcactctagcctgggtgacaaagcgagagtccatcttgaaaaagaaaaagtaggtcccaagtgaatctataagcacagactggggcagaagaccaggatatgatcaaagagaataccagaggggaccactttagatttgaagggaggcggtgggtgaaagaaggcccctcttggtgaacgtctattaggctgagacctacagggtgagtagatactaaaggagcaggaacttgttcccagcagaggaaacagcttctgagaaggccctctgtggaaaagaggcgggagagtggaggcaacagaaacaagtttcctgggtctggagcccgggagcaggaacaaagtggggaaggaggggctggaagggctacagctttgtgggaagtggatgatgatgacgagagggcagcccagggcaatgctacagggactgggctcagaccctgctgtgagttgaactgtgtcccccaaaaatgttatgtggcagttctaaccctcaggacctcagaatgtggccttatttggagacaggtctttacagagattatgaagttaaaatgaggtcattagggtgggccccagtccaacaggcctagtccaataaatgggaaaggtagacacacagccagccagcacggagggggaaggccacacggagatggaggcggagacgatgctccttctagaggccaaggagcatcagagattatcaacaaccaccagcagccaggagaggcctggaacagactcccctcggagccttcagaagggacgaaccctgccaaggcttgatcccagacttctggcctccagaaatgacagaatatatctctgttcttttttttcttttcttttcttttctttttgacagagtcttgctctgtcccccgggctggagtgcaatggcgcaatttcggcttactgcaacctccgcctcccaagttcaagtgcttctcctgcctcagcctcctgagtagttgggattacaggcacccaccaccatgcccggctaatttttgtatttttagtggagacagggtttcaccatgttggtcaggctggtctcaaactactgacctcagatgatccacccgcctcagcctcccaaagtgctgagattacaggcatgagccaccacgccctgcctaatatctctgttctttaagccgcccagtgtgagacttggtcacggcttctctaggaagataatacagcaccccacccaaccagtggggttcggagaagccggctgccttggaggccacagactctgaggcatttcccaaagctctagcgggagacctgagaggctcggctgcatccacggaggcggtgctggaatatttcagacccagggccctagcccagctaagcagggttatcagatccagtgacaccaactgttacaactggctctctccttcagcgctctttaatttggggccactgaaacaactgagtccgcaaaaacaaaggccctcccttgtcagatggcaatagagatatctcaggcctcagagaccccatcctcatcatagtccctagaacaaaaacgttgcaaatgatgactcctgtgtgacatctggccaccgatatactggccttacaccaggttcaaagctatctgaagaagtggtggctcatggccgtaatcccagcactctgggagaccgaggtgggaggatgacttgatgctgaattcaagatcagcctgggcaacatagtgagaccccatctctacaaaaaaaattttttaaattagttgggcatggtactcacacctgtagtcccagctactcaggaggctgaggcgggaggatggcttgagcccaggagttggaggctgcagtgaactatgattgcaccactgcactccagcctgggtggcagaatgagatcctttcgctaaataaataaataaataaataaataaccatttgaatgagatgccaacatttcagagccaggagatttcagataaaagtgcaaatttacagattttcttgaagaactgcacactgatagcactgggcctgtgttctatcctggcaaccactcgctgcagctctgggcaggggacacactcaccagcacgccacagtcctcaccacttcccagtgcctctccaaagctgaggacaggctgcctgccacggcccacgccctcccctcggcccacatctcatgccctgcctctccgctacaggtgtctgagtctgcagcccctgctttcaagtcactgaatgtcagtgcaaagacaggtgcacatcagtggtcacctgctctgaccatttcattccaccaatgaggaaaatgaaggttcagaaggatttactgatttgcccaaagtcacgcagtggttctaggcagggcgacaattgggctgagttttgttgttcttgtttatttttatttttatttatttacttatttttgagatggagtctcgctctgttgcccaggctagaatgcagtggtgtgatctcggctcagcgcaacctctgcctcccaggtttaagcaattctcctgcttcagcttcccaagtagctggggattacaggcacgccaccatgcccagctaatttttgtgttttttggtggagacagggtttcaccatgttgcccaggctggtctcgaacttctgacttcaagtgatccacctgccttggcctcccaaagtgctgggattacaggcatgagtcaccgcacccggccgggctgagtttttcaggaaggggccaacaattacaggcatagccctgccatgtccacatattgcgtcctgaataaagtccaggctggaccaaaatctctaacaagggatttgggcaggcagcccattcctctgccttgctgggacctcgacctgtgtttgagagagatgagagcgaaagcacagggtctcaaagtgcttggaggagaaatgcacaggatttgggcacagggacatggacatgactaactcatgagagctgtggctttggcctccttgtttacagctgaattcccgggcctagaactttctaggacactgctcgcactcagtaaatactgactagaagttgttgtttatttcttctgtcccaaggccactcagaaggtcagaagctttctttagctggcctagagttgaagtttctttagtctgataacagcagcccaatttatgtctgggaagccatccctccatatgagaggtggccctacagggctgaccccaccatcagcttcagagatttgcatgtgactcaagcctggccagctggctatcaattgctctggtcaagtgggtaactcaagaatagatatgaggccgggcgcagtggttcacgcctgtaatcccagcactttgggaggccaaggcggacagatcacttgaggccaggagttcgagaccagcctagccaacatggtgaaactccacctctactataaatacagaaattagccaggtatggtggcgcatgcctgttatcccagctactcaggaggctgaggcacgagaatcacttgaacccgggagggggaggttgcagtgagccaagattgcaccactgcactccagcctgggcaacagagcaggaccttatctaaaaaagaaacagagtagatgtgtgggccaggcatggtggctcacgcctgtgctcctagcactgtggaagtctgaggtgggcagatcccttgagcccaggagtttgagaccagcctgggcaacatggcgagacctcatcgctacaaaaatacaaaaaaaacctagctgggcatggtggcgtacacctgtagtcccagctactagggaggctgaggtgggaggatcgcttgagctggggaggttgatgcagcagtgagccgtgatcatgccaccgcactctagcctgggtgacagagcgagaccctgtctcaaaaaagagagtagatgtgtgacccaagtcagtctattgggtcttattctgtgattttgtggaagtgttgaaaagaaagaatgtcctttctgttgaacctagagctcagaggatatattcctaaagctaccaggggctggagagaaccctgcctcagaatgaagtctaagaagagagaagagaggtaatggatggaaaagagctgaggttgaagacactgtttaggcacctggattcagccatgcctgaagctcatgtacctcaatttttaactacatgagccaacatatttccatttttgcttaagctatttcgtgattagttttccatcatttacagtcaagggccctgacttacaaatgacagagctgactgacagggaagctgctgtctccctacaccccagggctctcatccaggccaaactgccaggcagctacaaggcctctggcaacctggacagccttcaccttgacaggcaacttgacttccaacactgcttttctctttcttttaatcttaaaacatcaaggatggggcagggaagggctgatgaacagggagaggagaagaaactggcattttcaacacaagaatcgcattgctgcagatgcagtgatactaatggttagccttcttgagtgcttggcactcttctaatcctgcatcatctcatttaactgtcacaaccaccttatgagttatagatactgttttgtttggtttggtttggtttgatttggtttggttgaggcagggtctcactctgtcacccaggctggagtacagtggcacaatcttggctcactgcagccttgatctcccgggctcaagcattcctcccacctcagccccccaagtagctgcaactacaggtgcgcaccactacgcctggctaaataggtcctgctattatccctgttccaccagtggggaaactgaggcacagagagcctggctgacttgctcacaatcatccagcttctgagtgcttcaggagggcacaagtgtgaatgctcactatatagaagctattgccaagaaagaactttggcagttactgaattcacgaccctcagttggcttcctttttttggggggcggggcggttggggacagggtctcactctattgcccaggctggaatgcagtggtgcaatcatagttcactgcagcctcgaactcctgggctcaggtgatcctcccaccttacctcccaagtatctgggactacaggcatacaccaccacacttggctaattttttgtatttttggtagagatggggttttgccatgttgcccaggctgttctcaaactcctgggctcaagtgatccacctgcctcagcctcccaaagtgctgggattataggcatgagccactgtgcctagctggtttcaatttattttaaaacgaaatctcttaaatctctaatcctgccgtgctaactcttcatcttcccctctagcccttgtccatatgcatcacattttacaaaattaaaaatagcgtatgcatatcatttcacatccttgcttccatgtgtcataagagcacattctcacatggcttttgcaatcagcgcaacagaggctgcagatggagtcaccgagactcagagaagttgagatgacctcatccaggcagcccagcaggctcgcagttgggccaggaggagatccaggtggcctgccctgcagcccagtgacccttgaggccctggatactcacagagtaagcagttcccctgtcttgctgcttgccagggccaactgtcttaagaattcttaggcagctattacttagtcagtaatgaaatatcactgaaagaatggccccagtcacgcagtcagacatctaaagccagctgtgggccaggtacagtggtggctcacgcctataatgctagtgctttgggaggccgaagcaggaagatcgcttgaggccaggattcgagaccagcttgggcaacacagcaagaccccatcaccacacaaaaaaatgtttacattagccaagtgtggtgctgcacacctgtggtcccagctccgtcagaggctgaggtgagaggatcccttgaggccaggaggttggggctgtactgagctatgattgcaccattgcattccagcctgtgcaacagagaaaggctctgtctcgaaaatttttaaatttaaaaaatataaataaaaataaaaccaggtgtgcatgggtggccccagccttgaagtgtgaggagcttacgaatgtgtgggtgagtttgggtatgtgtttagaggagggaggtatttggaaataaagtgtagaaaccatcttccttccttcctcttcccccactgcatccctctcaatctttcactgaaccaaaggaagaggttggaaaacaactggaatttcagtttgtaatgaacaagaaaaagacttctacccagcatgctcttggcaaatcagagatggagagggccagctcgaaacccacaggcatcggtgcctgggctacccacggcccctctccctccctcctccccaccttttggacatcatgctaaatctagctgcaagcctcctcagctgagggacaagaagagtgcagggagccagctctgcagctctgcggggcccaacgtccccacacctggacctagagggcagaactgtccaggatgaaccgaataaaatatttctctgccagaagccttgaaggcaataccccaaagcacatttcaaaaatgaaaaagggagtgtgctctcccttctgcaccctggcccccgcaaaacactggttccccatttaaacttctctaacagaagcttctctcaggcaccacccacaatgctcctaccccacccgctgggttcctgcctcatgcctaagccacgtgggcagaggggcaacaccttggcctccccactgactcccacccccctttcctccgaggaccaccatccctctcttttccaggttgggattagcatttttatctctgcaactgccatctctcaactatttacagaagccaccaggataaaaagaggcaacataaaaatagttgctcagcagctttcaggatggggtggggtgggggtgggggcactacagaatcttctcattttctttcattccttttcaaaagggaaaggatgtcagaattgttcatcttttccaaaaggctctgagaccactcacctgggacaggaaccaagtcccagtatttctcagttccccagggtatagcctgtcaccagcaccaatccccccaccccaccccaaccaaaagagcgggctgggtgaagggtcgagcctgcagagccagggcgccccactctgccccgtttccgtcacctcctgggcctccttccagctttccaaaaagcgagccagtttaaaaaaacaaagcaaaactttggcttttctctatgcttaaaatgtttcataattgaaaaaaaaaaacttcagtggcaatactacaaacatgactgaaaccgaaacactggcagctaaaataatccctttcccatttggatcactaacgtccccaacggggaaagcagcagccaggggtcttccctacaaaatctaacagaactcacatcattttaaagatgtcttttttattattattatcttggttttgttgagaaaggggtccaatcagggaagaaaacaaataataattctaaatcttatttctcagagcccaaaactattcggaaatgctttccatcccataacctgccagggaaggtggactccactccatcagaaaacgagcataatttgccagtacaaggagccaaagttgggagcgatggctcatgcctgtaatcccagcactttcggagactgaggcgggcggatcacctgaggtcaggagttcgagaccagcctggcctacatggtgaaacctcgtctccactaaaaatacaaaaattagccaggcgtgatgggacgtgcctgtaattccagctacttggaaggttgaggcacgacaatcgcctgaacccaggaggcagaggttgcggtgagctgagatcatgctactgcactccagcctgagagacagagcaagaccctgtctttaaaaaaaaaaaaaaaaaaggcggggcggggagccaagggaggcctaagacctcaggaagagaaggtacatcaggaaaggatacagatcccagaggaccttgagccttgattttctcatctgtgaaatggtgccagacctacctaagagggtggctatagagttgatcttctctatggcagtccctagtacacagcgtggctcaagctaattgttccgcaaagatcacgtcctcccttcctttctgtactccgcttcccttgtctggaacatggaagggttcaggagctgatctctgctggccttcctctcaggccagctttccatttctgctttctgggcgggtattcctggcaaagctatcaggacagaatgggctgactccactcacggccacagggccgtggcactatctctctgcttttctctactttgtggatttacttacctggaaaaaagtctcacaaaatatatactaataaaatcacatggggaccttcatttaacaaaacagggctggttgtaatggctgacaactgtaatcccagcacttttggaggccaaggcaggaggatcacttgagcccaagagtttcagactagcctgggcaacaaagcaagaccctgtctctacaaaaaaattaaaaatattagccaggcgtggtggcgcagggctgtaggcccagctactcaggaggctgaggcaggaggatctcttgagcctgggaggttgaggctacggtgggccatgatggcaacactgcactccagcctgggcgagtgagtgagatcccatctcaaaacacacaaaaaatcatcgtaactgaaaagaatggaactgaataaaaccaagactgtccctgaaaattgtaatgaaatgaccatgaattgatccaggaggcaatgggtttgttttgttgttattgttttgtggttttttctttttgacacggagtctcgctctgtcacccaggctggagtgcagtcacactgacctcggctcactgcagcctctgcctcccgggttcaagcgattctcctgcctcagcctccagagcagctgggattacaggcgcgtgtcaacacacccggctaatttttgaatttttagtagagatggggtttcaccacgttggccagactggtcttgaactcctgaccttaagtgatccacccgccttggcctcccaaagtgctgggattacaggcgtaagccactgtgcctggccagcaatgggtttaaatggggagccacgattcttgcaaggggtaggtaagggtgcatgaagggaatcccgaaaaccttgggttgggaaactggttcctgagtgatttcaagaaacctttcttccatcacctgctccctccaaacagagtgacaaaaaaatgtcttatgccaagaagttcattaactgaggggctacagagacacgggaatggacaaagtagccttaagacgcctttatggtggaaacaacccaaatgtctatcaatggatgaatgtatacacaaaatgcggtccatccacacaatggaatagtactgggccgcagaagcgaatgaagcactgacagccactatggcatggatcagtcttgaaagcatgatgctgaatgaaagaagccagacacaaaagtcatatattacatgattctatttatatgaaatgtccaaaacaagcaaatccagagagacagaaagtaggctggtggttgccaggggctgcagggaggggcactgggaagagagagtgacagtttaatgggtacaaggtttcctctgggggtgatgaaaatgctctggaactagacagaagtagtggttgtacaacattataaatgtactaaatgccactgaattgtcactttaaaattgatgaactatctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctggatcttctccaagaccactaaggtggtacctttacgagtccgcagaactacagttttattgggttcagggttcaagtccctttgaatacctgaaaagccttcccaagaatcacaggcacaaataagcccagactgtgaagactacaataaatgcctaactcttcactgctcagacactgatgaatatccataagcatcaacaccacgcaggaaaacatgacctcaccaaactgaataaggcaccagggaccaatcacggagaaacaaaaataggcaacctttcaggcagacaatttgaaagagctgtattgaggaaactcaaagcaattcaagatgacacagagaaggaattcagatttcctatcagatgaatgtaacaaggaaatagaaataattaaaaagaatcaagaggaaattctagagttgaaaatgaaattgacatactgaagaatgcatcagagtcttaatagcagaattgatcaagcagaaggccgggtgcggtggctcacacctgtaatccccacactttgggaggctgaggcagctggatcacttgaggataagagtctgagaccagcctggccaacatggcaaaaccctgtctctactaaaaatacaaaaaattaggctgggcctggtggctcacgcctgtaatcccagcactttgggagggtgaggtgggtggatcacttgaggtcaggagttcgagaccagcctagccaacatggtaaaaccccaactatattaaaaatacgaaaattagccaggcaaggtggtgtgcacctgttatcccagctactcaggaggctgaggccagagaattgcttgaacctggtaggtggaggttgcagtgagccgagatcataccactgcactctggctcggtaaacaaagcgagactctgacaaaaaaaaaaaaaaaaaaaaaagactttgagaccagactggcctacatggtgaaaccctatctctattaaaattacaaaagttatctaggcatggtgggaagttgaggcaggaggatagcttgaacctgggaggtggaggttgcagtgagccgagatggcaccactgtactccagcccaggcgacggagcgagactttgtctcaaaaaaataccaaaaaccaaaaacaacaaaaacaaaaaacatcaaaagactatgaaaaacagtgattggatgtttggggtgtggatatcggaatctggagctggggacaggtgtgtcatttgatagtcccttttgagaaccactgttgatctaaagctattccagttccctaggggattgctaataaccggtgcagctgctgagacagggaaaggggcctaattccttttgcaaaacaaggagcaatatttatatgagaactcagtacatttcatcacataaaaattgcaaaacgccaggctctgtcatttttaaactaatatttttgggagtccaccaaacagtctctaagatggaactgattgtgaatatgctggtgccaggtgcaatggctcacacctgtaatcccagctacttgggaggctgaggtgggaggatcacctgaagccaggagttcgaggccagcctgggcctctctaaaaaaaaaaaagctgtaagtcaaatgatatagcctctagaagccacagtttgctcatttacaaactggaggagaataagatgagaattgtctgatattgaggatcagaaagtgcttcatgatgcataaagcaggtaatggattatcaatgctttgctgctcagacacacagcaatgggttcataccattctgagagtctaaatttaggacgtggtgtgaccaaaattaccagtaattaagtttcttatgtttctgaggctctgcttcctcatctgtacactgtggcaagaccttgttctgactatgcactgaggataaaataaggccttttgaaaaagatgatgacactgaccactaattaatgatttcaatgttcccgtccaaggtcaggcaaaagcaatgcagagccatagagaatgttggtgcaacactgccctctgctggtcagtagcagcaccaccatggttacagagaggaaaaggtctttacaaagggattcctgggaaactgaggcagagagtggaagggatttgctcaagggcacagagttagctttggacaaagtgatggctcgaatctgagattcctaattcctagttctttctagagggagaaaaataagggctggaaactagtggattgtcgtttcactctcactaggctctgcacggcattttaaataggctgattggaatttctctctcctgttcttcccttgccacccatactgctcgggtttcttgtccttttcttcataccaggataaccatctgtgtggccccataaggcccaaagtcctcttgggtgctgccggagttccaacaaccagtaaagcacggaagctgggatctgaacactcacttgagaccccaaggcccacaatctatttgccaccaaaaaacaagacaaagcaaaacaccatggtaacttgtgttgaaaaagatagatcttgtgttttgttatttccccgaatggtatttgttgggcagacacatgtgtgtgtacagggtagcagtcaggatggaccacaggcccccacactacgaaacccttcagactctcccacagaaatgaggggaactgagccaggtgcagtggctcgtgcccgtaatcccaacttgggagactgaggcaggaggatggcttgaacccaggagttcaaggctgtagtaagccatgattgtgccactgcactccagcctgggggacagagtgagactctaactcaaaaaaaagaagggaaggaaggaagggagggagggagggagggaggggagccaggcacagtggctcacacctgtaatcctagcactttgggaggccaaggcaggcacatcacttgagcctaagagtttgagaccagcctaggcaacatggtgaaacccatctctacaaaacatacaaaaattagctgggcatggtggcacatgcctgtagtcccagctacttgagaggctgaggtgggaggatcacctgagcctgggaggtcaaggctgcagtgagctgtgatcgcccctcaggactggaagtcctcctggtctgggttcaaaccctgcatttctgaacactactgtgtgccaagccctggcaaatcatatttcttttaatttgataacactgtgaggtcggtacaattattatcaccattttacaggtgagcaaatggaagctctgagacattaagtatcttgcttaagagcaagagttgtggggaacccaggtgttgataatttgccagcatttgatgtgatgcttcatggttttattcctccccatttgcagacgggaaaaccgagttgcagacaaatgaaagtgacttacctcagggcctttgcatgtgccatcctctctgcctggaatgctcttctcagatatcaccttggcatcccccatcaccttcttaaggtcttcacttaaaagtcatcatctggccgggtgcggtggctcaccctgtaatctcagcactttgggtaggccaaggtgggtggatcacgaggtcgggagatcgtagaccatcctggctaacatggtgaaacccagtttctactaaaaatacaaaaaattagctgggcatggtggcaggcacctgtagtcccagctactcaggaagctgaggcaggagaatggcgtgaacccggaaggcggagcttgcagtgagccgagatcgcgccactgcactccagcctgggcaacagtgtgagactccatcttaaaaaaaaaaaaaaaaaaaagtcatcatcttagggaggtcttttctgatcaccctatttaaaagttcaggctgggcgtcatggctcacacctgtaatcctagcactttgagaggctgaggcaggagaatcacttgaacctgggaggcggaggttgcagtgagccgagattgcgccactgcactccagcctgggcgacaggatgagactctgtctcaaaaaacataaaaaaataaataaataaaaataagttagctccatgcttttaactcagtaacaaaaagacaaatgaccaacgtcaaaagtgagcaaaggactatctaagaagatatatatacacggccaatgggcacatgaaaagatgctcaccacgtaatgatatgtattagggaaacacagatcaaaaccacaggacacacgacttcctatcactaggatgactgttattttaaaaatggaaaataacaagcattggtgaggagatgaagaaattggaagctttgtatattactgataggagtgtaaaatggtgctgctgctgtgggaaactggccattcctaaaaaagttaaacatagaattaccatatacccagcagttccacttttaggtttttaccccaaagaattgaaaatggggactcaagcagataccatttttatttttattttttatttttagtagagatggggtttcaccgtgttggccaggctggtctcgaactcctgatctcgagtgatccacccgcctcggcctcccaaagtgctaggactgctggtgtgagccaccatgcctggcctcaaacagatacttgtaacctaaatgttcacaacagcactattcacagtagccaaagatggagacaacccagatgtccctaaacagacgaatggattaacaaaatgtggtctatccatgtgattcaattttactcagccataaaaaagaatgaaaggcacatgctaccacatgaatgaaccttgaaaacaaggtgagattcttgtgaaaggagctagtcacaaaaggccacatagtgtatgatgccatttatgtgaaatatccaaaaacagacaaacccacacagagaaagaaaagcaacggttaccaggggctggaggaggaggaatggccaaatgggtacggggtttccttttggggtgatgagaatgttctggaactagacagaaatagtggttacataacactgtgaatgaactaaatgccactcaattgttcacttaaaaaaaaacagagatggagtcttgtcgtgttgcctaggttggtctctaactcctgggatcaagcaatcctcccgcctcagcctcccaaagtgctgggatcacaggcctgagccaccgcgctggccaattgttcacttttaaatgattaatttcatgttatttgaatttcacctcaatggaaaaactcagccccaaacatgccttatcttccctccctacctgatttttctcctaatgcacagggcccctcacatatggtatgtccggcctatgtgtccattgttcatcctgcttctttaaaatataaattccaacagggtaaggatttcatctgttttgttaactcacatatgcccaaagagtctctggtactcgataaatatttgttgaataaatgaattagatagggtgtggtgatggagagagtcccgccgccatccctgcccccatctctaattctaacgttctaacccggctcttgaccttggagccggttaacgatgatcctgtctgggctcattttccctccttttcctgaagagcagcatccacaggccctcactcagctcagtcccttttaacccttgtctgctgagagtttgagataaagggggccacgagagaagacaatgaatccattacaatgtgtgatgagctgtctgctctgtggcttcccacagcaatttatcatgacctggaaccacagctgtgaggccgggtgtgcccccgccaggacctcactccccagctgcttcagaagggaacatttacaggaacctgtccatacctatttaatgaacagctgctcggatgcagccctgtcccaggcactcagccaaatgacaaatgaactatataatcattcattcattcgatgattcattcattctatgattgattgattcattcattcatgtggttgtcaaacattcattgagcacctactatgtgccagacactgtaccttgcactgtggcccttaatatcagagatgtcaatgtatgatagaccaggattcctcagcctaggcactggggacacttttgttttttgtttttgttgttgctgtttttgagacagggtttcactctatggcccaggctggagtacagtggcacaatcacagctcactgcagcctcaacctcctgggctgaagcaatcctcccacctcagcctctcaagtagctgcgattacaggcacacgccaccatgcctggctaatttttttgtattttttgtagagatagggtctccctgtattgcttaagcttgtcttgaacttctgagctcaagctatcctcctgtctcagcctcctaaagtgctgggattacaggtgtgagccaccatgcctggctactgtgcacattggaaccagatatttctttgtcacaggggttgtcctatagattagcagcatgcctggctgcagatgccagtagcactccctcagtcgtgacaactcagatgtctccagacattgccaaacgtccctggggcacacagtcatccctagttgagaaccactggtctagacaagtatattttcctcaaattatcagagaaaaaaatgcttttatttttgctgtttcctccttctctccctctctctctccccctacatacctacctacctggctagttaaattggaaagcaaaagcataattacagctaacatttgtaaatagcacatagtaaggggtcattttatcttggttattctcgcaacaactatatgggcaaaatgccaccaatgttcactttacagatgaagaaatcaaggcccagagatgctaagcaagttgtccagggtcacaccaagatgaaggggcagagctggggttcaaatccaggtccatatgactccagagcccgggtgccaccagattaagattaagattaagagaccaggttaagcaatataggaagaccctatctctacaaaaaaatacaaaaaaaattagccaggcatggtggcatgcacctgtagtcgcagctaactgagaggctgaggcgggaggattgcttcagcccaggaggttgagggtgcagtgagctgtgattgtgccactgcactccagctgggccatagcgtgaagctctgtctcaaaaacaataacaacaaaaacaaaaaacaaaagtgtccacagtgtctaggctgaggaatccactgtgccacactccctggcacagagcctcacacattgtagtgagcaataaacatttattacctcagtgaatgaacacaagaatggggcaaggattctgagaaaggcctggagaagcataggctgcaattggaggcttgatgttctggagggacgtgtattatcttaattatttccatccatcagtccatccattcatcgatccagccactcattcaccaagcattccccaaacacctgagttgtgtctggcacctaggaggaattctggtttcaagatctcatagctggctgggcacggtggctcatgcctgtaatcccagcactttgggaggccgaggagggcaaatcacttgaggtcaggagttcgagacctgcctggccaacatggtgaaaccctgtctctactaaaaatataaaaattagccgggcgtggtggcatgcacctttagtcccagctactcgggaggctgaggcaggagaatcacttgcatccagcaggtggaggttgcagtgagctgagatcgcaccgctgcattccagcctggacaacagagagagactccatctaaaaaaaaagaaaaaaaaagaaaaaaaaattctcgtagccaaggaggacgcattaattgtgctcaggaataattgccacatcagatacaaagtgagaagccacgttatgaaggaacacaaagatgctagattagccaagactcttggtcaaaagtgatatgtatgcctgctccaattggcttaagcaataaagggaggttattggctcctaaatctagtgaggtttcaggtatggcttgatcagtgtgttcaaatgatgtcatcagaaatccctccatcattaccctctgcctctggttttctctgagtcaacttaattccctgctggcatgacggccaccaagagctttaggcttatgtcctgccagcttagcaactccaactcaaagagcaccactttttcaatgattttagccaaaattccaagacttgtctcagaccaacctgaatcatgtgcctgctcttgaacaaagcacagtagccagggaaaaattgtgctttgattatctaggactggatcctggacctgcccctgggacttgcggaaggggacagctcaatctgagccatatcaactgagaacacaggaagcatggtcctaccaagagatgtctattccaggtatggtggagcctcagaggacagcatgactctcgttcagctggtggatcagggaatggtccaataagccacagctgtggatatgaaggtctgttgatttcagattgagctagagggggatactgggcatggcagaaaaatctatcaatctctgctatagttaaatatttgaatattggattgtttgcagatcttgtgaaatcagtgacctctgggtcatgtagaaacccagcacattcccacaggacacagcctagcagttgatcagagcagtagttcatacctgagaccctggattttcagaccctcccccaggccccaccagcctctgtcagtgccaagctggacggaacaaaccacatgaggttggtcaggcctctaccccatggaaaaacacagaatggtgattttttgcctgtacattcctggacaaataaattctcttttgggagctttttcctggctgggctatgttatatgcctcagagctgcccagatcccctggaaacccaaagatttccttccatgtgtaggactcattcagccccagctcagaggactgtttcatgggtactggtggcaggaattcttggttgtcttcaatgtctggctccctgattttcggtagggaacatggtcagcagaatgaggatggcatttcctaccttctactgcaggtaggtgtgaccatgtgactacgctctggccaatgacctgcaagtggcagtgacagatcccatccttcaagggaggaacatgccttctctttctcctttcctctttcttccaggcttttaattttttatttattgattgattttgaaaaacggagtcttgctctgtcacccaggctggagtgtagtagtgcaatctccgctcattgcaacctccacctcctgggttcaagcaattctcctgcttcagcttcccaaatagctgggattataggcacgtgccaccacgcccagctaattttttgtatttttagtaaagatgaggtttcaccatgttggccaggctggtctcgaactcctgacctcaggtgatccacctgcctcagcctcctaaagtgcttccagcctttttagaattcagttctggtgggaaccattttggatcatgctgatgaaggtaacaccatagagatggcagagctggggttgggtctggtgactcacgcttgtaatcttaccactctgggaggccgaggtgggaggattgcttgagcccaggagtttgagaccagcctgggcaacatagtgaaacctcatctctacaaataaactcttggctaaagcaatcctcccacctcaggctcccaagtagctaggctacaagcacacaccaccatgcctaattaaaaaaaatttttttttgtagagacagggtctcgctatgttgcccaggctggtcttgaactcttggcctcaagtgatcctcctgccttggcctcccaaattgctgggattacaggcatgagccgctacacatggctcatattctcaatagagcagtcccaattggccactgaccagccaatagtcttgctctcctgggcagatgttcaccctggtccaataagccacagctatggatatgaaggtctgtgatctcaaattgagctagagggggaagatgggcatggcagaaaaatctatcaatctctgctacaattaaatatctgaggtcagacatggtggttcacgcctagaaacctagcactttgggaggctgaggtgggtggatcacgaggtcaggagttcaagaccagcctgaacaagatggtgaaaccctgtctctactaaaaatacaaaaattagctgggcatggtggcaggcacctgtaatcccagctactcgggaggctgaggcagagaattgcttgaacccaggagatggaggttgcagtgagccgaaatcgtgccattgcactccagcctgagcgacagagcgagattctgtctcaaaaaaaaaaaaaaattgaatattggattattgaaacttggcatagagcagccactgtccttgtcttctaagagcttatatcatattattattttattattattaataacatatcattattaattaatagctgcagttcactgaacagtattagataccaggcatggtgcttgtaattagtcatctcattgaattcccttaatgacaattaggtagtcagagacctttcttcatggatcgcaaccccaggggcatgtgggatttcagagatgtgttttggggaaagaggtataattattcaactttcagttaattagccacttagagaaattaagtggtaggtggagttgtaaaggaaggcaaagtactgggcaggcagatgctaagtgggagactgttctaggcataagagaaatgggggtgggtatgaaaaaaagcaagagagagagagagagagagagacaagggaaatttggtttgactggataaaaaggccagtgaaaagagggagttttggtaagagctatgccatgggcagggagaagtacagagatcttcaatcatggactctatagccatcccctcttctcttcctgcaggtgggcagagccaaggtcccctccctacaccttcctggggcctccagcgatcctgagctcagcctcctgacctgcagacccctcagctctggccctcacgtcctgcttgctgtacctgctttatcccatgtcaccatctccattcctcagcatagtgacaatcccagttcctacccattccactggcttctccatttggcttggagctctttagctggattgagacgactactctgatgagtgccatgtcactggctcaacaaaatgggcccaagtgagtcaatgtcattgacatgaaggtgctgtcagtttggtgggaaccaagggaatgagactgtgttttagctgcgttcgtttgaacagttacacacttagggcttcttatgcggatgctcagagagaaatatggaagacgagatctcgtagaaaacaagaagacatgttgtaaatgagtcaggcctcctggagtccaggactagggaggaactctttattgaggatcactcgagggagtcttggggctggtggtcttcacgccacagccccataactcagctcctctcttccttctctcagtctctctgcttctgttttttgtctcatgtcctaaatgtccaactattcagcataactttattctgcttcccctctctatcctctgtagcaaaatgcactgttggaattacatttttatttttatttttatttttttaagacggagtctcactcattgcctaggctggaatgcagcggtgtggtctcggctcactgcaacctccacctccaaggttcaagtgatccccttgcctcagcctcctgagtagctggaactacagatgcctaacaccatgcccagttaatttttatatttttagtagagatgggatttcaccatgttggccaaggtggtctcgaacccctgacctcagatgatctgcctgccttggcctcccaaaatgctgggattacaggcatgagccaatgtgcccagctggaattaaattaataatttttatttctgctttagcgagagaggcggtgactcactgatacaaggaagatatttccccttccaagggtgatgtattcagcttttgggtttaaaaggagatgctatcaggcacgcgtggctatcctggcagattacataaaaacacagaagaaatgttctttgtgttaaaagaataaaaaagaaaaaacaaaacgtgtttcctcaaaaacttaaatacagaattaccacatgacccagcaattctactactggctatatccccccaaagaattgaaggcaggaacatgaataggaatttgtagaaccatgtttataccagcattatccacagtagccaaaaagtggaaagaaactaaatgttcatctacggattaacagacaaacaaaatgtggaatatctgtacaacagacttattattcagcctttaaaagaaatgaaattctgggccaggcgcagtggctcacacctataatcccagcactttgggaggtcgaagcggcagatttcttgagcccagcaacatgacgaaaccccatctctccaaaaaatacaaaaattagcccagtgtggtgatgcatgcctgtagttccagccactgggaggctgtggtgggaggattgcttgagccctggaggtcgaggctgcagtgagctatgatggtgccactgcactctaacctggatgacaaagcaagatcttgtctcaaaaaagaaagagagcgagagatggaaggtaggaaggaaggaaggaaggaaggaaggaaggaaggaaggaaggaaggaaggaagggcggactagttagaggcagtcaacccatccattatttgaatgagagcatctcttctgtgttagttggactaaaggagaagctgccagaactctcaaggggaatgagaaaatggaagggaattgaggctttggttctataaggtagtagacacctgagccacattccagtaccttattccaggacctatcaatgaccaggagatgccagggcaaggacaccataggaaagatgccagcgtgggtggcccattgtgtgctagatttgagactgatcccagcacccaggcaggctgcctccagcaggcggatgtttgcctggatgtttgtctggctctgttctgcagggatgctgtggtcagtcttctgatcatcacagaattctttggctaagagtaaatgaaagcccagttaaaacgacttaaacaatatttcagagagagagagagagagagagagagagaagtcccaaggtagggtggctcctgggttagttaactcagcggttcaaaccaagttctttccatcattctgctctaccacccagagcgtgtcatttcagaaaggccatctcttcttgtgtctctttcttaggaatgactccttccttctttccttccctccttccttcctggcttctttcctactttccttggtttcctctgtccctccctcctgccctccctccttccttccttgatgggctctcactctgtcacccaggctggagtgcagcgatgtgcaaccttgactcctgagctcaagtgaccctcccacctcagcctcccaagtagctgggactgtacgtgtgcaccacccacgcctggctaatttttaacatttctgtagacgggcttcactatgttgcccaggctggtcttgaactcctgatctgaagcaatcctcccatctcagcctcccaaagtgctgagattacaggtgtgagccactgtgcccagcccctacatctttctttagaagccccccaacaagtttcctctcacgtttcatagccatatactcattttcatatccattcctacacgagtcaaccacaagcagaatgagactaacgtgatactcctgaattggggatgaagctgtctttctcaagggtttcaaacccgaacaaaattggggattctgttaataaggaaaatagaatgctttatttatttatttatttatttatttatttatttatttattgagacagggtctcactgagcactcaaggctggagtgcagtggcatgatcacggctcacctcgacctcctgggctcaaatgatcccccacaattgccacccagcttccagagtagctgggactataggcgcatgcccaccacacctggttattttttctatttttttgtagagaaaaggggtctcgctatgttgcccaggctggtctcgaactcctgggcccaagggatcctcctgcctcagcctcccaaagtgctgggattacaggcattagccactgtgccctacctaaaatggattttgaatgggcaactaggagtgtctgctacacccctgatatggacgagctctaaggattaacggacacgtgggaaggactgtttcaagcacgcttctattaccaattaccgggtagggatatgacccacactctgggtaaatggtggctcacctacagattctcattccagcctgtgagatggagaaagggaagagtggggtgtgctctttatttttaaggtcctgacctctgcatacaaagttccctctacttcctgacctgagtaagacctggctcttccctgacagtcctcgaagcccttcccaggggatggtagtccgtctcccacccccatggtgtcctctatgctccacacctctatttccagatccatagtcctccatcttgagtaagcactgaggctcctgacatctagctgtaccaccttctgtgccttctcattgatgatgcctactcatcaatcaatcaatcaactgttattctcagagggctttggcaactggcttacctttctcgccccagttcctaccgccatattggtgactttaatgacccaggacctggccgaactcctggcccttcagctcctgtcccttcttattccaatgaccttcacctccactctactttagccaccatctccctggaccatgtactggccctcagtttctcctggaacgaatcttcctctaaagtctcacatttctctgatcacagacttgtaccttctgttcttttgatcattccagcttagcagttcttcgaactccaggatcccttggcccttccactttctccctctcaggaccctccttcctccaattcctttcccatccagcctagattccatgatctttgctatacccagtcatggatgttgtgaatgactccccaacatccattccaacccagacggttggtccaagttggtcatggtcattccctgtctcttatcaggagagaaacagtcatgtgactcacttctagttctagagggtagagtgaggtggggtaaagaggactctgggaaagattttcccatgaaagagacaaaagaactgatgatctttcctcctgaggatgaacccagcaacaagggtggcagtgcatagagacaggaagaacccagatctttgatgatgttgtcaaaccactaaatcaaccccatctgaagtatcttcccccaggatatcccaatacatgaaataataatttatttcatatttaagccagcttgagtcaggcattctgctactttcagacaaaacaccctaaataacttaatttgcaacttgcagcaaaagcccagtcctggatcaatgtaaatttccttccattctgtttttatacctgttctgcttagactggtggagaaaacaataggtcctcagtcctccagaaacctcagacgtctctctacccatccaccattaggagagcgtttccccatccatctccagcctttgtttagggttgcagaagacctgcgttgttatgtgaagtggccagctgtcttgactaggaaatagatattttttaaagttcccaaggatagcatggatatttggcttgggtagaggggaacagagggaagatcttgaggttaaaagaaatccagcattcataaggaggtagggtagttatactcagattaagttgaatgaacgaagtcattcccagtggctgagttgagttaggggacaaagagaagcttcctgccccgtgttgtggcctggcaggggtgcaagccccaggggagggtgacctatgggcagagcaactgaatcagccttttgctcctgtatcttggacctgactagctactgtcccagtaacacatgtcaacaccataacaaacatagtagataccaatgatgacacatcttaaaactatgtgaaccagttggcaagtcctggtggttactgagtgtggaggtaggaggcggttcctattggtgggaaggcccaggcctctaccataatctcagtcacctagactgttggcaataacaaattcatggtctctaattcttaccactactctggaattcctgttttccctgttggctctctcctcccattcaccatagcaactattttgaatcttctctacactcatcccacctcccacctgcctgccttccctctcactctcaggcacctctgcctccccttccttccttgcttccttccttccttcctccctccctccctccttctctctttctctttctttctttcgttctctttctttctttcttttctttctttttctttctttctttctcctttctctctctctttctttccttcctccctccctccctccttccttccttcgaatcttctctatactcatcccaccatcccacccacctgccttccctctcactcttaagcaactctgcttcctatttctttctctctctctttctttcctttctctctttctctatttctttcttttttttttttcagagtcttgttctgttgcccagactgaggtgcagtggtgcaatcatggctcactgcagccttgacctcctgggctcaggtgatcctccctccttagcctcccaagtagctgggactactgtgcctcctatttcacacagaaaaaaaaaatttttttattttcgtttcattatgttgcccaggctggtctcaaactcctgacctcaagtgatcctcccacctcagcttcccaagtagctgggactacaggtgtgagccacctcacaaggcttcacacaaaatagatgccatctatctgattgggactatccttaccttgcttgcttacctgcaactgttgtagcactgtccagttgagctttctatactgctgggtaagtaccgtatatctttgctgttcaatatggtagccattagctacagggggctatcaaaatatggcttgtacagctgaaaacaagaattttaaattttacgtcattttaattaatttaaattgaagtatgtgtgagtggctgccctattaggcagcaccagttcagcataactaaaagaaaaacatttgtggataccaaggcactggggtttctgcgaaccctctgacatcactaggcaatagactctcgaccaacgattataggaattctgaattaggtgatgagaaggaagtaagatagagtttaaaaaaaaaaaaagtacattcggcagggtgcagtggctcacgtctgtaatcccagcactttgggaggccgaggcgggcaaatcatgaagtcaggagttcaagatcaccctggccaacatggtgaaaccttatccgtactaaaaatacaaaaaaattagctgggtgtggtggcgcgcacctgtagtcccagctactcgggaggctgaggaaggagaatcgcttgaacccgggaggcggaggttgcagtgagcagagatcacaccattacagtccagtccgggcgacagagtgagattccgtctcaaaaaaaaaggaaaaagaaataaaaaaggcacattcactgagaaattgccccggagaaataaagaggaaaaaaatattgctttgacgtgttgttttagtcgtggcagttatgaagaaggaaaccacacagtgaaccatggctggaacattggttccatggtggtacatggctctgtacacatgacagagaagaaaagccttgtatcatggctgcaaagccccactggtactgacatgctcacagcgtctgtgggaggaaagatggaacaccagccacgtagagaagagagtgaggtgtcgtcatcagttgagtaacttcaaagagtgtccagttatctttgtttgcactttctacctttcatgcaaaatgtgtgcaacacaaacatatgggtaacttgcacgtcccattttgtgtagctgattttgctcacttttggagactctgctcctggggcagtcctggagaaacagccgagagagcaaaccagctgaacactcattattttcttaagcagtagatagctgcaaaagctccatttcgtttcttaaacagtttctttcagtctctttacctgtaggtatgctagtttacaaggactccagatggcctgggagcttcagaaccttttgccaattatcagaggaaggtaaagcctgctggaaaccagagcaacgcagaatcagggactccttgctatctttagaccattaatatatcattataatactaaaattcccacccagagaagaaaattgctattttcttttttctttttttcgtttttctttttttgagacagagtctcgctctgtcgcccaggctggagtgcagtggtgcaatcttggctcactgcaacctccacctcctgggttcaagtcattctcctgtctcagcctcccgagtagctgggattacaggagtgcgctgccacacctggctaatctttgtagaaaattgccattttctaaacatgcatcctgtgaagagacatgtttatgatttgcacctgcacatctaaagttcctccctgcacaaacatacaaacctccccgccccatatctaactccttaaaattccccagctacccacatcttggggaggaggaggtgtctctggagcaagaggtcattccttctccttctctggccaaagaataaatcctgcttgccttcctccccgcaaccctccaatttgtgttctttctttgcaactgacacaaagtagggaaaggactcagtttacccatggcagttctatcacattttaaatagttacacacctttgcaaatctgtaaagtttgagtacattttcctgtctcctctgacctcccctgaacgagcagccaattgtttaaagatcctatttggagaaatttctttctcccctgatttaaatgcttttattgcacactaagttcctactcttttttttttttttttcattattgcatacagagtctcactctgtggcccaggctggagtacagtgacataatcttggctcactgcagccttgaccttccagggtcaagggatcctcccatttcagcctttcgagaagctggaactacaggtgtgcactcccgcaactggctaatttttttattttttgtagagacagggttttgccatgttgcccaggctggtcccaaacttctgggctcaagcaatcctcctgctttggcctctcaaagtgctgagactacaggtatgagccaccgcacccggtctgcacctatctttgtgtttaatacgtgactccaccctgttccaataatgtgtctgtcagttcccttactagagctgctttaattacacagatttaccatcgctcttaatatctccgtggtcaccggtttatttgtgaagtgttcaccccatggcctctggggactcactgtctttcggctttcctctcctccctactctgcctcagcttagtctccttggtgttggtgtccttcagggatctgtcttcggtccccctccatgtcactctaccctctccctgggcagacccctggctccactcttgccccttccgcccattttccatggtgcagctagagtgctctgactgagctgcaaatgagaccatgcacacccgtttataaacccacctattgttctcagggtaaattccagacagactctttaacaccagaacataaggctggacgagattcaggtccaagtagtttgtttgggaggcgacccaggaagaggagtggggaagtgagacaggaaagggaaggcagtcaacacaggaagcattaaagagtaggtcaggaggccggacgcagtggctcacacctctaatcccagccctttgggaggctgaggcgggcggatcacctgaggtcggcagttctagaccagctagggcaacatagtgaaactccaactctactaaaaatacaaaaattagccgggagtggtggcacgcgcctgtagtcttagctactagcgaggctgaggcaggagaatcgcttgaacccgggaggcggaggttgcagtgagccgagatcgtgccactgcactccagcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacccccacaaatgtatacctaacatgccaaaatggggaaaataaaaggatcttacccaaggtattccccaagggttaaaacatcacgtattaacttcgtaaaaaaaaaaacactgtgtctaggtacaaataaacttaatagaggcaaacacatttaaatttgcccaaaaattaaacccccttacaaaaaatgggccttcctttataaaatttaattaaaacggcaataaacattcccgttgcaaatctttttttattattttttgagacggaattttgctcttgctgcctgtgctcccaattgcaaatctttttttatttttttttttgagacggaggtttgctcttgctgcctggtctcccagttgcaaatcctttttttttttttttttgagacggagttttgctcttgctgcctggtctcacagttgcaattctttttttttttttttttttgagacggagttttgctcttgctgcctggtctcacagttgcaattctttttttttttttttgagacggagttttgctcttgctgcctggtctcacagttgcaattctttttttttttttttttgagacggagttttgctcttgctgcctggtctcacagttgcaattctttttttttttttttgagacggagttttgctcttgctgcctggcctcacagttgcaattcttttttttttttttttttgaaacggagttttgctcttgctgcctggtctcacagttgcaatttttttttttttttttttgagacggagttttgctcttgctgcctggtctcacagttgcaattcttctaagaatcatcccactgccgggcgcggtggctcacgcctgtgatcccagcactttgggaggctgaggtgggcggatcacctgaggtcaggagtttgagaccagcctgaccaacatggagaaaccccgtctctcctaaaaatacaaaattagccaggcatggtggcgcatgcctgtaatcccagctacttgggaggctgaggcaggagaatcgcttgaacctaggaggcaggggttgcagtgagcggagatcgcgccattgcactccagcctggacgacaagagctaaactctgtctcaaaaaaaaaaaaatcccacttaaggcaaccgttttcttcttagaaatatgaaagtaagaatttgctttgttttttggatttttctcctccaagaacaccagaaaattctattctaggcaaacagatcttgttgtcctgacaacagattgccaagaaaataagtaaacaaagcatctgaatcatatttttacagaaaacttgaacagtacaagggaggggctggaagcaagagtgtaaaattacctcacccccaaggacagcactgtaatttcctgcggaggtttcatccttcctttctgaaccgtgtgccgctcatgttgctcactggaatgttccacctcccaaaccttgaacatccagatgcagacagcaggattcatcacaccaatgtactgggaaaggaaaagaaatctggggaccccaaactcactaagccaaagggaaaagtcaagctgggaattgggtcatgcaaacccgcctcccattttggttcctaaataaggtggctacaaagatgaaaagcgacacacctccctcacattttgcccacaaggaaattcctggcggcccccaagatctttaccctaaagcagttctgttgaagttctccaaggcaatgtaaatggatagcttatcttcacaggtgcgggggacataggacagaactcaaagtcatccctctactcacctgagacaaatgcgtatctgattgcttccttggccctatcttctatgttatcttatataaaaattcagattcggcccggcgcggtggctcacgcctgtaatcccagcactttgggaggccgaggtgggcggatcacaagatcaggagatcgagaccatcctggctaacacagtgagaccccatctctactaaaaatacaaaaaattagccgggcgaggtggcgggcgcctgtagtcccagctacgccggaggctgaggcaggagaatggcgtgaaccccagggggcggagcctgcagtgacccgagatcgcgccactgcactgcagcctgggcgacagcgagactcaaaaaaaaaaaaaaaaaaaaaaaaaaaaaaaaatttcagattcaccaagccaggcaaagggatgaatgactatttttcccctacccactctcacatgaaaattgtgtatttctcaatatcctgccctttcccctttaaatactgaagccttcaaaatcattttcggagaaaggcatacacctgtctcccaggtagttccttaactttggcaagtaagcctcctaaaatgattgagacttgcctgggtcattttctttgatttacagcacttgttgaatttttttttttcccattcaccaggacagtagaaaaacgctgtcgctagctaggcgtggtggcaggcacctgtaatcccagctacttaggaggctgagtcaggagaatcacttgaacccaggaggcataggttgcaatgagccgagatcgggccgctgcactctagcctgagggacagagccagactctgtctcaaaaaaaggaaagaaaaatgctgtggggctgggcacggtggctcatgcctgtaatcccagcactttgggaggccaaggcaggggatcacttgaggtcaggagtccgagaccagcctggccaacatggtgaaaccctgtctctgctaaaaaattcaaaaattagccaggtatgttagcacgtgcctgttatcccagctactcaggaagctgaggcacgagaatcgcttggacctgggaggaggaggttgcagtgagctgagatcgtgtcactgcactccagcctgggcaacagagcgagactccgtctcagaaaaaaaaaaaaagaaagaaagaaaaggaaaaaaatgctgtcaagtcaggctcagaggcacgcgcatgcagtcccagctacttgggaggctgaggcaagaggatcacttgagcctcagatttcaaggccagcctgggcaacatagtgaaactatctctaaaaaagaaaagaaaaatgctgtcagaaagaagatcttgagaagtttcacttcaacaggcagtgagattactagtcccaaacataaacaacatcatagaagaagtgatgggggcacagatgaggaggcttttcatttgtctcagcatacatcttcgaggaaaaaaactggccgggcgcggtggctcacacctgtaatcccagcactttgggaggccaaggcgggcagatcacctgaggtcaggagttctagaccagcctgaccaacatggaaaaaccccgtctctactaaaactacaaaattagccaggcatggtggtgcatgcctgtaatcctaggctgaggcagggagactgaggcaggagaatcgcttgaacccgggaggcagaggttgcagtgaaccaagatcacgccactgcactccagcctggccaacaagagcaaaactcggtctcaaaaaaaaaaaaaagaaagaaagaaaaagaaacaggaaaaaaaaaagccagtgtaaccacccaaaaatattaggaccaaatttaaaacactttgaacaagtagaaatattcagagtatggaggtgaatacaaaggcagcctggtgatgtgagaaagagcctaggctgtggagcccatcacttctggggctgaatcctgattctggtcctcaccaaggtcggggctgggtcaggcccaacctccagggcccgctttcctgcctgtaaaacagggatgatgtttagctcacaagcattagagatggtatgtgtggaagtacatagcagtgtctggcccacattgggcactacgtaaataacaactaatattatcgtttatgtgttcaacaaactgaaaaacaatgttcacaaaaacaggacagtacttttgaaaattctaagggtaggcccagccctggaacctatcagcagcgtggccttgagcaagtaacttaacccccttatgcctccatcctatcctgttcaatggaattcatgctattgctaactcttggaattactgtgaagattaaacgtgttaatatagctaagaacttaaaacagggcacacggctgctgggtagagttcccactgtgccaccaggtcagaacacctttttccttctctcccttagaggatacatcctgaagatctcgggtatagacccgaatgcctgctgcttaaaaagcttcaattccggccaggtgcggtgggtcatgcctgtaatcccagcactttgggaggccgaggcgggtggatcatgaggtcaggagttcgagaccagcctggccaatatggtgaacccctatctctactaaaaatacaaaaattagctgggcatggtggcgggttcctgtaatcccagctacttgggaggctgaggcaggagaatcgcttgaacctgggaggcagaggttgcggtgagccgagattgcgccattgcactccagcctgggcaatagagcgagactccatctcaagaaaaaaaaaaaaaaagaaaaagtttcaattccctcctcatttaaccttttccccatttaaccagacgatcaattcttatacccttaaaccactcatcatcacatcattatgaaattattgactcctttttttccccccaccaaatgctctatcaggagaaaagccagttagctgtcaccccgacagttctgagttttggggtcacaaatgtctctacttttcattcaacccactctgctatcagggaggagacaagcccctcaatcaacaaatctaagtcacagatagcaggagaccccagaccccttctattagctttggatttaggccctgtctccctgctagggtgaagctgccatcagctgagaggcgctttgggcaggctggcttttcaggtgtgcaaactgtgcagggctgtgggctcagaagggccctatattggtttaaggctctgccgttgctgtttgaaattattttatgttttttttttttgagacagggtctcactgtgtcgccccaggctggagtgcagtggtgcgatctcagcttactgcaacctccgcctcctgggttcaagcggttctcctgcctcagcctcccacgtagctgggattacaggcgcccaccaccatgcctggctaatatttgtatttttagtagagatggggttttaccatgttgcaaaggctggtcttgaacccctgacctcaggagatctgcccacctcagcctcccaaagtgctgggattacaggtgtgagccaccacacccagccttttaaatttttactttttaatagaggcctcacatttttagtttgcactggattccatgagttgcatagctggtcctggtcaggcgtgatgacatcaagcttttatgttggtatctgtggggtcacctgaacaacctgaccccatttattcaaccttctgctgaggcagagtagctaaggccacttcttaaattgaaaggctcttactttaaatacattaatcaaaaatgacatcagatgaaaaaatatacttgaaagaataaaaaggaactgataagttacctcctaagaggaagtagtacttttttttttttcttcagatagagataagctcttgtcacccaggctgcagtgcagtagtgcgatcttggctcactgcaacctccacctcccgggttcaagtgattctcctgccccagcctcccgagtagctgggattacaggcatgcaccactatgcccagctaatttttgtatttttttttttagtagagatggggtttcaccatgttggccaggctggtctccatctcctgacctcatgatccacccgcctcagcctcccaaactgctgggattacaggcgtgagccaccgcagccggcccccttaatttataatcaccttactcatgatgaattcctggacgtaatttatcatcatccctcatttatagagttaaatatagaaaaaaaaagtgcccatgcagaatatataagaaagccaacatctagaaagggactgaaaaatgctcctggtcattggtccaaaaattatgaaaaaatcttttccttcttaatctccagtcagggaccaacaagtcctcgtgagcagccacaggaaccacaagcgctggttcagtccaacaaggcagggaggcctcagaagaaagtccaagcctcatacagacctgcactgaccaccctggagagatctaccaattccaggaagagctcttgtctgagaataggtgctaaatgaatttacataatgatggagtgtgtacaatttctaatcaagatattggcaattttgcccagagagaacataatctgagatgcttgcactaacttgttagcaaaatacccatttattaagaaaaagttggtgtcctttgctaccaaaagggaagaaaaggggaataaaacaaatacgtagttactagcaacaaaataagacaaactaatcagaatgctgtttattgacaagatagggtgtcacaaatacatcatttatagggagagaggggacatgaacaagtccaaaatcttatactctgcacagcagcccagcagggatgtcctctctagagatggtttatcaagggtaccccatgagagggcagctcctgatgcagctgccggaagagcatcgcacaccggttcctctcctgggtcttccccagggtatggtagagtctggcctggaagtaaacgacgtccctgatgcgctctttgcagtcaacctttgcaaaatagttcttggcttcattgaggttctcgatggcagcctccagagctgacggaaaggggaaaataacacacacatttaactcaacccttcacgtatagttttcaaaacgtggtatttagttttatttgttcaacaactaccagaagattcttttatattctccattctttgagagagaaaaaacaaaccactagggtgaggttttcaaaaaggtctttaagactgggcgaagtggctcatgcctgtaatcctagcactttgggaggccgaggcgggtggatcacctgaggtcaggagttcgacgccagcctggccaacatggtgaaaccttgtctctactaaaaatacaaaaattagccaggtgtggtggcaggcacctgtaatcccagctacttgggaggctgaggcaggagagtcacttgaacccgggaggcagaggttgcagtgagctgagatcacgccgctgcactccagcctgggcgacagagtgactccatctcaaaaaaaaaaaaaaaaaaaaaaggccgggcgcagtggctcacacctataatcccagcactttgggaggctgaggtgggcagatcacaaggtcaggagttcaagatcagcctgaccaacatggagaaagccctactaaaaatacaaaaattagccagtcttggtggtgtgcgcctttacatattcaggaggctgaggcaggagaattgcttgaacctggaaggcggaggttgcagtgagccgagatcacgccactgcactccagcctgagctacagagtgagactttgtctcaaaaaaaaaaaagtctttaactcctgacttctagcctggtacttggctctatagggttaaaatagccattcacttgtcctcaatctttctgccaagcatgcatgtgaaagcactttaaatgctgcatgaaattttaatatatatttgtgaacactcagaacttaaatgctgtcccaaatttaatgtcttttcttcttctgggtcctaaactttcaatgctttctggaatagcattgcctaacagtcttcgtacagcttcctaccttctgctttcttcggctgatcgtaggaagctgctgaagccacctggcacttggccactaagaacatggcacgacctttgtccaggatagccccgtcagccaagatgggctcgatggccatgtggagaagacttaaggcctgttctgggattccaagaatgagctgaaaaagaaacatcatggcactgtacatacccaaacccactgcccttcaccaggaagcgtttcatttctggcagttctctcctgaatggctatctctggcttaccttttacctgacatgtactacgttaaaacaggaaccacattcctagaaaacacaacatgtgacaatctgatttcagactatgacaaatatagcagggggcggttattcacactatgaaaaggttcttgtctttacaaaaagatccagcattaatatcctttagcttggtgattctgaggggttgaactaggtgggagaaaggtaacaatccagaaaataactcaaaagaataaagcaaaagaaacaagagattccggttggtgttagtatgtttaaaaaaaaaagagagaattaaaatggtacactagagctgggcacagtggctcatgcctataatcccaacactttgggagcatgaggcaggaagatcacttgaggccatgagttcaagaccagcctgggcaacacagcaagaccctgtctcaaaaaacaaatttaaaacaattagctgagcatggttgcacatgcctgcagtcccagttactcaggaggctgaggcaggagaatcacttgagcccaggaggtcaaggttgcagtgagccacaatcgtgccactgcactccagcctgggcaacagagcaagactttgtctcaaaataaaactagaaaacatctacttaacacacaagaaagcagtaatggaggaactgagggacaaaaaagatatgacatatagaaaacaaggcaggcgcagtggctcacatctgtaatcccagcactttgggaggtgcaggcgggcagatcacttgaggtcaggggttcgagaccagcctggccaacatggtgaaaccctgtctttcctaaaaatacaaaaattagctgggcatagtggcacgcacctgtaatctcagttactttggtggctgagacaggagaatcacttgaacccaggaggtaatggatgcagtgagcagagatcacaccactgcactccagcctgggtgacagagtgagactccatctcaaaaaaaaaaaaaaaaaaaatcaaattagaaataatgacattaaaggtaaatgagttaaactctctaattaaaaggcagaaattgtgagaacaaactttttttttttaaagtatccactgtatgctgtctacaagagactcactgtagattaaaagacacaaatagtactttaaaaattagtcaggcatgatggtgctctcctgtagtcctagctacttgggagactgagttgggaggatcccatcagcccaggagttcaaggttacagtgagctacgattgcagcaatgcactccagcctggacgactgagtgagaccctgtctctaaaaaaataaaataaagacacaaatcagctgaaagtaaaaggatagaaaaatattccatgcaaacaataaccaaaagaaagctggagtgcctatatgagtatcatacaatatagagtttaagttaaaaaccgttacaagagacaaggaaaaaggaggacattatatactcatgaaacagtcgattcatcaagatataacaattataaacaagccaaacaacagtgttccaaagcatatgaagcaaaaactgacagatttgaagggagaaatagacaattcaacaataataggccaggcacagtatctcatgcctgtaatccctgcactttgggaagctgaggcaggtggatctcttgagaccaggagtttgagaccagcctgggtaacatggcaaaaacccatctctacaaaaatataaaaaattagctggttatggtaaggcacaccagtaatcccagatgctcagaaaagtgaggtgggaggatcacttgagctcaggcagttgagggtgcagtgagccatgattgtgccatggtattctagcctgggcaacagagtgagactctgtctcagacaaaataaaacaaaacaaaaaccacaataatagttggggagctcaatatcccacctttcaatcgcagatagaaaaattagacagaagatcagcaaggaaagagaagacttgaatgacactacaaatgaactggccctaacatatatatataaagcatgccacccaatgatacatcagaatacaaattattctcaagtgcatatggaacactttccaggatagactgtgtttgggccacaaaataacactcaataaatttaagaggaatgaaatcatacaaagaatctcctctgatcacattaaatcaaaaatcagtaacagaaggaaaccagaaaattcacaaatatgtggaaattaacatactcttaagtaaccaatgtgtcaaagaataaatcacaagggaaattagaaaatgcaatgaggtgtataaaaataccacagactctggctgggcgcagtggctcatgcctgtaatcccagcactctgtgaggctgaggcgggtggatcacctgagggcaggagttcgagaccagcctggccaacatgatgaaaccccatctctactaaaaatacaaatattacccaggtagccaggcacagcggctcacacctgtaatcccagcactttgggaggccgaggcaggcagatcatgaggtcaggagatcgagaccatcctaacacgatgaaaccccagctctactaaaaatacaaaaaaaaaaattagcctggtgtggtggcacatgcctgtagttccagctactaaggaggctgaggcagaagaatcacttgagcctgggaggcagaggatgcagtgagctgagatcgcaccaccgcactccagcctaggcgacagagcgagactctgtcacaaaaaaaaaaaaaaaaaaaaaaaattaccctagtgtggtggtgcacgtctgtaatcccagctacttgggaggctgaggcaggagaattgtttgaacccaggaggcggaggttgcagtgagccaagactgtgccactgcactccaacctgggtgacagagcaaggctctgtctcaaaaaaaaaatacacagactctcatttatgaaatttgtgggataaactacaaatttatgaaatatagttctcaaggaaatttataactgtaaaggcctacattacaaaagaaagaagatctcaaatcaataagcgaatcttccaccttaagaaactagaaaagaggccgggcgcggtggttcacgcctgtaatcccagcactttgggaggccaaggcggatgaatcacctgaggtcaggcgttcgaggccagcctggccaacatggcgaaaccccgtctctattaaaattacaaaaattagccaggcgtggtagcatgcgcctgtaatcccagctactcgggaggctgaggtaggagaattgcttgaacctgggaggcggaggttgcagagagccaagattgcaccattgcactccagcctcggtgacaagagctaaactccatctcaaaaaaaaagaaagaaactagaaaacgaaaagcaaactagacctaaagctaactaacagaaccaaggaaaaaataaggattaaagtggagataaacaaaatggagactaagagaacaacagagagaatcaataaaaccaaaagttggttctttgaagagatcgacaaaattgataaactgttagactgaccaagaaaaaagagacaagactcaaataaccgaagtcagggatgacactggggactttactaacaaccttacaaaagtaaaatggattatacaagaataccatgaacaattctatgcaagaaattagataaaaggtaaaatgaacaaattcctagaaagaccaaactactaaaattgactcaagaaacaggaaatctgaatagacctataacaactaaagagactgaattagtaaccaaaaaaacttccaacaaagaaaagcccagggccagactgcttcactggtgaattttaccaaactttaaaacaattaacaccaatccttctcaaattcttcccagaaaaaggagaagagagaatactttctaactcattttgtggggccactattaccctaatactaaagccaaagaaagatatcacaagaaaaccacagatcaacatcctttatgaatacagatgcaaaaattctcaacaaaatacttgcaaaccaaatccaatagcacgttaaaaggaacatacactatgaccatgtgaaatttactccaggaatgcaaggtagttcaatacacaaatatataaataaaatgaaagaaaaaatcggggctgggcgcagtggctcacgcctgtaatcccagtaccttgggaggcagaggtgggtggatcatgaggccaggagttagagaccagcctgaccaacatggcaaaaccctgtctctactaaaatacaaaaattacttgggcatggtggtgcacacctgtgatcccagctacttgggaagctgaggcacaagaactgcttgaacctgggagacagcctgggagacagaagttgcagtgagccaagactgcaccactgcattccagcctgggcaacagagtgacactctatctcaaaaacaaacaaacaaaaacccatatgatcaaatcaatcaatgcagaaaaaaaaaatttgacaaaatccaataccttttcatgaaaaaaacactaaataaactaggaatagagggaacttcctcaacctctataaaaaacccacagctagcatgatatttgatgatgaaagactgaacgctttccccctacaggaacaaaataaggacatacactttttttttttttgagagggagtcttgctgttgcccaacctgtagtgcagtggcatgatctcggttcactacaacctccagctcctgaggactgagttcaagtgattctcagtcctcagcctacctagtagctgggattacaggcatgcaccaccaccactacactcagctaatttttctatttttagtagagacggggtttcaccatgttgtccaggctggtctcgaactcctggccttaagtaatctgccttggcctcaaaaagtgctgggattacaggtgtgagacaccgagccaagacacacacttttgtcacatttattcaacatgtattggaagttttactcaaagcatttaagcaagaaaaagaaatacagggcatctaagtgggaatggaagaggtaaaactatctctatttgcagatgacatgatcttatacatacaaaaccataaaaaaaaaatccccaaaacctgttacaggtaataagtttggcaaagttgcaggatataagatcaatataaactagcaacccaaaaataaatgtttaaaaaaatttcatttaaattaccatcaaaaagaataaaatacttagggataaatttaaccaaagaagtgaaagatttatatacagaaagctacaaaacattgttgaagtaagttaaagatccaaataaaaggaaagacatcctgtgttcatgggttggaagagaatagcattaagatggcaatgttctccaaactgacctacagattcaaatacaatccctatcaaaattacaactactgtttttgcagaaatgaacaagctaattctaaaatcaacatataattgcaagggatgctgaatagccaaaacaatcctgaaaaagaacaaagactcccacttcctgatttcaaaacttactacaaagctatagtaatcaaaacaaagtagtactggcataagggtaacatatagatcaagggaatagaattgagagtccgaaaataaacctatatatctacgatcagttgttttcttttttttctttgatcaactggtttttaacaggggtaccaaaaccattaaatggggaaagaggagtcttcaacaaatggtgctagaataacctatatccgtatgcagaagaataagagtggagccctatctcatagtatatacaaaaattaactcaaaattattcagacttaaacataagcattaaaactataatactgtgagaagaaaacatagaagaaaatcttcatgacattagatttgtcagtatcttagacatgatactaaaagcacaagcaacaaaagaaaaataaattggacttcataaaaattttaaacttttgtatatcaaaagacactaacaagaaagtgaaaagaccaaacacagaacaggagaaaatatttgtaaattatatatctgataagggtctagtatccacaatatataaataatttttacaagtgaacatcaaaaagataaacaacttagttaaaaaacaggtaaaggatcggaatagacgtttctccaaagaacatatgcaaatggccaataagcacatgaaaagatactcaacatcattagtcattagagaagtgcatatcaaaaccacaatgagacaccccttcatacccactaggaaggatgtaataattaaaaatggaaaataacaagggtgggcaagattgtggagaaattggaaccctcatacattgcaggttgaaacaaaatggtgcagccactgtggcatttccttaagaagttaaacaaaaaattatcatgcctcagcaattccgttcgtaggcatcaaatgaaaacaggtattcaaccccgggcgcggtggctcacgcctgtaatcccagcactttgggaggccgaggtgggcggatcacgaggtcaggagatcgagaccaccctggctaacacagtgaaaccccatctctactaaaaatacaaaaaaatagctgggcgtggtggcgggcgcctgtagtcccacctactcggaaggctgaggcaggagaatggcatgaacccgggaggcggagcttgcagtgagccgagattgcaccactgcactccagcctgggtgacagagcgagactctgtctcaaaaaaaaaaaaaaaaaaaaaaaaagaaaacaggtgttcaaacaaaagctgtacagaaatgtaaagagccgctattcataacagccaaaaggtggaaacgactcaaatgcccatcagctgatgaatggataagcaaaatgtgatctaaccatacagtgaaatattcttcagccatgaaaaacaatgaagcactgatacctattgctacatggataaaacctgaaaacatcaagctaagtaaaagaagccaatcaaaaaaggccacatttatatgagtccagttatgcaaactgttcagaataggcaaactcatagagacagaaaccggtgagaggttaccagaggctgggggaagggaggactggggaatgactgcttaatgggtacagtttccttttctatgtaatgaaaatactctgaaattagatagcagtaatggttgcacaatgttgtcaatattctcaaaaccactgaaatgtacactttaaaatggttaaagtggtaaatcttgtgttacatactttttttttttttttttgagatggagtctcgctctgttgcccaggctgggagtacggtgtcacgatcctggctcactgcaacctccgcctcccagggtcaagcgattctcctgcctcagcctcccgagtggctgggattacaggcacgtgccaccacgcccggctaatttttgtatttttaatagagatggggtttcaccatgctggccaggctggtcttgaactcctgaccttgtgatctgcccacctcagcctcccaaagtgctgggattataggcatgagccaccacacctggccatgtacattttatctcaagaaaaaaaaaaagaatcactgaggaaggtagtaagaaacagattccttagctccacccctagagattctgactccgtaggtctgaggcaaggcctcaggtacgaagatattttttaaatctccgcaataattctaatgtacagccagtttggagaacctccactttaattaataaattcttccagtgcatttgaccttcactcattcattgattaatatttattgaaagccttctatgtgtagggcctataaggtactagggaatatagatgaaaatgaagagtcaattccttcatggcctttactgggggagaaagaaaacaaacataaaatacaatttgatttccaaaagctttcaatgaacatctgtgttcctcatttctttattcacatccccttgttgctaaatcaagcatcactctgtgtcagctaatcattaatatgatgcaggtgttctcactgaagaggcgagtcctccttactgaatacacagctcaggaaagccagtgccactggaaagtgtcagtttgtcaccaggttcacacctccacaggcctccttggagggcttgcacaggaagactacctttccagacgtcaatatgaacaaatgaaaactcattattatcctttcaatactcaaacgtagtcacagactcaccagctcttgagcacaaatatgtgctataaaaacagagatcggcttacctgcgcaaaagccaagttcagcactgtttcagaggccaagtactgtaaccggtactccttggagagggccagagcctgcaggagcatgggcagcgcgatggtaggggaggaagatcgccagtacagctctgccacggacagtaggacactgaccgtaaagaggaaaacacaggatgagaagatccaccaccacatctccgtgagatgtacaagagaccccttacctgatcaccatttctgtgttcttcagtttctgacaatgaaccaacaatttttgtaaaagcttatgtgcctctgacatttggttctgagcttgtaatacaaccgctttcctgaaacagaatcaaaatgaacacaagtgttttaactagtcactttgagggtaagaatctcaatttattcaattgcgctataaacctcccaagggaaaaaactgtgcctgatttaatttttgttgaaagaggctgagcgcggtggctcacacctgtaatcccagcactttgggaggccgaggcgggcgaatcacaaggttaggagctcgagaccagcctggccaacatggggaaaccctgcctctactaaaaatacaaaaaattagctgggcgtagtggtgggcacctgtaatcccagctactcagaaggctgaggcaggagaatcgcttgaacccaggaggcagagattgcagtgagctgagatcgtgccactgcactccagcctgggcgacagagtgagactctgcctcaaaaaaaaaaaatgtttttgttgttgaaagaataaattgtatgtgtgtatgaatgtgtgtgtgagcatgtatgtgagcatgctgtgtatacacaaacacacacacacacacacacacacacacgcatgcaggaaaaattctggaattatagataacagcatgttaatgattatctctgggagatacttattttcttcattttgcttatctgtattttctttttttttttttggagatggagtctcactctgttgcctgggctggaggcaatggtgcgatcttggctcactgcaacctccgcctcatgggttcaagcaattctcctccctcagcctcccaagtagctgggattacaggcacccaccaccatgcctggctaattttttgtacttttagtagagagagggtttcaccatgttggccaggctggtctcaaactcctgacttcaagtgatgcgcccgcctcagcctcccaaagtgctgggattacaggtgtaagtcaccatgcccagttacaggtgtaagtcaccatgcccagctgcttacctgtattttcttatttattaagaaaataaagtttttttctaagctaaaataaattaatgcacatataaaacaaaaacaaaaccatttaacaattattttattctggggttagagttttcaaggtttcttacctataaacaccctctatgctattgagagctgtgattcctgtaacaagtgaatcagccaaatgatatttgccatcattcattgctctgtcaaactgtattttttgatcacatagcatccataactagtaagaaaaaaaaacacaattaagtacaaaatggcgaatgttcatcttaatgagtatatgaaagtattttggattgcttagcaaatatccttacaataattcacacatattcttttttggggggatttaaaatttttttaaaatatctcaagtatgtgaaaaagcacagagaataaaatagcagatacatgtgtgccaatcatcaactttgtcaactcacattttgctttatctgcttcatatactattagataccaatgaagtcctttgcaaattctacgtctctttctcttttttcaaagtaggcactcaatttggtatttatcattctcattcaggttttttatacttttacaacatatacccttgtctctaaacaacatagagtatgagcctgtgtttttaaactttatataaataatatcatacttgtaagcatcctttgacaagttcctttttagctcaatattatttttctgaggggagattatgtcccactttatattataataaaagctatttttatcagaaataaatctattgccatgcaaaaggcagattacctgggcgtgctgactattaggcggaaatcgttccttcaagtgctttaacacttcagaagctgcagcaaaacagccctaaagtagaaacacacaatttgatcagcataacctgtgttgaatccacacctgctgtaccatgcacagatggtgacagattcacctgttcccgttcttgatgcagcaacctgagagatactggtcagagactcaaatttcttttctttcttttttttttttgggacagagtctcgctctgtagccctgctggagtgcagtggcgcgatctcggctcattgcaagctccgcttcccgggttcacgccattctcctgcctcagcctcctgagtagctgggaccacaggtgcctgccaccatgtccggctaatttttttgtatttttagtagagacagggtttcaccatgttggtcaggctgctctcgatctcatgacctcgtgatccgcctgcctcggtctcccaaagtgctgggattacaggcgtgagccaccgcacctggcctgtttttttttttgagagggagtctcactgtgtcacccaggctggagtgcagtggtgtggtctaggctcactgcaacctccacctcccaggttcaagcaattctcttgcctcagcctcccaagtagctgggattacaggcagacaccaccacacccagctagtttttgtatttttagtagagacagggtttcaccatgttggtcagtctggtctccaactcctgacctcaggtgatctgcccacctcagccccccaaattgctgggattacaggcatgagccaccgtgtccagcttacatatatttttataaattacttataacactgtttaccacatggtaggcatccaatgaatatttgttgaatgaataaatctttcaatgtcaataaatacaaatttatatcatcgtagtattttatcgggaaaatcaattatggtacatgaaaataatctggtttttgatattttggttatttctaatattttccatttaaaaaatgctacaatgaatatcttggtgcatagagctttgcatactggtccaattatttccttagcataaaaccttagaagtaggctgggtgcggtagctcacgcctgtaatcccagcactctgggaggccaaggagggcagatcacttgaggctagaagtttgagaccagcctggccaacatggtgaaaccccatctcgactaaaagtacaaaaaaataagccgggcgcagtggcaggtgcctgtaatcccagctactcaggaggcaaaggcaggagaatcgcttgaacccaggaggcagaggttgcagtgagctgagatcacaccactgcactccagccttggccccagagcaaaactccatctcaaaaacaaaaacaaacaaacaaacaaaaaaccttagaagtggaaatgacaggcacttttaagttctttgagatatattactaaattaccctatataaatgtaccaagtactttcataccagaactctgtgcttttcttcctctaacactgaagtatctttgcttatataattggtgaaagtagtaccttaactgctttaaatttaatttcaatgactagattgaaatgttttcatgtttttgggccatgctttctgtgaatgtacattcatgacttttttatactcttatattgtcgggatgtttatcttttttttttgagacaaggttttgctctactgcccaggctggagtgtagtggtgcaatctcagctcattgcaacctctacctcctaggttcaagcaatcctcccacctcagcctccctagtagctggaactacaggcatgtgccaccacacaccacacccagctaatttttgtatattttgtagagacggggtttcaccatgttgcataggctggtctcaaactcctgagctcaagtgatacgcctgcttcagcctcccaaagtgctgggattacaagtataaagataaacagcacccaactgggaggtttatcttattgatcccgaaatactttcaatttgtctcaatcctttcatgaggtaatgcactttttgtctacatagacgctcaggccacatgtggacttttatttgaagtgaataagcagaaattacatagaattacaataaaagatcattattcctgtgattttaactggccagtctcaccaattattttcatgaccgccacagggagtcgggcatggggatatagatcctgcagtatcccccaaaaatattcccatcgtggcctgcaattcctgagactgagagaggagtgatataagatgagctagaattacatggaaagagcaaaggagaatggttatattagaaaaagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccaggctcgagtgcagtggcacaatcatggctcactgtagcctcgaactcctgggctgaagtgattctcccacctcggccttcggaatagctgggaccaaaggcgtgcaccaccataccgggctaattttttaaattttttgtagagacaaggtttcaccatgttgctcaggctggtctcaaactgctgtcctcaggtgatcctcccacctcagcctcccaaagtgctgggattataggcgtgagccatcgtgcccagcctattgtttttaaataattaatagtttaaattttctcagttttaaattataatgtggtagatattaataaatataactcatataagtgaaagtgcttttgggtcttcaaaaaaagtttttttttttagagacagagtttcactcttgttgcccaggctggaatgcaatggcgtgatctcagctcactgcaacctctgcctccccagttcaagcgattctcctgcctcagcctcctgaagtggctgggattacaggcacccgccaccacgcccagctaatttttttgtatttttaatcgagtacaaaggcatcctgagaccaaaaagtatgagaacggctgatctagagcaggggctggcaaactacagcatgtgggccaaattcagccctctgtctggtttgtttgtttgtttgtttgttttgtatttttagtaaagacagggtttcaccatgttggccaggctggtctcaaactcctgatctcaagtgatctgtccaccttggcctcccagagtgctgtcattataagcgcgagccagtgcacccggacttgtttttgtaaataaagttttactagaacacagccatgccatttgtttacatcatgtgtgtggctgcttttgcgctatgactacccatatgtgtaagtagaaagagaaccagcttcaaagagacagaaatgggtgaagggatccctctgagcctcaattcctttgtccgtaaaatgagagtaataaatatctgacagaaaaacaaagcaggcaaaagaaagaagagaaaaaatagttaatgtgagtaacaaatactcttagggagcagtaaatacaactcagccctgcagtgagcggtctggtgtgacctggctctccctggaaaccagtggcggggtgtttgggtattaacaaagccagggcctccctccctcctgggcgcctccacccttttacctccaccagcttcaccacattggggtggtccagcttcttgaggatggcaatttcctggtacacctgctcaatggggcccctgggctggatgcagcctccaggagctggccgggtgcctcggggtggagggcgacctgaaggaaacaaaaacagacccagggtcagggcaaagagactttcctccgcagagggcagctgcaggtgggatgccaaaaggtgggatgccaaaaagccactctgcagggctggagtggctgctgccaccaggggctttaactaaccctctactcctctgtctcctctgctgctggaagtgagtgagggcggagccctcggccgtcctgtgaattccctccttcccgtcacatccccagtccatgccctggtccacagtgaaaggcaggagtgctgaggcaactgcagtctagctcagcaatctcaacacccagggtgagtcaatcacttcccctctctgggctcagtttttgcagtccataaaatggacataaacattaactcttatctccttaactcatagcacagatggctggctgggcgctatggctcatgcctgtgatcccagcactttggaaggctgaggcgggtggatttcttgagcccaggagttcaagaccagcctgggcaacacggcgaaaccctgactctataaaaatcacaaaaaattagggccgggcacagtgcctcatgcctgtaatcccagcactttgggaggccgagacgggtggatcacaaggtcaggagattgagaccatcctgactaacacagtgaaacactgtctcgactaaaaatacaaaaaattagccgggcgtggtggtgggcgcctgtagtcccagctactggggaggctgaggcaggagaatggcgtgaacctgggaggcggagcttgcagtgagccaagatagcgccactgcactcgagcctgggtgacacagcaagactcagtctcaaaaataataataataataataataataataataataatcacaaaaaattagtcaggtatggtggcacgtgcctgtggtcccagttactcaagaggctggggtgggaggatcacctgcgcccaggaagatcaagcctgcagtgagaagtgatcatgccactgcactcagcctgggtgacagagcgagaccctatcaaaacaaaaaacaaaaaaaacaaaaactaaatagcactgatgtaaaatgaagccagggagaagaaaagaagcaagcatcgggagagaaaaacaaaaggctatctagaaaggagaggcactcaggccaccgcttgatcctgcagtaaacaataggcagtcacaaggatgtacagacccacagtgaaaaccctcacgatggcacacatcccatgtaagtaaggctctgagtgtgactaacagaatagaacagggatgtgatcggccttggaaaagcaaaggcagaagtacaggtgtcagagggaggatgtgaaaggaggaaagctgagtccaaaggaaaagggagggtgtggggaggtgggagacacgcgtcatatagctggagagaggggaaagtggtagtgtgtgtccacagaggagctgaccatcaggagagcgttccactgcctgctggggaaagggaggtgctacggtcaggatgtttgtgctcctccaaaattcatatgtcaaaacctaatccccaacgtgatggtattaggagatgggacatttgggagaagagtaggtcacgaggatacagctctcatgaatgagattagtgctgttataaaagagacctcaggctgggcgcagtggctcaggcctgtaatccaagcactttgggaggccgaggtgggtggatcatgaggtcaggagatcgagaccatcctggccaaaccccgtctctactaaaaatacaaaaattagccaggtgtggtggtgcacgcctgtagccccagctacttgggagcctgaggcaggagaattgcctgaacccaggaggtgaagtttgcagtgaaccaagatagcaccactgtactccagcctggtgacagagtgagactctgtgactccgtctcaaaaaaaaaaaagaccccaaagagctgtctagcccctctgccatgtaaggatgcggtcagaaggcactacctatgtttgtttgtctgttttgagacagggtctgtctaccagactggagtgcagtggcgcaatcaagaatcactgcagccttgaactcccaggctcaagggatcctcccgcctcagcctcccgagtagctaggactacaggtgcacaccaccatgcccagctaatttttaaatttttggtagagacaggggtctcactacattgcccacactggtctcaaactcctgggctcaagtgatttgcccaccactgcctcccaaagtgctggcgtgagccaccgctcccggcctgagatggtgctaactatgaaccagcctccagaagtgtgagaaataaatatcggttaggttaagccacccagtctctcgtacgttgttacaggacaccatttgttattttgttaagacaagaggtaagaaggagtgtttaagcaagcgaaatcctctattgtcactggaagaagccagaagcagatgtcaaaaattgataatagtgacgtgaggattatgacctggtgcagcgtttggataagcaggataaaccagggtcctactgttaggatgggtttttttttttttttgagatggagtctcgctctgtcgcctaggctggagtgcagtggcgcgatctcggctcagtgtaacctctgcttcccaggttcaagcaattctctgcctcagcctcccgagtagctgggattacaggcacccaccatgcctggctacttttttgtatatttagtagagacagggtttcaccatcttgaccaggctgatcttgaactcctgacctcgtgatccacccgcctcggcctcccaaagtgctgggattacaggcatgagccaccatgcctggctgtttgttcttatctaatttctctttttggcccaagctgacattttgcccagcaatgctggcagggagcttatgttgaagcagcctctgatactctcacctgcagcctatcatctgaccacacacaggagctaccagcaactaaaagtgctaaaagccaaggctgcctataggagaaggaaagaggtcagcaagaaactggtctccatgatgagccctcctgtgctctggccttttttttttttttttttttttttttttttggggagatataattcaaatacctcggggggatttaaatttttttaattaatctttttttttttttttttttttggagagagggagtctcagtctgtcgcccaggctggagggcaggggcgcaatctcagctcactccaacctccgcctcctgggttccagcgattctcctgcctcagcctttcgagtagccagggatttacagaggcatgccaccatgccgggctaatttttggatttttttagaagaggcagggtttcaccatatgggccaaaaggatctcaaactcctgacctcgggatccccccaccttggcctcccaaagggctaggattataggcatgaccccccgggccctgctaaatttaccattttaaaaggggaattttaagggtttttagggctgacaaggttgggcaaccatccccattatctatggcatatttttttttttttttttgacccggagtctcgctctgtcacccaggctggagtgcagtcacactgacctcggctcactgcagcctctgcctcccgggttcaagcgattctcctgtctcagtctcccgagtggctgggattacaggcacaagctaccaggctcaactaatttttattgtatttttagtggggacggggtttcgctatgttggccagcctgatcttgaactcctaacctcaagtgatctacccgcctcggcctcccaaagtgctgggattacaggcgtgagccaccgtgcccagccctcctcaatttttttaaaaagaagcccttacgaatctctactaacaggtcagtaaggcaacaagcacagcctgaaagaagatcggtttcaaaagggaaatgcaatttcctcaactgttaggaaagagacacagacgcaaggctgaggctgcagcagcaccatgcagccagccggcctgaaccccatatccaggttctctaaccccatccaaagagaagaagtgagtgggaaagcaaaacatggaagaaaaatagcagtaggccagacacaatggctataatccaatcccagcactttgggagcctgagcctagaggatcacttgagtccaggagttcgagaccagcctgggcaaaatagtaagaccctgtttctataaagaaattaaaattttagccaggcatggtggcatgcacctgtagtctcatctgctctggtggttgaggtagaaggatcacttgagcccaggagttggagactacagtgagctatgatagcaccactgccctccaccctgagcaacaaagtgggatcccatctcaaaagaaaaaaaaaaagaaaaaaaaagctgggcgccgtggctcacgcctgtaatcccagcactttgggaggccgaggcaggcggatcatctgaggtcaggagttcgagaccagcctggctaacatggtgaaaccccgtttctactaaaaatacaaaaaattagccaggcctggtggtgtgtacctgtaatcccagccactcgggaggctgaggcaggagaatcgcttgaacctgggaggcagaggttgcagtgaaccgagatcacaccactgtactctggctcgggcaacaagagggaaactccatctcaaagaaaagaaaagaaacaaagcaaagcaataagcaatataagaccctctgatttaaaggaaaatctgaaatagcatttgccccaaatccccaggatcaggaaatgaaatgtttcccataaccaccagaagaaagtatgctggggcgggaagaagatcacaggtgaccctgagcaaattactcagcctctctgagcccttcatataaagaggcttccataaaatgagttgatagaataatggtgattctgtggcccatgttaaaatttgagccaaaatgccttgaaaacaggcttggcctgccccacttggcctggtcctctcccctgagagtggtgtctggccactcatcttccatctaggatgaggttctcaaagaggaaacccccggctactgcacaaagttccctgctaggtcaccccaccctatccccttcccctcctactcccatcccatctcccatttctggcccatccttcaaggctctgcacaaatgacacctccttcagggagcctcccagattcacaccagtctgaggagatttctccagaaccctcagtgccctgtgctccttcgatcacaacagcactcattccttgtggtgtttctcaacagtggcactgctggcatttgggggagggtgatttttttttgttttttgtttgttttttgagaggaagtctccttcttgtgccccacgctggagtgcaatggcacgatctcagcacactgcaacctccgccttccaggttcaagtgattctcctgcctcagcctcccaagtagctgggattacaggtgtgtgccaccacgcccagctaatttttgtatttttagtagagatggggtttcaccatgttggccaggctggtctcgaactcctgacctcaggtgatcctcctgcctcggcctcccaaagtgctgggattacaagcgtgagccaccacgcccagccaggggagggtgattctttatgtcgtggccctggcctgcctacaggacactttagtaggcatccctgactcccgcccactaaaagccaggagtgcttagcatcattttgacaaccaaaagtcgcccccacactttcccaaatccctgccaggagggtgggaccacccccggatgagaactagtgcattgttattagtgactatatttagctaccagcccactagccatatctaaggatgggcagtactacagaccctgcatagagctgcatcggcaaacactgatgtagtgaataaacaaaacaaaacaaactcctgggctcctcaagaagctcagggcagccttgccagggtctctgctcttgaacaggtgcacaaaggttctaaggcctgacatgcctgcactggctgtgtgaccctgagcaagttacttaacttctctgagcccttctataaaatggggctaaatcctagcaacactgcaggatttctgtaaacctcagtctcctaatctctactatggggttaaaattccctacgttgtaggatttggtaggcattaaatgagataatgcatgtaacacatagcacagaatctggcaggcagcaagaactcaatagatgttagtttttaatactgttattattattattgtccagggccaggtggcagctcatgcctgtaatcctagcacttgggagactgacgtaggcggatcacttgaggtaaggagttcaagaccagcctgaccaacatggtgaaaccccttctctactaaaaatacagaaattagccaggcatggtggtgggcgcctgtaatcccagctactggagaggctgaggcatgagaatcgcttgaacccgggaggcggaggttgcagtgagccaagattgtgccactgcactccaccctgggcaacagagactccgtctcaaaataaataaataagtattcttattattatccaagttaggggctcatcaaatgatggctattactcttcattacaaaaatatgttttgcgtcctcatcaccaatgcctgcttcctccataggaagggtgtgtgtcaccaatgcctgcttcctccataggaagggtgtatgagcagcagtctggaaggggtatgtggggcttgccctaaagctgcatttgcatggcatgcacactatttattctgaaactgcatgtttttgtggggtgattagggaagagggtggctaactcccccaaagccctccccttgttgcagcccccgcctcctccaaggaacaaaggagcttatggggacataaagccatcctcttctctctcctctgggggcagagctaggggagggggagtggtaaatggcagcacagctctagggcacctgaagtttctatcccctgcgtggagactccaaacaccaggctggggaaggtaaaagtagcctgtagggagatggacgctgcaggtcccatccggaggccaggtatccctctcttgctgatagcactgagacgccctccccaaagctcagccttctcggggagatcggaggggctgagctgcatcctgtccagcactaagtgagagtggccaggagggcaggctggcagagctgtgaaagcacccacttccccagctaggcagtgcaggggctgggggaaagccaggaaaagctcaaggctgggtcgggtggcaccccaggcacagagccccaatgctgagaggggctgggtccagtgtccctgagagtcaggcggacgcctctccgcattcacagcatactgcaaccccgaggtgaatttaggtcagaaggaccaagcctgtgaggctccggctgagagaagaggtgcggtgggggtggtcaaagggcagaccgaagacagccaaaggtcccctaggtccccacaactgctggcctagggtcctgccacctggtgtccaagccaccagggcctgggtttgccccgagacaggcaggctgcggggtgggggtgctccaagtccgctggtcctctcttccccggaacgctccagatttccccacctgtcaaacgcgaggggctgggcctaggccgcctccacgaaccctgacggacccggcccccggtgaccccggttccaaactccaggaccgcccctgccacccggacagggcgcggcccagccgaggaggccatcccgaggcccagggcgcccagaggacgcgggggaagggctgtcggggaccgtgtccctccacgtggcggggcgtggggaggcgcacgtggggtccctccgtgttgggagccccaggccagcctccgggctttgtgtgccatgccggcggcggtcccccgcctcgagagggaaacggagcgggcgcccggggccgcggcggctgcgtcccttgccccgggcccggctaccgccagctcacctgggctccgcgccgccgccgcctcccgcgctctgcgcccccagctcggctcggctcggctcagcttgctctgcgcggccgcgcgctcctctcctccgcccgggcggcgggcgcgcggggggcgggggcgggaggagccgcccggctcggcttgggcgcgtcgccgccccgggcagcgcggggattggccacggcggcgggaaacccgtgtgtaactactacatcctnnaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcaagtgagttcatcaaatcaatctcttattcttccctagtatttgtctttaaagtgctagattaggccaggcgcggtggctcacgcctgtaatctcagcactttgggaggccaaggtgggcagatcatgaggtcaggagttcaagaccagcctggccaacatagggaaaccctatctctactaaaaatagaaaaattagccaggcatggtggcatgcacctgtagtcccagctactcaggaggctgaggcaggagaatcgcttgaacccgtgaggcagaggttgcgatgagccaagatcgcaccactaaaccaacagagggagacttcggctccaaaaaaaaaaaaaaaaaaaaaaaaaaagactgtaatctcagcactttgggaggccgaggtgggtggattatgaggtcaggagattgagaccatcctggctattgagaccatcctggctaacacagtgaaaccccatctgtactaaaaatacaaaaaattagccgggcgtggtggcacgtacctgtagttccagctacttgggagactgaggcaggagaattgcttgaacccgggaggcggaggttgcagtgagccgagattgcgccactgtactccagcctgggtgatagagcgagactctgtctcaaaaaaaataaatacataaaaataaaaagcttacagtgatctgaatcccactcaagctgtgtatttgtatctgttacagacggaagcaaggaaggtaagtccttggctgatcagccctctgatttacctgggactgagaggtttcctggacaagggactttctgtgctaaaaccgggaaggtcgaggccaaacaggatgagtcggtcaccttcagaaggattaagtcaatggacttcaggaaggctgatgacaggctgtattaggccagaactctataagccattgacaccctctcctccttcccttgtccacaccaggcttcactctggagagaatggctaaacctgtactagttaaactcaaactttccttgaaagacagttttacagggcagtggggcggcgggggtggggggtcggggaaccaaggaaacaaagaaccctgaaacagatctgttagaaaagaaggggctattacaagaagcagggaggctttccaggaaatgtgccttccaaaaccctatttctggccggacgcagtggctcatatctgtaatcccagcactttgggaggccgaggcaggcagatcccttgagtccaagagttcaagaccagcctgggcaacatggcaagaccccatctctacaaaaagtacaaaaaattagccaggcgtggtggcacatgtctgtagttccagctactcaggagtctgaggtgggaggatcccttgagcccaggaggtggagagctaagatcatacaactgcactccagcctgggtgacagagcaagaccctgtttcaaaaaaacccaaaccagccgggcacagtggctcacacctgtaatcccagcattttgggaggctaaggtgggtggatcacctgaggtcaggagtttgacaccagcctgaccaatatggtgaaaccccatctctactaaaaatacaaaaattagccaggcatggtggtgggcacctgtaatcccagctacgtgggaggctgagacaggagaattgcttgaacccgggagacagaggtttcagtgagccgagatcgcgctactgcacttgctgtgggtgacagagtgagactgtgtctcaaaaacaaaacaaaacaaaaaccgtggggaatttttttttaaagtgtgaaaaaaaatagaaaactacatttcttgtgatcttgtatcagacaccttcaagcttacctgaaagtttgaatcaaaacaaaataacaaagtgtgccttttatataacttgtctcgttgtgaagacccatctgcttttttctctggtgaagacaggttttctgaaacacacagtgttgagtctttcccatccctcaacaattactggattattagctaaataagcattctccagcagatctaaatctgacacaacaagaatgcacgtttctttggctctgaacagcattttatcttttgaaaaccaccttcacgtgagtgatactcagaatcccattttacagttgagtaaaagctcaaactcatttgtttctgataaaacattctggaggtctccttgcaaatttttctggttcattatgcctccctttatcctccataagataatagttcatagcctatagtcccagctactcaggaggcttgagcccaggagttcaaagccagtctgggcaacatggtgagactatgtctctaaaaaataatttaaaaaaagatagccaggcagggtggctcatgcctgtaatcccagaactttgggaggctgaggtgggcagatcacgaggtcaggagttcgagaccagcctgaccaacatggtgaaaccctgtctctactaaaaatacaaaaattagctgggaatggtggtgggtgcctgtaatcccagctactcaggaggctgaggcaggataattgcttgaacccgggaggcggaggttgcagtgagccgagattgtgctgctgcactgcagcctgggcaacagagcgagactccatctaaaaaaataaaataaaataaagagataataattggtcgctaagagggaaggaaggaaagcaggactcctcagactccaaaactatcaacgtgttataacattttgcattttcagttgttttagaggtggataagaataacctttaagtccacataagaatcacaaaatgttctgttgagatttccccaattatttatttatttatttatttttgagatggattttcgctcttgttgtctaaggcgttaggtgtgtgagctacacaccgaatcatgagatacatggcatgcagtgatgtcagcacagccaacaggaagtgtttgtggagagtagcgccctatccctttcttcacttgcttccctttttctcgtttttctatctcatgagttccattctctgggcaataggaaattgagagggaagtggggtgactcagtacagttagtttcttttggctttctttgaagccgccctgcttcttgcaatagccccttcttttctaacagatctgggtcaagtttaactagcacaggtttagctactgtctccagagtgaagcttgggatggacaaggggagggggaatgggcatcaaagtaggaaattgagtgggaagtgggggacaaagtacagtcaatttctttgggtcagtggaggataaaagttgcttctttcctgccctaagaaatatccagaatgcttatctcttgcctttagtcattttaccctaacccaattagggttagcattagggctaaggttagggttagccttagggtcagccttagccttccatttggacaaaatctgccatttggccgggcgcagtggctcatgccggtagtcccagcactttgggaggtgaggagggcagatttcttgaggccaggagttcgagaacagactggccaacatggcgaaaccccatctctacgaaaatacaaaaattatctgcgtgtggtggtgcacacctgtaatcccagttacttgggaggctgaggcaggagaatcacttgaacctggtaggcggagtttgcagtgagccaagatcacgccactgtactccagtctgcacgacagagtgagactacagctcaaataataataataatgataataataataataataataataataataaaaatagtgtgaacccgggaggtggagcttgcagtcagccaagatcgtgccactgcactccagcctgggcaacagagtgagactccgtctcaaaaataaataaataaataaaataaaaataaaaataaaaataaaaataatataaatatgaaaataaagttctgctttagctgtgtgccaccgattttgacatatattacattcattatccagttctattgagtcatttagcaatatttcttacaatatttcaatcagcttccaaatattttaaaaatctacctcttaaaaattaatttctggctggcgtggtggctcacgcttataatcccaacactttgggaagctgaggcaggcagatcacctaaggtcaagagttcgagtccagcctggccaacatggcgaaaccctgtctctactaaaaatacaaaaattagccgggcatggtggcaggcgtctgtaatcccagctactcgggaggctgaggtagggagaattgcttgaacccaggaggtggaggtttcagcgagccgagattgcaccactgcactccagccctggcgacagagcgagactctgtctcaaatgaaaaaaaaaaaaaaagaaaaaaaagaaaatgaatttctaatttccttgaaatgtggttagagaacctggtctgtatcatattgctgttgggaatgtattgaggaaaatacatgatctaatgcatatctgttgttataacccttccttgtgcatcctaaaaaagaatgtatgggccaggcacggtggctcatgcctgtaatcccagcactttgggaggccaaggcaggcagatcacctgaggtcaggagttcgagaccagcctggccaacatggtgaaaccccgtctctactaaaaatacaaaaattagccggacacagtggcgggcgcctgtaatcccagctatttgggaggctgaggcaggagaattgcttaaacccgggaggcagaggttgcagtaagccgagattgtgccactgcactccagcctgggcgaaagagtgagactccatctcaaaaaaaaaaaaaaaaaaaaaaaagaatgtaccttctatatctgatagcttgatagcttgagtgaggccctttctgagaaagtccatctgagctgagatctggatgtcaggaaggagctagctctctgaatacttttcctaggagaaagtattctaggcaaagggaatagcaggtgcagagtccctgaggtaggaatgagcttgatatgttccaggaacagaaggaaagtcaatatgaatggagcatagtgggcaaggaggagagtgatgtgagctaaccccttgagagacagtcagaggccagatcgagtagggccttcgaggccagagtatggacttcagccttagctaatgcagtacattcactgacacctacgggtggtttgccaagcacttgtcaggtacaaattggtctcatcttatacaatggagagagcattttgagattattatcattatcacttttttttttttttgagacagtctggctctgtcacctaggctggcgtgatcttggttcactgcaacctcagcctcccaggttcaggcaattctccttgcctcagcctccagagttgctgggattacaggcgcccgcctccatgcccggctcatttttgtatttttagtagagacggagtttcaccatgtaagccaggctggtcttgaactcctgatctcatgatccacccagctcggcctcccaaggtgctgggattacaggcgtgagccactgcacccggctgggatttcttaagtcactgcttttctcatgtcctctgtcagccccaagaacggctccatcttaactttgcaactggttcaaacatctcagccttttttctttttgaaggtttccccaaatcagtcccatttaatctccctccactatgatagtcatttgttttgggctggcaaggctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtagttcatcagattataggcatgagccaacatgctcggccatccacctcttactgatgttactcaacgtgcatgcatttgctggaaatggcaaaaacctgaggccgggcatggtggctcacgcctatgatcccagcactttgggaggcccgggcggagagatcacttgaggccagaagttcgagactagcctggccagcatggtgaaaccccatctctatcaaaaatacaaaaattagcccggtgtggtggcggtgcccgtaatcccagctactcaggaggctgaagcacgagaaccacttgaaccgggaggcagagagatcgcaccactaccctccagcctggacgacagaccaagactgtttcaaaaaaaaaaaaaaaagtctgggcacagtggctcacgcctgtaatcccagcactttgggaggccaaggtgggcagatcacgaagtcaggagttcaagtccagcctgaccagcatggtgaaaccccgtctctacttaaaaaaaaaatgcaaaaattagccaggcatggtggcgcgcgcctgtaatcccaactactcaggaggctgaggcaggagaatcgcttgaaacccgggaggcagaggttgcagtgagccgagatcatgccactgcactccagcctgggtgacagagcaagactccatctcaaaaacaaaacaaaacaaaacaaaaacacaaaaaaaaaaccacctgggaacaacttcctatatgttcatcaaaggaatggataaatgaaactcattatagttgtttgatggaataccatctaatagataaaaggggtgcactggatctgtactgacataaggaaatcccaaaaacataatgttgagtaaaacagcaagttgcagaatacaacatgatgtacaatttgtgtgtaccttaaaatcccatgcagtagatactgttcatggacacatgcttacatacaagatttttaaagtcaaagagaagaatatacattaaattcatgacagtgtgccacaaagaaggaaaaaagcacagaacgggacagggagcataaggaatgttgtaaagttttattccttttagtacttataaatggctgtgaggcaaatggcaaactgttagcaatagtcaattctgaatgggggatgcatagtcccgtatttttctatattctcatatttccccccccccccccaaaaaaaatatgtatcaggcctggtggagattatctggggcactttaaggcagggtcagcaaactttgtaaagggccagatagtaaatattttaggctttgcaagccataggctctgtaatgcagctactcaaccctgccatcctagcagccacaggaaatagtaaatgaatgcatgcggcagtgttccaataaaactttatttacagacactgaaaactgaatttcatatgattttcataagtcacaaaatattactgttttggtttttatttaaccattgaaaaatgtgaaaggccaggtgtggtggcttacacctacacgcgtgattacaatcttagcactctgggaggccgagggggcaggatcacttgagcctagaagtttgagaccagcctggacaacatggcaagacccatcttgacaaaaagaaaaaagaaaaacgtaaaaaccattcttagcaggccataaaaaacaggtggcatgacagatttagcttatgggcaataaatagtttggcaaccctgctttactaaggtaaccaaaatagatttgggtgtcctttcctgttactggatgtcttttcctggtacttgttaaacaattctgtatgtttacatcatgttactaaattgcctgtgttttattagaacactgtagctcacacaggcagaaacttagatatacacacagctgtgtaaacttaaaagccaattaagtaagaaaggttgggaagtgcccctacaaatccaaaccctagctcaagagttgcttttcctgatagtttcctgaaatgctgtgagccaggccctccctgcccgctcctctctctgatgtcttaaagcaaggactgtaccatttatttgatgctcagccacctcccttccttctttattccttcctttttcactctgtgttttgacttgccaatagacctatatcttcctggcatctaggcaggtaccacatctgaaacctttgtatactctccgcattgtgggtgacagcaatgaccctgaagtcagatagattttgttcacatcccagtttcactagttaccagctctgtggccttgggcaaatgacttgatctctcccaatttggtttcgtcagctgtcaaatggggataataatagtatctagctcacaggtttcccatgaggtttaaatctaacgatgtatgtatgtaaagatactagctctgtgcttggtacataagtcttcaatgatgctaactaattaaaattagcacaaagctaaaacccccatcaatatatgtgctttccttattaaagttaattagaacaggacagaaacatcacagttgcaattctttttttttttttttttgagacggagttttgctcttgctgcctggtctcacagttgcaattctttttttttttttttttttgagacggaggtttgctcttgctgcctggtctcacagttgcaattcctttttttttttttttttgaaacggagttttgctcttgctgcctggtctcacagttgcaattcttttttttttttttttttggaaacggagttttgctcttgctgcctggcctcacagtggcaattttttttttttttttttgaaacggagttttgctcttgctgccgggcctcacaggggcaattttttttttttttttttttgaaacggagttttgcttttgcggccgggccccacaggggcaatttttttttttttttttggaaacggagttttgctttggcggccgggccccacaggggcaattttttttttttttttttttggaaacggggtttggctttggcggccgggcccaacaggggcaattttttttttttttttttggaaacggagtttggctttgggggccgggccccacaggggcaattttttaaaaaaccaccccccggcggggcgggggggctcaccccgggaaccccaccctttgggggggcgggggggg

SEQ ID NO: 709 - DNA, 211528 bp, Homo sapiens
  misc_feature (1)...(211528): n = A,T,C or G
gagcgccttgctcctgcgcaggggggactgcggataacaaacccgactgcaaaagaacctaggtcatgtcaatgtcagcagtggcatctagaaaaataacccaggaaaggaggaccgtggggagggaatgtgacgtgggcaaagaccccagaagagggagaatgtgcttcccaggcgggtgcaggcagaggcgccaggcagggggaggctgcggcaacagcgtgcagtgtgttccccgggaactgctccctgattcatgcatgacatgtccactctggcacctggtgtccctgagtggatggccaagcccctgggtctctgcagagcctcattaagctgcacaccttcctctccagctataactggatgtttgctttcctgtttctttgattctgaatacatgctgtcctggccaccacagtctccgtctccctgcggaggtcacaaagtggtctcggtctcggtctccctgccaaggtcactagttataccctcaagggtggggtgggaggcaaaagccgcttcaggtggctgggtcagctccccatcgaggctttccactggacagggaaagggcggacctctgccctgtccacacctgctcttcttctccccagacaacttcctccttccagggctggtatcctctgcagctcctttgcacccacatcccccacccacaccctccggctccacaagatcatccaagaaccaggccctggaggatccttctgggtgcctccccacattctctgcgccagtggccagcaccaagacccccgattttctgtgctcagtgaagtccctgctaccctttcctggtaagagcatcgaaacattcaccccaggacaagtgagggcatcagagaaatggtggcatcatcaccacaggtcacaactcagatgtccccagggaccatccaggtggggatgatggcaaactccgggggggccaccattcagccccactgtcctgccacacagcaggtcagacctgcaccgcgagaagttcaggtttcaggaagaagctagcaattctgatgctaaggtaagaatcgtctgatgtaaatattggccactgtcttgaaactgaaacagtgtttgggtcacctgcaggctgagtggtgcaaagaccactgcccggcaggctccggtccaagagcgagcaagcctgccgtttcccaaatgactgtcgcatgcgatctggcagccagcagcccctgaggctggcacacacaaggttgttctatccctgtcttacagataacaaggcagctctggagggcgggtggtttaccccaaaatcacagttcacctaggtgtgcacctggggctgtttctgagctgcccggcccaggcctctattagttccctgccctggctcaaggggcaggctgcccacggtggtgctcacaggacgatcctaggtccctgcaagtatgagaagcgtgtgagtattttgtttaatagttaagtatataatgcatttttaaaagggtgtaccaaacacatgattttatggagattactgcttaagactttgcccttaagaaataatatacatttactttaatgtataaacatatgtaaccacacatcaaaaccatgattcaccctgtgttctttttaataagagaatgtcagctccttctgaataaggagaagaaggggaggatgaagagcaggagggagaggaggaagccactgacttctccgcaccagttgcacgtctggttgacaaaacacctcaaatccctgtcctgttaatgacaaaccccattcatctcctccagactcctgggaaaaagcatcagagatacaataaagcggcccctgggagcaggagccagttcatgggtctcaaactcaggctcctacaggggccgggaaggtcatgcctgagggtgccgctggtggggtggggctctggaaacagagcagccaggtccctctgtggcccttggtgtctgttttgttcataaaacagggacagaatgatcctatctgcgccggcctcagggaccgccggcagggccaccagcacagctggccggcagcaccttctcagatcctctatttgccaagggaacatagaactccaggtttttatgtggcatctcccagctttgaaatgtctgcaagtaattcattattttaaagcagaaagccctgtttgggcccagctgagtctgggccctttcccagcgtgagcctgggctgagcggcaggggcgtggaccagccaccctcctccagggagtgccaccccagccaaggcgccccagggttgggttcgggtgggtgcgccccatgtttgaaacggcaaagcactcagagaggaaagccttcaacaaacaagtgaccccctcagagtccacacagccagcctccaggaccagatgttcagagctgtcccttgtcagagctccctgcagggaacaggactcatttgtctttgaacaatctttccatctcaggcacggccatcgtgaactctgtgtgactttttcacaactttctgaataatgaccgaagatggtctagaccgggaaatctatttttatggaaaccctcctctcaggctgagctggcttttcccccatttccccggcgttgaaagggtcaccccgtgagggtcctggtgggactgggggctgagctggagcctgcaggggccaggagcacagggctctccgcaccgtcccggctcagcgggcagtggctggaggagcacagggctctccgcaccgtcccggctcagtgggcagtggctggaggagcacaggactctccgcaccgtcccggctcagcgggcagtggcctggaggagcacaggctccatgcgttcctgctccgcacacagctcggggccttcgacagaggactagactcagcagtttcctggcctctcccgcaggcagttccctctgagcttggcctggagaggctctggggagatgaccataggcttcctcctccctagggggacagccttgctccctcctccactcgaggccgtaaccaccctgctccatctgccccaggtgtcggcctgcgacctagtcttttcccttttatgttttgcaattatttaaaaatcagaagtttcaggcaaacagttcttctgggaaaatcagcaggttgggggacaggacgggtctaggggacccatcacatcaggtttgcttctgaccctgatgtcaaaggtcagcctacctgtcactgccgtccccctcacctgcaccccggctgtgctctcgtggcagagtcagaggcaggttgcccctccatcacctctgcctccagccatgaggaaacagcccgtgctgatgagtgtccacctaccccacactgtgggccactccagtggctgagccccaggggcatttccacttgccatgtctgccccccgactgtagtatcggcccctctgttgtctggccccagtcacagagaagaaagatgctctcagctggatgggcctgggtgggaataagcagggctcgttcccttgtgggaggagtgtcggctctgcgataccaaaccagagtggatgcctaacaacccggaggtggcaggcaggcgagatgcaggtttgaaggttgagaggaattctaacacatggctgccctgcgccatctgccacctgccctggctcagcgcacaggccctcccggcactgtggagacactgggctatgtggatgggggaagtccagggcttccagactgctgggtcatctgaacccctccacaggggcctggtgatggtccccacacgtctcaacagttagagcaaaaatcagcagaaaggggccaaacccccaaatgatgcagtgagtgagacccagtgtagtgagtaagacccagtgcagtgagaactggtgtagtgagtgagacccggtgcagtgagtgaggcctggtgtagtgagtgaggctccatgcagtgagtgagaccccagtgcagtgagtaagacccagtgcagtgagtggggcccggtgcagtgagtgaggccccatgcagtgagtaagatcctggtgcagtgagacccggtgtggtgagtgaggctcagtgcggtgagtaagatcctggtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgaggcccggtgcagtgagtgaggccccatgcagtgagtaagatcctggtgcagtgagaaccagtgcagtgactgagacctggtgtagtgagtgagaccccagtgcagtgagtaagacccagtgcagtgagtgaggcccggtgcagtgagtgaggccccatgcagtgagtaagatcctggtgcagtgagtgagacccagtgcagtgactgagacctggtgtagtgagtgaggctcagtgcagtgagtgagacccagtgcagtgagtgagacctggtgtagtgagtgaggccccatgcagtaaggcctgggacagtgagtgaggcccggtgccgtgagtgaggcccggtgcagtgagtgaggcccggtgccgtgagtgaggcccagtgcagtgagtgagacccggtgcagtgagtgagacccggtgcagtgagtgaggccccatgcagtgagtaagatcctggtgcagtgagtgagacccggtgcagtgagtgaggctccatgcagtgagtaagattctgttgctgtgagtgagacccagtgcagtgactgagacctggtgtagtgagtgaggctcagtgcagtgagtaagacccagtgcagtgagtgaaacctggtgtagtgagtgaggccccatgcagtaaggcctggggcagtgagtgagacccggggcagtgagtgagacccagtgccgtgagtgaggcccggtgcagtgagtgaggcccggtgcagtgagtgaggccccatgcagtgagtgaggcccggtgcggtgagtgaggcccggtgcagtgagtgaggcccggtgtactgagtgaggccccgtgcagtgagtgaggccccgtgcagtgagtgaggcctggtgcggtgagtgaggcccggtgcagtgagtgagacctggtgtagtgagtgaggccccatgcagtgagtgaggcccagtgtagcaagtgaggcctggtgcagtgagtgaggcccggtgcagtgagtgagacctggtgtagtgagtgaggccccatgcagtgagtaaggcctggggcagtgagtgagacctggagcagtaagacctgatgcaataagaccctggtgcagtgagtaagacccagtgcagtgagtgaggccccatgcagtgagtaaggcctggggcagtgagtgagacctagtgcagtaagacccggtgcagtgagtgaggcccagtgcagtgagtgagacccagtgcagtgagtgagactcactgcagtgagtaaggcctgatgcagtaagacccggtgcagtggttaagaccccgcctcccgtgaatgagaccccctccagtgagtacaaccccctccagtgagtaagactcgctgcaaggctgaaccctgctgtccccatgcctctccaggggcctgatataaaggggccaggaacaggagcagcctcaccaaagttaatttctttttatttttaaacccaaataagctttgttgtttttaaagcaggtaaacaaaaaggagaccaggagaaccttagtagtggtataatgtgactcggttttggcttgggtgtgaatcaatctccaagcaatcatcttgccttttatagatatagtgaaaataattaactaggagaataacatttttatctacattataatttccacttataaaacgttcatgtctgtgtgcataaggcataacaggtctatatctaggaaaatggatccatttttctccttttgatttggctcctattaacattgttataatacagtttcttcgataaataataacaacatcatactatgtcagtgattgactgctgccctgtttctattttcaaacagacaaccagacatcatgtgtgggggcagctgctaacaccccatcatcagttaagcacagagaagctgtgtctcggctcagtggatttccttcttgaggcataaaatgcagaggcggtctgaaggtgcagactgcagtctcaatttattctacgtagaaaacagacgctactgaagtcgcacttgcagtcagaactccgggcccctcggggcgtgactgcccagctgtgtcacccggagcagctcatgctgcttctaagctcagcttccttgttggcaaagggccctactgtgtggcacacgccgtgcacgtcaggacaagcacaacgcatggcgcacaccacctgctgggagaggcaattgtgcactctacagccacagggacaggacacagcgcggtgagcccacccggtccaggagcgctgggaaagggccccaggagaggcagcagagctgagacaggacgacgaccaggagcgaccaggaaggggaggaggagagtgctctgggcagaggggacagcgtgtacaaaggcccggaggtgagggcacggacagaggaggagagaggttcaagatgaggctgggctgaccacacagggctgtgagtcacaggtcagggtctgtcttcactctgagtgacaggggcccagaagactccacagcagaggagggagtgaccagatttgcttctttaaaaggcactcgtcctgctgtggaggggagggctgaagggggcggaggagcagctgtaggcgtggggcaccagtgaggaggtcctgcaggccccaggcaagagcggccctgtgttcaggtggaggctaaggagcgggagccggtgcagtgacatttccaaggtgacgtgaccaggttggtgaaggagagagcctcaggtagagccaccttctccagagctgggggacacatggcaagcccaccctgcccagcgaggggccaccaccgtgtcctagcctcagtcattcaacaaacatgtttatggagaccctgtcatatgccaggttctgttctagactcaggaaatagcaataaacatgacagcctctctcttccccaactccctctctctcctgctcttctctctctctgtccctctctctgcctccctcccttccttcctccaccccatggagtttactttctagtgaaggagacaaagaagaaagaataagcaaacacacaagtaagacagtgccgccttccaggaaagaaaaggagccagctgatgtggcgagtggctggcgaggctgggctgggcagtggaggacagtcaggtcggcagtggcgactctgggaaggtgtcaaccatgcggggacccgggggaagagcattccattcaaaaggacaggcgtgcaaaggccctggggtgggaatgcacttgatgtggcgcagagcaaggcagacgcatggcgggagcggagtggaatgggcggggagtggcccagagtgcggcagggtgggcaggggaagaagggcgtgtagatcttacttgaaatgcagaggaagccccgagagggttcgagcacagggtgacaccacctgacggccacgtcgaatattactctggctgctgtgtgcagctgggggcggctgggaggctggcgctggcctccggngtagacagtgaaaccaggggcanggctggtgatggtgacgatgggtaccggtggaaatcggacgtgagccgcacggtccgacccggcatcccctcggggaggactggcagaggcgtggagctctgtcctgccaggagtgccgtgaaaatgcacagacgctcacacctagatcctgcagataccacgtgtccccagccttcacccacgcggctcagggaagctgcttccccctagcagacgcagcagccgtggaaatgaccacagaggacacacggctgtgcagccctggttgggcacctgctccagggacctggcaaccaccacatcccgtgcccctgcaagcccctgtggccacccaggcccacggcctgcccctccagggccggctccagtccactccaccgggacccaggcctgtcagccaaggcaagagggacacacactcccgtcttcactgagaacctgcctggctgcctccgtcactgcacacctgcgcaacccagcccagcagaggacaagaattccctgcgttcagggggctccgaaaagacataaggaacccaaccctgcatgccacgctctgagcgggaaggaaggccgcatgtggacgcctgtcctgctcactgtgcctccagggctctgacggtgctgagcacagatgtggtgcttgggcagtgcttgtggggtgcatgatggaagggcaccctggccccagcaatgacagctctagaaacccctccggcctggaaagtcttcttcccaccccacccagcccctgccacacaaaaacaagacaatcccatctggacacagctacaggggacccacccaacggccctgcccgcacaaaaaaagagctcgggcagggccagcctggtctgcacacggagggtgggcatgcaggagacccagggcactgcctggcacgagccatgaatgtcctggagggcagggcggggctcgtcgcgcgccatttagctcgggaggagaggaagctgcaaatgaagtggtctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataaacgtcatctctgtgatggggtggcgatttctctaataaatgtcatctctgtgacgggggtggtgatttctctaataagcataatcgtcactgccccaccatagggagaggaagcagaggggccctggaggaagcacagtgagcaaccacgtggagctgcagagccctctccgctcactgctgtcctaagagggcagccgagagttcgtgtgcaggtgctggcacccgggcctgcagcaagaacactcggggaaaaggccacacagcggtgggggacgtgtcagcggaggcatcgcatgtacttccagggtaccaaagtgagttgtgaaacctcctactacgctgaattttcaaagcaggcgtcagaacccgtgagatgattcgtgctcgtggaggatctaggcggggtcgcgagtggcacaataagctgtggacctgtgagactgtctttgaatagagctgttttgtgagctctgcctccaccgccagggtggagagggaacgtctgccgcctactgaatgcctgtgtagcctaggagagggcttcagtagagcctgggggagccctgtgtgccccttgcgggggacagggttggagctggtgcctgacacttggagaaggacatttgggctgtgtctcagggctaagggctgcattttggaaagcaatgtcaccccctctatctgtggggcacagcggcaggaaccccagagccaagggtggaggctgcgataggagagaagtcaggctggttcatctgaaggcctcccttccggggcagcagttcaccaaacagacacaaatggctccccagcttcccacagggaaggcaggtaggcacctggcatgtgcggggacgaggcaatgacacctctcagggtttccgagtgttggcagaagtgacccggatgtttggtatgcagagctggcccctggggagaagccaagtcacttcctgaggttttggggagacaaggtgttgacacccaggcccaaccctgggggcacaagaatcaaagacacagagatccgtggaggtggccctgggggtccagtacaatgggatggtggagaggggcccccagaactcctgcagcctcaaggggaggggcaggtgggtgacctggtttaagaccagggcctgaaggaagggtgggggggccgtgtttgctaatcctggaaccttgggaaaaccaccgacaaacgcaaatctgagaagctgtgagcagtgggtgactcgtcgacagaaccgcatgggtgagggactgcatttatgtctcaagctgtgtaaatggtcatcccagcaacaggtcagaactcaccccattccagtcatgccccacagtctccccgaattctcctgcacctgggctcagacctgcaagaggctaagccaggcctaaagggatgaaggccaccgtccagtgtttgagccgcaccagggcagcacgcagtacccaaggctgccccagacgtgagtgggctccgctgtcagagcccccaacaaatgacatggcgcaggaagggagggtgggaggcagggagcagcttcgacaggacgccccaaggcagcagagcttccggcagtggagctcagagttgagaccgcccagcccctggctccccggggcccagtgtggtgagttgggatgaggtgttgcccttcctgcgttccgggctcccatgtggcctgttcagaaaccctggtgaaaagagcggccctcggtgggggccctggctgtgggcgagtgctcctctggaaggagactccgacacactgcacattgtgacagaggtggctgtaaccaaggcgaccccagaacaacaggctgcagatgcggctcagtgtctctcctacacaatagctgacctgtgctctgcacaccccggcgtattcaaagcgatgagccctcagccgcgggttaaagtactggtgtcttctgttctttacagtctcagtgtgccacattgaggtgtcacgcgccacactccatggcatccacgctacagatgccaaaggccacgggaaagcgagttcgccattctgctgaggtgggcaggctactattccccgggacgtggctgacacccctcacctgccccgatgtgcagctgaagagacccctcgtccggccttggcctcaggggagggacgatgtccagcaagcttctgtctgaccctgtgtctgccacatcaactggagcagagacaactggatacagaaaatcccattcaccaaggtgggtgccctcaggaggaagggcctgcgcacgctgcaacgttggggatgcattctgagatctagctgcattctcggagatagagccactgccccaacaatttcagcggcacagtctggaagggctccccacagattcttaatttaccctctgcagctgacaaaacacaatccccaccctccaccagaggggtccacaacctaaccccagagcctgggaatgtcacctacgacgggtccacaacctaaccccagagcctgggaatgtcacctacgacgggtccacaacctaaccccagagcctgggaatgtcaccatacgacgggtccacaacctaaccccagagcctgggaatgtcactgtatgaagggtccacaacctaaccccagagcctgggaatgtcacctacgacgggtccacaacctaaccccagagcctggaaatgtcaccataagaggggtccacatcctaaccccagagcctgggaatgttaccataagaggggtccacaacctaaccccagagcctgggaatgtcactgaacgaggggtccacaacctaaccccagagcctgggaatgtcaccgaacgaggggtccacaacctaatcccagagcctgggaatgtcaccgttaagaggggtccacaacctaaccccagagcctgggaatgtcaccgaacgaggggtccacaacctaaccccagagcctgggaatgtcaccgaacgaggggtccacaacctaatcccagagcctgggaatgtcaccgttaagaggggtccacaacctaaccccagagcctgggaatgtcaccgaacaaggggtccacaacctaaccccagagcctgggaatgtcaccgaacgaggggtccacaacctaatcccagagcctgggaatgtcaccatacgaggggtccataacctaaccccagagcctgggaatgtcacctacgacgggtccacaacctaaccccagagcctgggaatgtcaccacatgaggggtccacaacctaaccccagagcctgggaatgtcaccgaacgaggggtccacaacctaatcccagagcctgggaatgtcaccgtacgagagtcccacaacctaaccccagagcctgggaatgtcactttacatggcaaaagggacctttctgatgtgggtaaattaaacgtctggaggtgggaggtgatcctggattagccacatgtatccagtgtgatcccaaggatcttgacagagggaggcaggagcagaggagggggaggcacagaggctggggtcaggggaacggattcgcactgcaggttcaagtgttcatccgcactgactataatagtcaatataaaaataagcctggtagattacagcagcaggcaatgagttaacgttggaactacatcgagagctctcagaagtcactaacaaaacaaacactccactggagaaatcaggaaagaaggtgcttacaacataaagaaaaatgcagatggccagttcacttaggaagcctcaccaataaccaaagctacgcagctatgaatgacaaccaggtgtgacttcctgcgcatcagagtctgcaatggcatgggagaggcggcactgccgagccccacccatggctggataaatggttacgacctttctgaagggcagtttcacgacgcgcatcaaatttttaaatgcgtctcaccaaaaatagccgaggccgcctggaataacaagctggagggtttacacgagccggtctcaggccttggcataggacgtggcagttgcaatcgtaccggcatgcaaatgggatgacggacagagcagagtccagaaacagccacgtcgcccctcccgtgactgacggcaaaggcggcaccacagcactaggggagaggttggtcttcccacacgtggagctgggtaaattacatatccgtctggggacagtggtcagtctcaacccctactgcactgcagacacagaaacaagcagagaaggaccacaggcccaaacacgaaagtgaaaacaacaaatgttccaggtaacacaggaaactactttcatggcctcgggttaggcaggattcctccaccaagacataaaagcactgaatacagaagagcttgataaaccggactgcactgacgttgaaaactgctgtccaccagcagacaccatcgaagtcaaaagggaagaccccgtgtaagagatatttgcaatacgtatatcaaacaaatgactcatactcaaaatacacaaaaactccttaaaaaatcagtaagaaagaaaagcaaacagcacaacagaaaaatgagcagaagtcttgagtagatttttttaaaaggatattgatatccaataaacataaaaaggtcaccaacatcattcaagaaaagcaaataaaaaacagaatgagacaacattagccaccagaatggcggacctggaaaagacgggccacacccaatgctggacactgggcttctcacgctctgccaaggggagagtgaaccagtgcccgctctggagaaggcaccgggcaccagctgttcatgctgaacatgcccctcgacccagcgacgccatcctgggcagatcccacaaagaagggcacagtcaggttcaccagcagaaacgcgctcactagaacatccggcagctctgttctgctggcgtctggaaaaggcattccatggtgctggccgtgtgctgcttcttgacctgaggggtgatttcttgggtatgttcgctttgtaaaaactgtcataccatacacacatatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaaaaaatgtgtagacatttaacagagcaattctacctctgagaattcatcctacagagataacccagcaagaacacagaagattcattacagcattgtgagaatgcaaacccgaagccagacgcacaccagcaggatgacaaacgtagactattaagcagccgtgagaatgatgatacagtctgagctactggcacggaaatatagacatggtaaatttaaaaactgaagctgcgaaacggcacggatagcagaaccccatttatataaaattgtgtgcacacacacacacacctagagaagccccgaaagaagtcaccacaatgttgacactggtcatctctgagggatgggatttcaaacgatgtttggctatgtgtgtgtgcatgtgtgtgcgtgtgtgtgtgttatttaaacagcctgcagagtaggaatatcctggatctacagtgcaccaaggaatgaccatgggaagaaaatgaaccttgcttcattcacaatcaaccgtttttccctcattcacagcaaatcctagagaaataacagctgtgtgccacaatccctacgagaaagtacctgcctccaagagaagccacccgcctgctttcatctccctcaaatatggttctgaatctgagaagcacaggaaagtgactgtgtgtaatagtccgcaactggaaacagccaaattatggttacaaggacgagtcagcggtggcctattcatataatggaatatggaatagtgacgagtagcatccagccgtgaacactgcaatatcccctgggagactctcacctgggagtctcccgggtatattggcgatgcctagagacgtatctagttgtcaaacctggggaggggctgctggcatcaagtgggtagaggccagggatgctgctccacaccctccctgcaatgcccaggccagccccacagccacagtgccccaacaccaatgcatctcaacacagcagaaccagttcccttggaagattaagccccagaaacacaagccaacttcaaaaggccaaagtctggattccactctatgcctgggaacctcctctgttccggggtgacatggacgctggagctccacacggtcagaaagcgctccggagctcggctccacgcggtcaggaagtgctctggagctcactcccttccaatgccctgagagatcggacagacgattgctgacgtcagtggcaaagggctgacgtcagtggcaaaggactcccgcccccccgcagacattaaaatgagccctttgggagaataagggattccatccagctcagaagggcaggagtaatgaggccacccagccctctggagggcaccgggaaaggctggaagcagggtctgtgccctgagacacagtccactgagacacagtccatggcccagccacacccgcggctgccccgtttgtctgtagagtgcaggctccccagcaggggagaagcacagatgacacctcactgaccattcccacttgccctctgcagcctgagggcccagacacactgatggcactggcgcaattgacatgaaccgggcacagtgacacagtcacgtgtcccaggacctccgtgggcttccgtggtgcagccctggggcatgtggagtgcccagcctcacccccaggctttaccaggtgccccctcagagcctccaggatgggcctgcaactctgtccctcacaccctggggagcttgcaccccattctgtgccagcaaaagaaggtatctcaggccaggcacagtggcccacgcctgtaatcccagcactttgggagacggaggtggatggatcacttgaggccaggagttcgagaccagcctgaacaacacggtgaaaccctgtcactactaaaattacaaaaattagcagggagcatgcccgtaatcccagctactcaggaggctgaggcaggagaattgcttgaacccaggaggtagaagttgcagtgagccgagatcgtgccattgcactccagcctggatgacagagcaagactctgtatcaaaaaaaaaaaaaaagaaaagaaggcatctcagcctcgggcctcaagacctcagcccatgttgggagaaaattcctgcagcctccatgtcacggttccctgacaacgatgtgggggacaaatgtgtgactctcttctgagttcacctcctcctcacggcccgtgacagagtgccgccaggggaaatcttcccatcagacaaatcactttaacttagaagagcaggcccccgcaacatcctcagaaatataaaagcaaccttcaaaagaaaaaccccaaaaccctagagaacgcttggctaagacaagccttaattaccatcctctttcggtatgataaaaattcctctccacctctcttcaagacaggattccttattcaaacactttctttttttaaaaataactgcagtaaccaaccattaaaacggggactgcattttaatccacgctttctttttctctggttttcaaactggcacctttcatacttcacagaagacacaaacatggccttctacaaaacttccatccacggcatcaagccccacagggcctgtaattcactggagccgggaggtgagaagtgcctgcagagacggttcccccaggccaccatgccgtccctgccctcgggccacggccagcaggcctcaggaccagtgagaaaatggcccggagagccctgcccgagcttctcacacagacacgcctgctgcattgctcccttcccattgctcccttctcgtgtctgggaggcctgaatggtgcctcaaggaaaaggagtacagtcttgcatcacttaatgacaaggacacattgtgaaaatgcatcattaggcgatttcatcgtgctgtgaacatcacagaggggacttacacaaagctagacgacgcagtccaccacacacctggctgtatggagtagcctattgctcctaggctacaaactgtgcccactactgtactgaatgctgccagcggctgtaacacaatgggaaggatctgtgcattgaaatacatcaaaacatagatgaggtacagggaaaatctggtcttacagtctgatgggaccactgtggtatacgcaatctatcactgaccggaacatgactgaaatgtttccaaaacacacaggatgctcggttgggtctgctgcagcaccagccacactggaaaccctggtggctttagggaccactagaagccacgctcgacctcccctctgccaggaaagccagcacactgaggagctagccatcaggcaccagcaccaggctccagccctccatgtgggcctctctgaccctgacgtcacagagaaccccagtgacccggccagcggggctgcctgcacctgcttcctgcacaactccccccaggccgctctgccgggggcaggaaagcactgtccctcaggggtggctaattctaggctttgcctctcccaaaaccattactcggatcatccagatgctaaccccagatacatcattcatctctcagatccgttctgtcttcatctgtggtcgacagctcatcaggttgaatcttcagaaatgacttaaatccgcacaccagggtcaggagcagaaggctagctgggaccattctgagttgtctatttgcagagactggtcattttctccctgctgtttgtcacttcattgcccctcaacactgcccgagggtcaacataaggggaagaagaaggtccatctgcaggtaaatagaaactttctgggtttccagaacagaggctggaccgcccactgcaggaatatgcaggttcacagggtcatttgctgcaacaagttatttatacaaaatatgggtaacaacttaaatgcccatgagtaggagacgagctgaataagccggcgatggttcagtaaacccacacagtggggctctgcgcagctgagaagctggaaggcctctgcggatgggtttggagtgacttccaggataaactgagtaccaaagagtttctatggtataccacccttcacaggagacagaaggggctatttaaaaagtacatgtatctgttcatttggcacaaaagagatacaaaacacacacacacacacgaatgggaccggcttacctggggaagtgggtgggaacagggtgcaggggatggaggatggagacagagcgggggtgcgccgtggctcggaggaagccttcagaaccacacgatggttcacatacccctcaaatacatcaacactgaaaatcaaccaacctgtgggggacccagaagagagtaccagtgacagcagatgaacttgactgtgttctaagtgacactacaggaagggaggcagaagaaaggagccagctatggaacgcagagaaatggtatcttaactacatggtgtaaggctaaaagcagagagggtgggaacaaacactgtcccctcatcaggacatacgtttcccacaagggtgtgggttagcaattctgaacctgtgtgtgcagcacatttatacaaataaaattattgagaataatgagagacaggtttcctactttgggagaaagaagaacatacaaggaaaggctaaatgaatcccacagtcttagaccagaaacaggtatcagaatgcaatcctagtttgcaacacagacacacatacagacacacagaaaaatgcaggaagatgcaggtgcacgcgtgtgcttctgagaacacacacacacagatttcccggctctgtccaccgagagaggactgagaacagtgacgctccagcagaaatgagcacgcctgtccctaatcctgctttctaaacgccattctccaaccaaaggcaccagggctccttagggaaagagccgattccatgagcccagcatatctttaatgcctgaatgtaaggagggactcagaaaatgagggaggcatcaaaggaggcagaaaccaactggacagagctcccgacggtcacggccgcgacaacgggagcaacagaatccgtaatgatagagccggacagcgccctgtgggatgaaatagtacccctgagtcatagcaacaccagcaactgaataaataaatcacggtttgtacttatcacagaattccaattaataaatgcagaaggaatggtggaaatagaaagtcatcattaggcaaacattacagtcaaaatttttgcaggcaagagcaatcaaaatgtagaaattcatgaaggaagatgagctgaaggaaggttgtgtagtttcacggtatctccccaccaccaagatatttattctaggcaaaggggaaaaccatccctttacagtgggttcatctggcagacaccacctcactcatgccatccacgtgagcgttaccggcaacaatgagcattcacatcccatatttgctatgctggagccgaattactccccactaaagtcacctgttgaagccctaacccccaagacctcagaatgtgacagtgtttggagtcagggtctttgaaggggtgattaagataaaatgaggtcattagagtaggccctaatccaacgtgaccagtatccttataagaagagatcagggccgagcgcggtggctcatacctgtaatcccagcactttgggaggctgaggcagaatcgcctgagcccaggagttcaagaccagcctaagcaacatagtgagatctcatctctacaaataactgaaaaatgagcagggcattgtgatgcatgtctgaggtcccagattctcaggaggctgacgcaggaggatggtttgagcccggcgatcagggctgcagtgagccgtgactgcacctctgcactccagcctgggcaagagagagagactctgtctcaaaaaaagaaaaaatggaagatcaggacacagacacgcacaagggacgaccatgtgaggacatagggagaagacactgtctgcaagccaaggagagaggccttgggagaaaccaaacctactgacaccttgatcttggatttccaacccctagaacgacgagaaaataaatgtctcttgcttggtagcccacaggccgactcacacagcctgatgctgcgataagaaaggaccatttcacttccctggcgttcttgtcaaagacgcacagcatcggcctaatcaggaggaagcatcggacagtgaccagggatgctccacaaagcaccagccggccgccgcgaagtgtcaaagtcatgggagacaacgggaagctaagaacccgtacagactgcagttgcctaggagacgtgacaactaagcgctctgtgccagccgagatgagaccccgggactgaaaaaaagctgcaagtgaggaaactgacaccattcaaaaaacgtctgtcgttaatatcagtgtcaatttactggtttcaatcattgtacttaaaaataccaccatcagggaagacggatgaatgatctgtatgtctgtagacatacaggggcattctgtactattcttgacatttttttctgtaactttaaaatcatttcagaataaaaagcttaaaacattgaggttgtaaactgttgacctcctggctgaatgcaacccacacatagggtttctttgacaacactggaaacaaatttgaattagctgccaacaagacacatccagggatataatttaaagcccaaattctgggctgctcttcgaaagtcacaagctgtggtgacggtgacaccccaaggaggccaaaacccagcccgaaggcaccctgtgtccagggctgctcctcacactggccatcccgggcctggcccctgagagccacacctagaggagggcctagtttgaggaggtgcccagtcctgaggacacaggtcccccgcactgcacaaggacagagcctgagggcttcttcacggtccaggggcctcggataaatgtccagggttcagccttacccagggcttcatgtgagggcatccacagctcgggcaactgcctcgttcagacctggcccatgtccaggtgggcatggccaacatttcagagcactcagcttacagacctccttttgccaacagtgcctccatttccctcctcagatcaccagtgccccactgcgtgtgagcctggggaaccaaacctcttccctgacctcagccctggggtgctattaggcatgcatgaggggcagagccctgccctggccggagcttggggtcctggcctggaacatctccccggagcaccctctgccctggccggagctcagggtcttgcccctggaacatctccctcgagcaccccctgccctggatggagctcggggtcctgcccctggaatatctccctcgagcaccccctgccctggatggagctcggggtcctgcccctggaatatctccctcgagcaccccctgccctggatggagcttggggtcctgcccctggaatatctccctcgagcaccccctgccctggacggagctcagggtcctgccccggacggagctcagggttctgcccctggaatatctctctcgagcactccctgccctggacggagctcggggtccttccctggaacatctccctcgagcaccccctgccctggatggagctcagggtcctgcccctggaatatctccctggagcaccccctgccctggatggagctcggggtccttccctggagcatctccctggaacaccctcattacactcagtcccttccagaatttgtggtagcctgagcgatggcctggctttgggactgactgacattcaggtggagctgaggccgtctgatgagaaaatgtttgacaacagccatcaaactggcagcactgggctctttgcaatacgtatttttggtgcttattctaattctgaaatttcccaagactctgcttcgctcattccttgctcccttctaaggaaaaagctttcatcttcattgacctgggaaactgacatttcaatgttgaattaaaacttcagcttttggttgaacgcagtgagcaattttgactgaagagaacactgcagattctgaccgatcgtcgtgtcgaaaacccctggcgtcccagggtggtgtgtgggtagcatccctgtccagagcctcagtggaactgctggaaaggcctcctgcgtagccctgggtgaggcaccctggagacccgctctgcccaacagcatagcctgagctgccgaaggtctcagcccactgggtgcccctagagccgggtgggacagtggccagaggtcagggtgaccaaggaggagcagcaggagccggtccaccagaggccactgctgagtcggcccaaggtcagggtctgaatctggattatttgatagtttggggagcaaacaatgttaaaaagcaaaatcctgcagcggcgtctgtgcagggctctgaagtgtgcacacccgggcacaggctgggccaccacggctgttctgaaccggaggcctacgagtctgtgccccggccttgctgagacgctgcctgtcatgtcctcaggccccagctgggctcctgcccccacctgcaggacctcacagaaccagaacaacccgggagccaaaagcaaagtccctctcaaacacctcagtctgtcctgaaagaaaatgactgagcgtactgagaaagggtggtggaaatgaaacggctatgctttgagaaagaagttccacgagaatgtcaacacctctgctaacagaaatgatgcaggggtgccactaaacagcgttaagcaaaatacatttatttgccctttgtgtgtaaaaggcaaaaccctccatatcagggaggtgggctcttttctattttattttgcaccggtcataactgactcaagctggtttcctaagaaaatagaagagcgggattttttaacatatgggtcctcgtggcctgaagtcagtgaatgatggggcagcacgagggaagcgctgcgtgaggcggccgacccgaggtggagcttccctcctgtctcactgttggaccctctcggtgggaaaccgcggggatgaaccgatctctaagactaaggttcaccaggcaccacagggggcgtcctccacagcaggggcaaggcgggatttaaccaaaacccgagccgatgcccctcatcccggcgtgaagggtcagacatgcagacacctgggagaatgcgggcctcagccctgcaatctaaccacgtggctgtgattcagtttactgccaccctgccttcctgggagctggaggagtgggagaggagggggctgcctgggcgggagagcggataggcgtgaggcccctgggtgaggcaccctggagacccgctctgtgcacgagagggagaagccataccagacaaaacaaatcactttccactttccaaattccagagctcctacctgccggccctgcaaggatgggatgtgggtgtgtgtgtcggtgtgtgtggtgtactgaggctgggtatgtgcacatatgtgcctatatgggtgctggatgcaggtacatgcactgggtgtgtactgagtgtgtgtctgtgctgggtgtgtgtgcactggttgtgtgtgtctgtgctggctgtgtgtatactaagtgtgtgtgcctgtgctgggtgtgtgtgcactgagtgtgtgtggactgggtgtgtgcacactgggtgtgtctgtgttgggtgtgtgtgtactgagtgtgtgagcactgggtatgtgtgcactgggtgtgtctgtgctgggtatgtgtactgggtgtgtgagcactgggtgtgtgtgcactgggtgtttgtgtctgtgttggtgtatctgtgttgggtgtgtctgtgctgggtgtgtgtgcactaggtgtttgtgtgctgggtgtgtctgtgctgggagtgtgtggactgagtgtgtgtggactgagtgtgtggagtgagtgtgtgtgcactgggtgtgtgtgtctgtgctgggtgggtgtagatggggtgtgtgtggactgattgtgtgtggactgggtgtgtgtgtgtctgtgctgggtgtatgtggactgggtgtgtgtggactgggtatggactgtgtgtggactgagtgtatgtggactgggtgtgtgtggactgtgtgcactgggtgtgtgtggactgggtgtgtgtggactgtgtgcactgggtgtgtgtggactgggtgtgtgtggactgtgtacactgggtgtgtgtggactgggtgtgtgtggactgagtgtatgtggactgggtgtgtgtggactgtgtgcatgtgcatgtgcatgtgtgtgtatgcgtgtgcatgtatgctgtgtaacctcactggctgtgtggctctcctgcagccctggcactcaaggctgtgctctcatctcctgcctcccctctctgcccgtgccctcccctctccacttgcccccgcctcaccttctgggatgatccctgactcctgctcttcaaagtccctcaggccctgtggtcggctgtgcttcacagtgcccacctcactcacaaggacaacttcaacctcagagcacacagaggttccagagtccttcagaacaagcctcctgcctttacagacttttttttttttttgaggcagagtctcactctatcgcccaggctggaacgcactggcccgatctctgctcactgcaacctctgcctcccgggttcaagtgattctcctgcctcagtctcccaagtagctgggattacaggctcgggccaccatgcccggctgatttttgtatttttagtagagacgggaattcaccatgttggtcacgctggtctcaaactcctgacctcaggtgatccgcccaccttggcctcccgaagtgctgggattacaggctgagccactgcgcccagctacagactcttgactacaggcttgacacgccgcggggcagcactgccctaccctcaagcccagaagctccaagtgtctctgctgcatgtcgcagccacatttccaaacataggctgagcctgtggagtgcaccctcactgacgtcacggcagaggggacagcctgtgcaggggaccaggattctctccacacaaagagaagacacaaatgtcaactgcacaactgcaagacagggcactgactccggcacagcactcactcagcaagcgtctcctgagcctccacgcagtgccaaggccactgcgggcaggggggaagggcagtgggctccatgctggatctggcagcctctgagaagctgcaggccatttaagggattactgattagcataaatgattatagcatacagagctgagactctgtgctaatacagcgcaaagaccgcgtggagggaggttcccttctgtgcaggccgcagagggcttggaggagagaaggctcctcctgagatgggtgaactcagacagcagatgggtgagacaggcccaccaggcacagggaacgacaccagcaatgacagcagctgtctgctgggcttggaaggagagccagaggtgcatggaaagccgggcgggaaagacctgctagacatctgccgacaggcccagagtgtaaattctcctgcagggaaccttgagtcccagaaggtctttgaataggtaagtagcaccacctgatctgtgtgtttgacaataagtctgtaaactgtggggagaatggagcagacagaacacgcggaggctgctggtccaggtgagaagtcactgggaaggagagggacaccgggaggggcggaggaagcaaggcaggggacacactgaaaacaggctcacggctggtcacatgcagagaggaagggcaaggaggctgaggtgaccagtctcatctccaatcccctctccatctccattcccatctccatctccaactccatctccatctccaactccatctccatctccaactccagtcccctctccatctccatctccattcccatctccatctccatctccaactccagtcccctctccatctccatttccatctctatctccatcatctccagtcccctctccatctccatttccatctctatctccaacatctccagtcccctctccatctccatctctatatccagtcccatctccatctccatctccattcccatgtccatctcaatctccaattccagtcccctctgcatctccattcccatctccatccgcacctccatctccagtcccctctccatctccatcttccactccagtcccatctccgtctccagtaccatctcttgactgccccagctcacccagcagcacaagtgtgtgggcccctcccaggtggggcagaaacacagtcaccctggaaagaacagaagcacccacccaggtatgcgcacagagtcggccttggccatagagcagagtgaaacagaatgaaatagaaaatcctgccaggaaatgcctttagtgttaattctgaccaataacacagtgagttcttgaataaacactttgaaaaatctcactgtttcagtgtcacatcaaacaccatacctcctgacatgaacctggcgtggggaacagcgcacgcgttttttaaagaacggcagcattatactctggtttctcctcagattgtatacatcttttgccttttactaaagaatggcagtgcatcggtatccccaatgtctctgtcagtcctactcactggcaaaaacaaacgacatgtggagaggagagcggttatgaagcatcaggaccaagagcttatcacgcaatgcctgaagcgtaaaaatggttttgcctgagctctgaagcatgtttctctctaacagaacacagtgctgcatcttgctgatggctaataacacacatggtaactgggatggccaaggtacccccctcctccagtaaggacacttgttataaatgaggaagatccgtgatcgctccacacgtctaggagagccacctcgacgcctcttccccaacatcgacaccgcgtggccagcccaggcactatgcgaggggcctcccactgcagctcagaaacaaaggcccaagagaaggagctccagggagaggaagattccagttcgggctggcaccaaggctgttggagattctttatgcaagcacacagacaacccaacattcctcagtgtgaaaccagatcaaaggcggcgacaagggtgaaggcaccgccactcaccaatctgtgcttgaggtggaccgtaatgagtggagagcccgactggttctgagacagggtgggtggtggggacacctccagggaaatcaggtggctggtggcgaacagcaggcagtcctggtgatgcatggcctccgcgatccttgggaagagacggaaatcattacaaaatgggaaacgcaggggagcagcacacagctagaacctaggctgggagccagcgttccacccaaaactattgagacggaaatcttctttggatgaagctttgatttctttcattcagctcccgctgctctccttcaagatgtgaagctggtacctgcaggcgagttcaactattctgtgttttaactctgtcccttgaattcttatcttcaatacctgctctcgttaaggtgtgacgccaggaccaagaggtgagacagagccctcgacctcaaagagtttataagaaaagtaagatggcccaggaagcatggatgagcagaaatgctcaaaataacagggcatgaatctcaccgattccacttaatcagctgtgtgaccttgggcaggtaactcaccctgtctgagtgtcaatttccctgattataggatggtgcagtggccatctgctgttttgcccacccagtattcattcatcgttttcctgatcaaagcacctgccttcccctctaggtggccatccccttccccgctcacagcccacacagcctggagttgactctatcttggctcaggaggaagccctggtatctgggtctggatcagtcagtgcactgcagccctcaggccatggggaccatttaggaatgacacccaatccagtcaaatctgaggagatgccagaaggcgaggtggggggagaatccccccnnnnnngntnnnnnnnnnnnnnngnnnnnnaaaaaacacacgctttccgctaaattcggggnggggggtttttttttgggtgggggttttttgtttttggnnngnngtnnnntttttgtttttttttgtttgtttgtttttgtgggttgttctgtttgtttggtgtgggtgtggtttgtggtgggggggggtttttggttgtgtttgtgtttgttttcccgtgtggggtttgggtctgttggtctgtgtgtgtggggtgttgtggtggtggggttttgtgttgttttgtgtgttttgtctttttttgtttggttgtttgtttgttgtgtctttttttgtggttttgtgtgtgcttgccttgctttgcgtgttttctcttgggttgtgcgcgctgtttgtctgttttttggctcttgtgtttttcttggcgctcctcccttttctttcgttccttctttgtttggttttgtgcttgtgtctcctttctgtgtgctggtttttgttctttttttttgttttttctgtgggtgggtgtttgttttttttctttatcctgccgtctttttctacttaccttaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagagaccagcctggccacatggtgaaaccctgtttctactaaaaatacaaaaattagctgggcttggtggcacctgcctgtagtcccagctgaggcaagagaattgcttgaacctgggaagcagaggttgcagtaagccaagatcgtgccactgcactccagcctgggcgacagagcgaagactctgtcgcaaaaaaaaaaaaaaaaaaaaaaaaaaaaaaaaaacctccccaggaaattcaattatgaaaggagttggagggctaattctgccctccagaaaggagggccactgacaacaaggaggggggtagggggggggcccctgaaggtaaggccccctcaggaatgacaaaggggactttagggaacctggaaaacacaggggtgctgggttcctggcgctgggccccaccccgtgggggggggaaaggacccaggcaaacccacctggaaaccccagttgtcactgaccacggtcaaacttgaaagccaaatgaccagaacagtgtctgaccagggcctgttctgcccaggccctgcggttctagagggtttaagtcagtagagagaaagggagaacaaggaacagcagagacttgaatacaacttacccttcccaccctctgtcactaaacgtcctttaaagcccctcccaactggccatgctccagccaggagtttgatgactggagtccgctctgaaagcgtttttgcatgttggttggcaaaatgaatggtcctcccagaccccaagagagcgcggggacctctcactgaagcctctgacactctttaaagggtagagtcggtaaagcgatggcaggtgatcctcacgcagccccggggaggcgctgcggcccccagaccctaagagctcaaccgcgcagccccaaaggcgtcccctctgcagctgacagcgattcactgaaagaaaaaccagccctgctcggagctctgtagacgctgtgagggaggctctgatgccacaagcctttccctcgcgaccacctctgcttgcacaaagatccctgccctcggctcgtggcgccccgcccaacacccctgggcccctgacgcccctcagtccagggagctgctccagttcactgcggggccctgacccagcctgcagacgggaagcctgggccaggacgcgcagcccgggcccaaccagccagggccctcagagacaggcacgtggaagtaccgaagggaaagcacagactctgctgaggtcacaccctctgatcacgaccccaccataccagcagctcctggtgtccaccggtgctaactgcacaaagaaatcatgggaggcagccctgaccaacattcgactccatcccatttccctgattggttctgggacggacacatgactcaccgcagccaatgagaaccagcctgggacttgcgatgggagtgctgggaaaaagcctccgtttccatccggggaggcagagaagatgagggacgagcctcatgccagtgcaggtgcaggagccctgggcccagcctccccacagatggtcctgactcaggaacctgtaaatccccatccgtgtttaaacactgagttggggccaggcacagtggctcacgcctgtaatcccagcactttgggagacagaggagggcagatcacctgaggtcaggagttcgagaccagcctggccaacacggtgaaaccccgtctctactaaaaatacaaaattagctgggcgtggtggcgcatggctgtaatcccagctacttgggagagtgaggcaggagaatcgcctgaacccaggaggcagaggttgcagtgagatcgcaccactgcactccagcctgggagacaaagtgagactccgtctcaaaaaaacaataacaaaaacaacaacaaaaaactctgagttgggttttctgtcacttgcaaaccactgtaactgtaactgttatgtgtggttcccaggaggcttctgctgagattcccctctgcagccttggagtcctggtgactcctgagcaaggagctagccggtgggtgagaaggcaccggaggatggggaaggacgagcccgcgcctgtgctgttctcagggctgtgtgcctgcacctgccgcctcgactggaagagccctggggcctcgagtggacccgcctggaaagcaccgccttcctgagcattccgggaaataagaccctcagtcattggcccagaggagccctagcgaggagtgaccgaggaacgacgctgcatccttcggaagctcctcagggagccccccgccatctccagagccccacaccctctcctcctgcccctccccagccccgctctgcgcccacaagggtaggaaacgtaccacgatgacaaacagggcaggggctacaaaggcccagatggcgccactcgccaacgacagccagcaactgcggagggaagcagagccgttacttcaacaacctcgttccacctgccagcgtaccttcatccaaaagtagttgctaaggtgatgtctttctcagctacagggtccacctggggcagtcatacaacattcctaatccctgcaaatgtatttttatccatgatgatcccacgtctcattcttggaaaggattttccaggtttgaagaccaggacagcaacctctggagagtttagccaaaatccagaatagatttcaatttcattaggaaatagacctttgctggggactggctttcctgcagagcacttcaagtatgacccaatagggccttctgtgagggattcccatcctgatgagtcgtcagcaatgcagcacctgaccattcccatatgcccaaagctcgaggtcagttcccctctctccgtgccctccaactgagaggaaaggttccagagggtcctagtgattgctctgatgtcctgagaggagggtccagtttgaggatctggcctctgagaagtgaccccaagaactcgggcaaaaaaaagccagctcctccacaattttatctccagagcctacggcactgtcaagagccgaagagtccctaggacctctcatcttgactcctggacactgtttcccaaggacctggagtgcctttaattggatctgggcaggtgcgtggcgcagtcctcactggcacccaatgtggtgtctccccggggctggcttatttcatccctccgtgactgctcactgagcagcaggtctgccccacagcacaacaaactccatcatctcatttaatcctatgctgcccctgaggtgggcgctatgatcactccaatcctgcagatgaggaatctgagccctaaatagctcaggtgacttcagagatcactgtcagcacactgcctccctgcccccattcctccccaaagcctcccggaccaggagatggcaaatgccccaaaacaagagacagcacctgcaagaggctcattcatggctgcacacccagagcacggagaggagaaacctctcatctgaggatgcactgtttaaaaggaaaatgcactgcaagtctgaatggtacctctgcaaaggtgcgattcaaaccaggctctccggagagtaggatgcttctgcaaagagagagattgtgctttccagcacttcatgcagaattttaagtcgacgaggggcttctggtagatactctatcctgttcagaaacctggtgagcttcctgaacctggctggtgctgcctggctttcgggcatgagtgtgggaaaaggcttgtattacggtcagaccccgggactcaggactgtgggtccagcatccccaagctccagatgggataaaagggaacaaatgccattgagctgtgtttgaggagaacattcttcttctaattagtccctcaacttctaacagcatccagaatgaaaggaaggccagaacagtggtctgcgtaaccatgctcgtttcactgtgcgctcagacactgccttctacaaatgcttcgccttcagggaacctgcaccaacgtggaaaaggctggatttctcccagtttcactattcgtctgtactattatctcattctgaagctgtgaaaatgctcaacttcctttctgtttgtaagcaccgtcaatatttattttccatgttttcactcagtggtttctcagcgtggctagaacaggtagcagcttccaagaaacatttgagtgaaagctcttttacttgtaaggaaagaaaatcatctttctggaacgtgaacagctgatctggtccctcagcaccatcccatcctcttcctgacacaactgtggacccatgagctgcatttcaagtggcaacaggagatactggacatcataaggtccatcccctactacccaagcaatgggaccctcaagaccacctgcctggtgcacagcaggccccacttactccaacatgcatgtgtctgctccctgtgagttactgggcacacggtctgcacagtgcgcttgctggccaccccaagaaagggtgaaagggccacaattcagcctccgtggatgaccagaactgtgtctcagaagaccacgtgggtgaaacatttccaagcagaaactcctagcaggccccctgctattcctggaggcgctctgtggtctttgttgctagttccgaggccccaaaatgtccagagcacagctgggttgtttctccctctccctggaccacgactttctcaccggctgggcctgtgggagccagctttgcacagcacccctgcacccagaagagcacaggaaggcaagagccacggggctctcgccacaagctgttccatggaacgcctgccaaaagcaaggcaaagccctgcacttacttgttgcttgttccgtaactgtccatggcaaatgacagtgaaatgatgcagatcagaagaggaaaacctgcagaagattggagaatatcatgttcacttgctccagttttcttccctccctcccgcctcccccatccctcccttcctttcttcattccttgtacacctcatacatgtatacagagggggaactatgtgctaattgttgggacacagaacagcccctatcctcaaagaacttttagtctaaacaaaggaataacacacacacactcatactcacatgttcacacttctgtactagacaacaaagtgtatgagtcttcatcaaaacaaaccatgtgggtgagatgtggcattgtgactggcaggaaggtaagctcagcttggtctatctagacctgtggttctcaaccagggccaaggtggccccacaagagacaactggcaatggcttaagtcatctagggttgtcataacgggatggaatcaggcaggcagaggccagggcttctgttaaacaccctacaatgcacaagactgccccacaagagtcacccagcccaagtatccatagtgttggttgagaagccctgttctagagcggcggtggaaaggtgtgagatcagctgggactgaggggacatcggacatggctgactttgccatgcacacagtccacattcttacagtatttgagcccataatttccttagggaacctatcacactccatctttccatgaggtccaggtgggctggttccttcctggctctgaggcatgtgacccaggactggctgactggaacatcaaatcccccagccacagctattggttcaaagatgggcatgtgaccctggctggcccaatgagactcaatcaagggctttcttcgaaactgctgagaagaaactctcttttctatggagcccctaagaggataaggatgtcagtgagcttggggtccaggcagccattttggcaccacaagagatcagatctgagagacggaaaaagaaaacaaaatcttgattatattacttaagctcatggatcaagccatatctgaagtccagcatcttagaacttttttgttatatgagccatcacattccctttttgccttagccagttcaagttggatttctattacttgaaactgagtgtgacaaattaaatgtgtttaatatttgacaaagccaagtgagactttgggggtggtgatagaagggaggcccacgaatgaggtagaaagcatctggatcacagcagtccccagagcttcatcattctgcaacgaaaacactctatggccacactacttgtaggaattgacctaacccaaatctgaactggcctctactttcacttttaaagtgcagaggttttgtatgctaatgtgtcttatgactctccaaaaggaagatcgcattgcaacactcctcaagctcagccatccacggaatttgtctggaaacatggctctgcttccacatgcacgtgtgagctttgaaacagatcctgcacgaatgggaatctgtttctgaaaagaacacacttctcgttattcagaaagtggggcatcatccacggggcctgctctagtgcagccaccctgagcacagcagcctctgtcctctgctccctctgcagggaaggatgggagagagatgagagactgcaaaggaccagctccttactccacacctgaaccttttccccaggaggatgctcaagagacacagctcctggcacatctcggatccctgggatagcagggtgggggatggaagtgcacgaagagcatgtggctctctgcctccgtagctgaagtcacacaggttctgggagatttctgctccagaggaaggaggaggagggaaggtggctcctggcacccacccgaccgcctccaggccgcagccctccagtgccctctgggggcagagtacacgccgtgcctgcccttccaaacatcagggtttgggtttcaagttaattaccctggaaagacatttcctggacagtcttgtctctgaaatacttggttttaaatgtcaaaaggacttaaatgcattgcagaatgtctgggcaataaagttatccagaaggagaccaggcagcctctgtggaagaggcgcacagttggggcccagcagtgactgtgggcctttgtcatcctgtcactttgagtttccctatgtgagctcctctgccatttcttcccctgcatctacccctgtgtccagcagaggccaagccatgggtaaggacaaagggtctgagaacagggtggggcccactgtctgctttctccaaaatgagctgcaggagctatgaagtctgggtgagtgcgtttgtggggctttttaagaagaaaacattcctaagtgggaggataaggagaggggcagtaagatggagaagacagtgagtgggaagagcgtgggctttggggccagaagacacctcgttctattcctggggctgcccgggaccagctgtgcatctacaaggaaccagccgaaattctgtgctcagaccatgggaacgtaatgagttgccttcctcactaggctgtgaggatgacatgagctgtctatgaatgatgagcccctcgatgatgaagctgatcttgcaataatctgtgtcatcaaccagctcagacctcacccctttcccaccactgctgtcatctgaaactctcacacggtaacctgggcagacctggaacatgcttctgcggacaatgtgaagtccctctggccctgtcatcagagacatttactttgggtgctcctctttgcaacacggtgaccttcagagggaccagaccggtgctgtccttggcatctgccccctaagattgaggggcaggtgaggagcatgggttatgagagattaaccgaggtgggtgaagcgaaggcctgggaggatgggcgcatgggcaaggggtctcgacagatggggtggagggagacaataccagggaactgtggaagtcactggtgccacctatttccagatgccccacacgcgggcacaggggaggtccacacccctgcccctcggggctcttgaggccacggggctggttctgggcactgagttgtgtacagaagggacatgtgtcttatgggctgagcacatgatttccagtgcagtgtcctctctgaccccttccctcacatagctcgaggcggtgccttctccgtcagcctgggctcttcactgtccaccaccacgggccaccatggacatgtagcgtgcataggaaaatgacgtttgttctttaaaaccaaagagggatggaagctgtttgttattgcagccttgcccgcctaccctgacggatccccctcctgtgatcatggcattacgcaatctctctggaatgaaagtgcagcttcagagaaagggggggcctggaactaagattaagttttgtccctagaggaacaggagctcacaaaagaaactaagttgcaataaagaaaaataaaacgagttacattctcttcacctctgagtttgcaatcagagtttcttgtctgcttcagtgatgtgtaaactctccaatgcttgtcactctgccctcctggctaccttgtgggctccttgaggacagaggttatctgtccctcccttcagagttcctagcacaagtctcgcagtcaacaacaccttaaggtaaggtgtggatttgatgcccccccaccccacctcagtttccaaaaaataatattgctcaaaaactagagtaaggccaggatgaaatctgcaggaagaagccacctcccaggggctccccccaccatgctctgggtgggcctccagctccttaattaaaaactgaaggtcgagagagcccaactgcctgcagacccccccgacttcagcttgtagccagctccaatccatttggaatgaaagacacagttcttgggctcctgatgaaattaattaagggaaagctgacagggagatagatggaggttgcaggactcacagaaccagccagcgctccatttgcaagagctgtgtcagggactacaagctcagtctcctactggggctgcattggtatcagaaaccacacagttctggccactgttgtcaaggaggaatataaactcagggcgtcggatctcctcatttttcaaaagaactttgtaatcttgtgtaaaatccctcaatcttaaaatattggcaaataattcattttttccctccagcattgtgcagatcaaataaaacatccttccaggctggattggtttggcttagattctctgtctgtcaaacacacacaccccaaccccatcctatcggcgacacagacagccccgctacatacattgctctcactctagcaacaaatcctgcagacacttttcgttcacccagctgtcttttctgtggcttatggagagtgtgagtgtgtgtgcgtgtgtgtgcgtgcacacatgcacgtatgcctctaaattacatgactgtatccataaagaaactataataaactctagatagttggccatcagtcagcctctaaatcctccctgatgaggtcagatatcatcagaaggagcagctctcctctctggggcgtcacagaggcctgaagaagcaggtcatgcgtgacctggagggagggcagaggacacgggcctcaggaccagcgtgtgcaaaagcatcctcgtgatgatacagcatgagcagtgaggcaggacggaggacgtccgtggtgactcggggagctccctgcatgaccagccgcagtctggaggtggctgcccaagtggcctcttcagtctccccagggagccacgaggggagcacaatttacctccacttaatcctcagataaattacatttgccaactcaaagcacaaagtaagcctgtttacctgctacttgcataacaaagactgtgaaaattaaacgtatttgaaacaagtagcaggtccctcatgtctggtcagtgttttacaacaactgcgagaatgctaagtgtcaatgcacagcccaacctagagcctccagtgctcactgggaccccttgggatgggcaagggcaaagctcagcaaagaagccacatcactggggagctgacttctagaatgacagcacaagtcgctcagcagacccctccccagagacagctatcactgaaaaaaaaaagttttaaaaaacataatcatttaaagtctctgtacattttcctaagggtttacagcaaattgagaaaaactggctcaagaaaatctactaaatcttgttaagaagactgagtctgtggcacttcagccaaaacctgcttccctgcccagcttggtgtgagagaggctctgctccaagtaggtgtgggcaagaagacagggctccactccctccagctcccagtccagggctacggtatctccccaggctgggggaggtggggaaggctgcccgcatttctcattccccccaactttgtgctttagaagctctactccagataaaagcagctgaaaggttgggactcccttcctcctccaactcatagtatgcagggtgtggcaggctcagaacactggggcctcactgccctcatctctgttgactcattgggcagaggttctacactgggagagacaagctctgaagattcgaagcgatttcccccacccagtgccctgcatgagaggcagacatgtcactccacaaaaagtgggccactgtccttgcctgcagctccagagcagtgcctcaggaattcttcccaggaaaagaagctacccattaggttagagaactccaaagtgctccccatgggaactgatttaaagcagagtggagaagttcaagcctaaggtagtctgggaaagaacggagctttgcagcagggaacgaagaggaagctggtggctccgcgacaacaccaagataaaccatattccggctggtttactggagacagccagggaagagacagctcagaagagccttcctggggtcagaacaaacctcaaagactggcctcaaaaatacccctacgaaggggcctggatttaatcagatcaagctgtagagcatcatgtgccccaagctattgttgggaacaacagagccataggctggcaatgagtggaacctaacagatggtgtcatacaaacataagtagagagcttgagagagaggccatggaaagagacagagagagccctgctaaaaccactgccatcccagggtgactgtacatgcctaagactgccctctggggagtgatgtcagaggaatcacaccacaggagaaacagactgtgctaaatagtccagccaagttactaaacaaataaataagcaagcaaggagaagccatggaaggagggaatcagaatcaagggtggctacaatgtgtcatctaagatgacaagtcttcaacaaaaaactatgagatatacaaagaaaccagaaagtgtgacacacacatggggaaaaatccaggcaatggaaactgcctgtgagaaggctcagttgtcgtatttatcaaaaaaaaagagacttcaaaacaatcattataaatatgttcaaagaactaaatgaaactgtcattgaaaaagtaaaggaatgcataacgaccctgtctcatcaaacacagaatagcaacaaagagatcaaaattctaaaaaaagagccaaatgaaaattctggagtcgaaaagtataataactgaaattttaaaaatccactagaggggttccaaaatagatccaaagtggcagaagaatcagtgaacttgaagagagataaagaaagattacgcaatttgaagaacaaagaaaaaaaaaacaatgaagaaaaatcaagagtcttagaagctgtactgtaagtgtactctaaatgtggaacaccattaagcacaccaacctactcataatgggaatattagaaagacaggagatagagaaaggaacataaaaagtatttcaataaataatggctgaaatgttcccaaatttgataaagagaattaatctacacatctaagaagctcaataaacaccaaaaagtgggccaggcatggcggctcacgcctgtaatcccagccctttgggaggctgaagtgggcggactgcttgtgcccaaaagttcaggaccagcctggacaacatggagaaactctgtctctacaaaaatacaaaaattagccaggcatggtggcctgtacctgtggtcccagctactcaagagggtgaggtggaagcatcacttgaggctgggaggtggaggttgcagtgagccgagatggtgccactgcactccagcctgggtgattgaaaccctgtctcaaaaagaaaaaaaaaaaaagtaaacacaatgagatacacacccagacacatcagagttaaaatgctgaaagacaaagagaaagtcctcaaagaatcaacagaaaaacaattcttcaaatacaagggaccccagtagattaggttttgacttattatgagaacaatcgagccagaggcagtgagaggacataatcaaagaacgaaaagcaaaaaagaatcttatatctagaaaaactactttttaaaaatgaaggtgaaataaagggatttccagataaacaacaaatgaatctgttgctagcagacatgccttacaagaaataacaaagaaagttctccaggctgaaagcaaatgaccccaaaaagtaatcttaacacacacagaaacatacatacacatagcaagcaacaccaccagatggaaactcaaattcacaggaaaaaatacagagaaccagaaatggaaatcagaaggttaatgtaactctataaatatgtacttgctctccttttatcccagcttctttaaaagatacaagattaaagaaatagttacaaaaatgtattattgaattgtgccttatacagatgtaacatgtatagcaataatcagagaacaaaggaaaagagaatatgcctatataaaaataatgtttatctcttataatttagtataaatttggaatagattctaatatgctaagatgtatatagtaagcattaggtcaatcgctaagaaaataaccaaaaaaaaagtgaaaaaaatcattaagagaattaaagtgttacactaggaaatattcacttaattcaaaagaaagaagtaaaggaagaatagagaaacaaaacagatagtagacatatagaaaacaaagagaaaaattgttgatgtgaatccaccctatgtgtcataacattacatgggaaaggattaaatgacccagccaaaaggcagaaattgccagacaatttttaaaaatccagttgtattctgtttacaggagatataccttaggttcaaagatacaaataagtggaaagtaaaaggatggaaaatatatatgctctgcaaacagcaactgcaagaaagctggagcgagtctactaatcatatgggacgaacagactttaaaacaaaacataatactagagatgaagagatgttttataaatgtaaaagggtcaactcatcagaaagatgtaagtataaacagaaccccaagcaacaggaaacaacatcaacaaattgaagggagaaatacacaatacaacaagtggtgacttcaatacttcagcaatggacagaacaactagaaaaaggatcagcgatgaaatagaagacttgaacaacactataaaccaacttaggcctaacaggtatctgtagaccactccatccaacagcagaatatacattcttctcaagggcatatggaacactttccaggatagatacttactaaggcataaaacaaaccctaatacagttaaaaggactgaagtcatacaaaatatgttgtctttccacaatgaaataaaattagacatcaataatagaaaaaagtgagaaactcatgaatatgtacaaattaaacaacataaataatcaatgggtcaaataaaaattaaataaatttgaaaatactttgagatgaatttaaaatgaagacacaaaacatacaggatgcagctaaagcagtgagtagagggaaatatataactatacatgcctatattaaaaaagaaaatctcaactcagtaacctcaactttcacttcgacacactggaaaagaagaagaaactaaagctaaaataagcaaaagaaaggaaataatgaagattgaagcagaaattaaagaaacggataatagaaaaacaaaaaagaaaatcaaaccaaaagttggttctttgaaaagatcaccaaaattgataaaccaagtcaggaatgttggaaatgtttccaagtgatggggactttttgcctttgattagccagtggattctccttcctatttgggtctctaggaggcaccaagaaggataatatgaagatgaaagcacatctgactttccctgtcccatccgatcaaaccccattcccacctccccccatccccacctgccccttctgtccccacttccacctgtctcatcctgtcctacctgccccatccccacctgtctcttcctgtccctcccgccccgccatcccacctgccctgccccacctaccccatcccatcccatagtagtaacggtgcttgctgtcctccgacccaaagaccttgatcaccatgctgtagaggtgcagcccctccaccagcatccatgcgaaggcactcaggaagaagtagtgtaggagcacggccatcacttggcagggggtctaggatttaaccagagatgggaagtgagacagctctggggtgggccctgggcgtggctatgatcccagcctcccagtatccatgtcctgggtggtcttttggtcatgtgaccatgtttcttcccagggtatcttcctgttgctcaagcccagggatttgggtgtagcgcttgactcagggctagccaattacagcaccatgttgcccccagggatggtgattggttcaggagagggcacaggactcaggcccaaccaatcagcaaaactatccattccttgcaacaggattggctcagggatgggcacatgactcacctggtccaatcagggtggattctgggggctaaggcagggactatggaagagtttccctcccttcaagtgaggactggagcaaggaactttggaagccacgtggctcccagagaggtgtggagcctgccgcctgccatgtggctgaaccctacatgctgggacttctagttctaactaaattgactgcagcttccaagttgtagttacccagaactgaaaggggctcaggcgaccatgctgctccataggcttcccctcaatagggctcagggacagaaaggcagggccttgggaacctctccattccttgcctggggcctggaggccccaggtgcccaggacggagagagttgggccctgcacagtgcagcctcagatcctcctggggctccactcctctgctccctgtgagtccaggtgctgggaacagccagggcgtgtcccttagctctagataaaaggtccaggaaaccagagcccaggaaggaacacaaaccaaggaccccaggacaacccagctctgctggcgctccaagttctgtccttcagatacgcccaaggcagttagttctcagagaagaaatgtacaagccactaaatgtgtttcttgtcatcatgatctgttatatctagatacaaaataagacatacctattatttttgttggctcagcaacccctggccctgtgtcttccaggaccagctgccccttttccttggggagcagccccttcctaccccagaggctctggtgggaccaaccattacaatcatcctctcccatctgggcacaaaggtttaccctgtaggcatatcactcaaacaggaccaactggagcccttccctgggattcagacccaggtctctgggagagcgggacccatcagagcccttccctgggattcagacacgggtctctgggagagcgggacccatcagagcccttccctgggatttagacacgggtctctgggagagcaggacccatcagagcccttccctgcgatttagacacgggtctctgggagagcgggacccatcagagcccttccctgggatttagccacaggtctctgggagagcgggacccatcagagcccttccctgggattcagacacaggtctctgggagagcgggacccatcagagcccttcgctgggattcagacacaggtctctgggaaagcaggacccatcagagcccttccctgggattcagacacaggtctctgggagagcgggacccatcagagtccttccctgggattcagacacaagtctctgggaaagcgggacccatcagagcccttccctgggattgagacacagggttctggaggaaagatgctctcccagtcccctagggccaccagctgggattatagacacctggagctgctgcagacctgcctcccctcctgctgccagcacacagtgggaccttgctccccagtatggacttgaacaggcagcgtcagcatcacctgaatgattgatagaaatacagcattctgagctccacccagagctcctaaaccaaaatctgcactgtaaggaatcctcatgggaggtttcacaccggagcctgagaagcgtccagcaggagaacatgaggccagtgcacaccccatccattccacggtgcatccaggaacttctcagatgctcccgagtctgaggtggggtgccctgtgagggaggtgcttgctgccacatgaaggtgggtctgtccataggcagcagccccaggacatgcatggggacaaagggctctgctgggcagtgaggaggagaggctctgctgacccgctaggcatgggataaagcgttcatcttctgttggccaatcctgattgcaccctaagaccacaggcttatcctgctgggttcctaagagcttctgccagaaccagctccctttttcctcccacacatggagcaggcagccctctgtttttctcttccatcaactagcttacaagcccacatcattccactgctgggtcacttcagagagtctcagctctttgccttctgtgaggtctaagacttcttagggccccagagaaccccccactccatgcaaagggcagggaaagatggcatctaggtctgcaggtctgcttcgctgaacagaggtggcacaactgtttgctgtcaagcagctgatgaagggcacagcctgcagccaataagagtcttggtctgcccacaccaggccgtcagcttggccaaggactgtgagccctgtgccccaattcctttatctgtaggctgagaggatgacagctggttagagggtgacatggcttcacagatgcaagcccttgtcatggtgcctcgcgcgtagctggtgctaggcagtgtgagtgggtggcggcagcggcagctttacccgaggctggcgtgcagcacagaaaccagctcatgcacgtcacgatctctgcttcccccgagaaaaccacagccctggttgtctggggagatgggttctgaaatttgagttgaaaaagctagcagaaggtgccacccggtgacatccgaggaggcaagggaaggacagcgcaggaacacggagctgcgcccactcaccgtgcccggctcgaggcggaaactaatgagcagcaggacctgggccaccagcacggcgaaggacaggttggcgtggatgtggtagcgctggttccggatggtgctcacggagctgaggacagaggcagggtgtgaggcctgggccctgcgccgacccagtcccccaggctgggctccctggccccacgaagtccctatatccattcctccaagagcagccagaggggttgctgtcactccctgctgtggaccatcgatggctccctattgctcttggatctgaccccagctccttccatgcccacacagccctacacagtctgaccctgggccatggctctgctctgagttcctttctttcccagctcatgttcctgcttctcaaagccccagcttattacagctgtggggcctttgcatagctgttcccatgcagtaaaccctctcccaggtccccgcatggcggcccaaatgtctccctcagcgtaagcttcctgaccactgctgggacctagctgcacccctcgctctctgccctgctgcctcgtggcgtgatcacagtgaagatgtttgttctcgcttttgtttacttggttattgtccagcccccatccaagcatgttctcatctctcttgggcacagtcgggccctcaaagccgaccacacgcctgtgctgaggaacgtgggagcgagagtgaatatctgagcacagggctgaggtgtccccaggcccatggccatccccttttgcctggctcgggttccaccagaattcctgtgcctgggctgggggcctttccagacctttccagctaagcctggtgctcttacctccacagcccctcccctctcccgtgtctcttccatcttgagatctgggtgcaggcaggggccgagagactgttgggtggattagaaaaggggactcacgacagcacggcgaaggtgaccagcgtggccaccaggcagagcacggagagggagcagcccacatagctgatagacgacagcgccacctggtgtccgcgtgcaagctgcggggagcagagcagaggcgtcagcagcaggcccaggcaccccatcggagcctgaagctgcagagggcccaggtgggtgcacagctggtcccctgtgagtgtggtgctgaccaccaagcctgcctcccagcccaaatgtctgttgctgccaccgacagaggccggtgctggggttgcagccctggttctgtgcgtgcatgtccggtgccccgaggtgccctacagaacactgaggctccctcagccacagtctccagactgtggctgcctggcccgggcaggcgctgagcctcctgtctacactgcaatacacagggctgcagactaacagtcagccccagagccagacctcccgggttcaagtcccagctgggccacgtcctggctgacaatctgggccatgtgacactcggctgtgaaatgaaaataatgacccctctccattcccacagtggccgcaaggactccatgaatttacaaacataaagtgctggagcagctagggaagagctggttaccgccccggcctgaggccacgaccctcccagtccccgcacaaagtagtgctagggaagagctggctaccgcccccgcctgaggccacaaccctcccagtccccgcacaatggcttgcccgcctgcacactgtggggctcaggaaagctctctaaatggacacggtggtgatcgccagcaccgtgtctgctgggccccccaccttgcgggaatgcggcccaccacgacacacctggggatcaaacgcctgccgcgccgccccggatagaaccgttgccgtatttcaccgaccgctcagtcccgccggggccccctcggtcctgaaggcgccaacacgcgctcacacgcgtgcgaccctgcgctccaggaggctccgggctcctaagccacaggcctggaagggcagcctcccagctgctcacgtgcaggagggcgccacgtgcttcctcctgtggcccatggctcttgtcagaggcccagctgaagcctgaagcctgcatcatgctgtccctgtccggcactgaggccccagaccccagacccacgtccccccgtcctccgagacgcctgcctccagcttcctcctgtggcatgcgggtagggggagtctaaatgccttctccccgatcaccaggacaaaggaacaaaaggaggccactctgagtgtgtaaggagctgttggcaatgagggaggagatgccgcaggcccagggggccccagctcagggtgaggcaggtagtgcactggaccacggggagcaacctggggccagggggccatgggaagcccgaacactcagcaagcaccgccttcaactgtgattcacagcggagtgggctcacgcccgaggggctacagacgtgctagattcctgggtgcgtggggctggggtaggggcagcctggacgccacagcctgtgcctcccattttagcaggagctcattttcaccctgcaggccctggtatcttctctgagatccagtgcttgcagaaggcagggccttggcctggcccccttcaggagtgaaacagctgttgccatgacaccagcagcatttcccctggaggggcccttttgtgctctccggctcagggacaaggcagagaggctgagggctgggcagagccacctgtgctgaacgccggctcaggcctcagcaggcaaggacctgcgcacaacttccaatttcccaggggctggacttccctctccacggacgttgtggctatcacgggaaaggtgggcactgcgtggccagggccagggagacggaagaatcccccttccaggttcatgatgccccagggagagaggaggggcagtcacaggggagcccatcagtatccctgaggatgagagggaactttgaagaaatggggcccccgtcccctcaggagaatggctgcggtttcttgttcttgtttctggttattgcagaatcatgcagttaggggtaggagagccccactactccttctcccatggataaacctttttccttcaactcctgggcctggcctcccatatttgagaagaccttcaggctgttgacctctgacccctgggaatcacagccatgcccgtgggcttccctgcagcaggtgccacgatgtcccctgggtgtgtgcctccatcttggcttcccctgaccctcatgggctctcctgcactgggcttgaggaactcaaggtggagactttggtgaactcacaccgactctgcccagagcccactccctatcgctgcctggcaacacccagggcacctgggacgctgtgggcgaacaggggcctcccgggggcccgaggctgcccagtgctgcccatctctgctccaccaggtgggagctgaggtcacaggcatcttctgccagcagaaggggccttgtgggaggggtaggcactcatcagtcacctgccgagtatgtttggcaaaacaagttcctcaacaggcgggtgctgccagtgcattcccaccgcagcattctcggcaatggaaacaaacgtctccacctgcagaccgacgggccaagagctactcccattaatcgcatagccgcggtgggtgaagggaactcagtttctaggccacattccccacgctaagtgtgtgacactccagtttccgcatgacattattagcaaattgtccatgaaatgatgtttctgctttcagataagtttggaaaaagctccattctctgcaccccttaaaagactttttggatgaatataaagccacttaagagttctgaggattctgcaggtaaaataaacccccctgttcagctatgttcaacttggcatctcttaaactctttggaggaggaagggaagagacccaatgacagcaatagagatgtggtttaagaagtgctgttttagaggaagtgagatgtttcagaaactaagaataaaaccaaatacaggacacactgacattatactggatatgcaatctttctaagacaactgaaaagtcttgtctctcacactgatctctgcctagagatggaagtaagggtcagttacaagagttttgggcctcagcagagggaatggttcttggaaacgaacgtccagctcttcagcagttaccaaactgaattcagttaaaaaccaatggaggccagacacagtggctcacgcctgtaatcactttgggaggccgaggcgggcagatcacctgaggcgaggagtttgagaccagtctggccaacatggtgaaatcccgtctctcctaaaaatacaaaaattagccagacatgatggcccacacctgtaatcccagctactcaggaggctgaggcaggagaatcacttgaacccgggaggtgaaggttgcagtgagccgaaatcgtgccacttgcactccagcctgggcgacagagccagactccatctcaaaaaaaaaaaaaaaaaaaaaaaaaagaaagaaagaaaaagaaaaaaaataaaagaaagaaaagaagaaaaatcagtggaaacactgctagtaaaggaaagaaagcagtggtgtccaaaagcctgcctggcccactgccctgggaagccccccaagagatgcaccccacacaggtctccaccccacaaagccctggctcctccccacccctgatcatctctgctctacccaagtcatctcatgtcccaccagagggatgcatatcactctcggacaccatagctgcatttcatggggcatcgtctctcccccagggacacgggaagccctgaggatgcattagggaagcttttcctacctcatctcgcagctctaagaacagcagtgagcagtactgggaacaatggtaatcagaggtatttgctgaaggcgtcaggggagaaagagccctcacatctacccatctgactctgccactgattcaacagacagatttcctaaatctacatcactgattaatatcttttaaattgagaaaataaagctttagctcatctatttgcaaatgcagtgaggttccagtgggctgacatgagagttcgctgcacactgggctgcagttggtcagccaactccctaaaacatcttaatctccgttcttggccacccattctactgggagtttctgacaaatgggagtctagccctagccccagacccacacctacccacttatgccttaagccttccaaccatattatcgatcaaccttatcgccaaccaaccatgccatcaaccaacccattatcaatcaacccaccatcaaccaacccatcatcaatcaaccttaccattaaccaagcctaccatcaaccaaccttacgttcaaacaatgcatcatcagctaatctgactatcaaccaactccaccatcaaccaaccttaacatcaaccaacccatcatcaaccaactccaccatcaactgaccttaccaacaaccaacccatcatcaaccaacttcaccatcaaccaacctgaacatcaaccaaaccgaccatgaaccaaccttgccatcaaccaacccatcatcaaccaatctaccagccaattccaccatcagccaaacccaccatcaaccaaccttaccttcaagtaatccactatcaaccaactctaccatcaactgacgcatcatcaaccaaactcatcataaactcaccttcaacccactaccaactaacctaaccattaaccaacccattaaccaaatgcatcataaaccaacctatcaatcaacctgattatcaatcaaacccatcatcaaccaacccatcatcaaccaactttatcttcagccaatcctaccctcaaccaacctactgtcaaccaaccctatcttcaaccaaacttaccaccagcaaacctcaccatcaaccaaccccaccatgaaccaaccccaccatcaatcaagtctctttatcatgtacttttatcaaacccacccaaagccagcatcatgccaggcacaatggggagcactaaaaagaaagacatatggctcttcccttgaactgagctaatagcctgaccaggcagccttgaaatgattgtaagaaacataaggccagacatattggagggtcacatggtacatggtgcttgagttataaggtgagcccataggtaaaaatgatagatgatcaaaatgacctttgaaaactcctgagatctcccataaactggagtctccatggcttctgcatgtaacgttatacattcttcttccacacaatggtctgaataatgaggccgacttcaggagggatcaagaagaaatggcatgcacacgtcagggtctgcaaacctcactgcttcaacacagctttcaagtccacagagtggactgaggcagaaggtgacaatctaggtgatcctgatagtggctcactgccttctctttactacagggactttctagttgtaacacacattcagccatggatttgtcattgtattacttaaccctgcaacctgtgttaaatgttgactccaccacgacctgcacacagccttaggaaactggaagggagggagggtgatctgaaggagggggagagaaatactgagtgggcgttaggagggagagggcttcacacaggcctcaatgcttgggcaggaacctgacagacaggacaggagacagccttctagaccagagtgatgtgagctctgacggtaagttacatgaagacaggtcgactgtcttgtttaattctgaatccccggggcccgacagaggatctggcaaactctaggcatcatggagaatcacangagagtggttggaaatgacagatacgaggcacctgctgcttgaaggcatcgactcctcatagcagcctgtgagtggacagcatggtttccctttacagatgaggacactgaggcagccgcagtaaatgactgcccaccaccatgcagctggcgagaggcagggctggggctgacccgtgatggcccctgctacagcagcaagcatgtattcagcacctactgtgcaccatgcacggaagtctcattgcagtggggaagcgggtgatgaacaaagacgtggatgtgtaaacgtgaataaatacctaaggctgccagtgtcgtgttgatgaggctgtgatggaaacacacaggggcggtggcggaggtgactgcagagggaagagggatggtgnnnctnacacggccatgatctgagaaaggccctgacccaggcccttccctctggcttggaccacccacttcccagtcctgttgtcttccccccatccggtatccnccccagtgctctcttgccgccctttctccctctctccccctttccccccacccgtcctcttttcctcccgccgtctcccgtacagcccttttcgttttcctgttgttaattttttgccgccccccctcgcacttccgttggcttgtagttctcactctccgtccgtcctgccccctccttccccccccctttcccttttttgttctctttctttttttcctatccccccccctcttatcacctaacccgttgtcgcttctcttccccgtctccttgttactaagttatatttctcccccacctcttccccgctcatcaccccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttttgatatgctgacttgcatgaagggtgttcaaaagcgattgagaatacaaatgggaaaagtaatgtgacctgggaaaatctatacggtcgactcagtcagctgatttcttagcccataatttatctccagcaacattcctactcaaaacattctcagactctcttccatgtgtctgaagccagtacatttttaacaaggacaggtcttcctcgtggtgaaaaaagtgaccatgttttagtccttaatccagcattgtttcttccaggaaagcatgctttattgtcttcaacgctgccaagcctcttcatgacatccacagcaagccccgtggtgagcagacacatcttccttggtcccccttgctgatgttcttctgcttgggctgtttgctgggagagagaaaattccattaggtgtctgggctctctgttatcggcagtacattgtctgggaagaaataacaaatggaggggaagccaactgcagtactaattcttggtgctaagagtgactgaagggaaaactctcaactcctgccaccaggaacctcaggtgcccaaaaggaaataccgggctcattcatgggacgtgggcgccgtgagtggggagtgaggaatctgccctgcttggcttctctctatgcccttttcgtttgatgttagagaaaagttcaattcatatagaaaaattcttgtctggaattagtgtttgtagttaaagaactgtcctttcttgagaacgttaatataatagtgagtgcacagactctgacccatctgcttgggttcaaatccaagttctaccacttatttttgagtaagcctctctgcgcttagtgtcatccatcaaatggggacttattttgtaaggttgttgtgaggatgaaatgttaatataagcaaaatattcacaaaagtgtcagatacatggtaggagctatattactatcatggtataaaaacatttgaccagctgggtgtggtggttgcacctgtagtcccagctgctcagaaagctgagacaggaggactgctcgagtccagcctgggaaacacagtgaaaccccatctctataaataaaaaaaagagcagccaggcacagttgctcatgcctgtaatcccagcaatttgggaggtcgaggcagaaggatcacttgaggtccggagctcgagaccagcctggccaacacagtgaaaccctgtctctactaaaaatacaaaaattagccaggcatggtggtgcacgcctgtagtctcagctacttgggaggctgaggcaagagactcgcttgaacccgggaggcagaggctgcagtgagccgagattgcgccactgcactccagcctgggcaacagagcaagactcagtctcaaaaaaaaaaaaaaaaattaaaaaaagcattcgacccagagtaggacacattaaacttctgtataatattttggttttagttcttagtagaaactcatgttgccaatttctttcagatgcccacagatgcctaccatcccatcataaccaacctgacagaagagagaaaaaccttccaaagtcccggagtgatactgagttacctccgaaaatgtatccctcagcttacccagtaagtccctctcggagcagacagccttgaatctcaccaaggtaaggctatttgatgtctgtgtctggtggaccgggcgtggcacccttaccgggaccatagatgtttctgtttgacctagatcgagtttaaaaaaagcaggaacttttactgaaacgtttgggtttcaggcttctcatgaacaaccagctggtgtggccctcctggccagctctgtacagctcagcggagcttcctttatgggcacttgagtctttgctgtggtttcccaatgcccaacctgcctggtcccccctgtgcagccacctggcccccgcgggcgtgtggttggcaactcctagactaaataaactctgctgcctcctggcaacaggtaaaaggtggagaggcctcactggcagatccagccgtggggcgtgggccacagcctgtgcacagtgggagtccccaaagctatctaaacacttagagaatgcaacatttatggcattaaaatcaagatggtttctctttctgctcctccaaatagtttccaggtgaaggcagagggtggatcgtgggctctcgtggacttgctgtcttctgttttagggctagggcttatcttggtggatgcgaagacagaaggggttttgagattggctcaccttgaaagcacagcatatgggttaggagcagggtatatgaagtcccacggctgcactgacctttgatctgcagttactctgtgtccttggtcaagtgacctaacatctctgcctcacttggctcctgagatgtggaggaaataataacagcgcccacttcatcggggataagtgggttcctatgtgcacagaacagtgctgggtacgtggtgagcacttttcaagggttcttaattcttactgatttccttgctgaagtcacacccaaagaagcacatgcagagccatgtgttcagggacttgagacatcttggaatggagggaggttgccctcagcttttctgtccacgtaagagaagttagacttctcagatttcattcattcattcattcattcattcattcattcatagaccatactagattctgggagtgcaggatgaccaagtgctaatactccctgctttcaagaggctcagggttgagggagtgatgacaggtcatggagtctgagaggggctttaaagggaactacatggagctgcgggactcagcggtcctggagtcacagagacctggctttgaccccagctccaccactcccggctctgtgtccgtgggaaggttatttaacctcagcacacctgcttcccactgtgacatggggacagtgagatcgcccatgtgtctcaggtacttctggctgtgagaaacagggccctctgcttagcggacttagacttcaggccatgtactcgcttcaggcaacaagaggcccagaggcgggaatcctaggagtcactaactcagtcttcactcacagcaggggctggataggcaccgccacaattctctcggcactcggcccttttctcgcccagctgcaggcccccagcaccctcgccttaccctggcacgtccaggagggaaagaacgggtcgggagactccctcctcgtcagggggaaatctttcccatggttccctttgctgagacaccccctcacatctcagtggccagagctgggccacatgaccacacctgggccaatcactaaccaaggggagtgggattagcaaccagctcagccaatcatgaaggagctctagggtggggccaaggctgcccagtgtgggagcgcttccgggctccgaagggaaggacccgcggggtgttgggtggaaagagcgggtatagacaagctggaaggtccttatgcatgtatgcacaggaccgggcgtgaggccccgagacagggcttggtatgcagtaagtgctttattaatacgaacactcttgtttttgttgagatgggctacaaggggtgactgtggcaggcggtgccttctatgcagttagcacttagtaaacactcacactccgggcactagtgccctgcctgtagctaaggtatgcagtcggggcttcatgcccacttggcactggcaccctcccctctagccgtggtacacagtcggcgctcaataaacacccactctgggcacgggcgccctcccgtctgactagccatgggtaccctgcagcatcctcaggaatgtgcagcagagacttagcaggctccctctgtgtttccgggtgtctagggaaggagggagtccgagtgaggataaattaattagacgaatgttgattaaacacctacttgtgggtgggttgcttcattaattataaaatggatggcttaatgagccacagttgcatgctcatgagtgggttcactgatgactttattaattaagcacattgtgcagcctccgctctctgccagatgctgggcttggtgctggggatgtgtgatggatgtgccgggcattgcccctgccctcgtggggcttgtggccaggggcatgtccagttagctggaaagctgcctgtgggatgctggtcctaaaggtcactcctcagaaccttctagaagtgtgtgtcctgccctagggcaggccggagccactgtggcccaccgcctgcctggctctgtgatctcttcatcacgggctagaagggtctgtctcgcacctgacactgcagtggcagcagttagccgtgtcattgtggcccacaccacccagcaggtccctgaactgagtgtgatagggtgtggccaggctggcaggtctgtgggaagagttggtggtggggctggcaggagtgagacagggacaaagtaggacaagcagaacttggggccaaggccagacaggcacgcaccccagaaaaggccaggcagggctgccctctgcggagcccaggtgtgggggctggggttgttgggtggggatggcgtatgcgcagtgaggtgggtggaggccaaggcagctccgtatccttattggctgtctggtttgcaacacaaggcaatgcaggtctacacaggaaacactttctttttaagcttggtcacttttactttccttgctgcttttcttccttctctccctcagctatacctgagagtcagaggttgcaaactcatgtggcttcaggggccaaaggaaatggatggcatgggccagacagagcaacagtggggagtagagagaggtagtggcagcctgaatgcaccgcctcctctgcagccagcagttgctagcaactcaaggccacctgtctgtaaccgttagggtgactgattctgattttgcaagaaaaaccccagacctggatttttaaaatggaacatctcccaattttaagaaatgggcagtgaactgaaatcttttttttttttcaacctgttttattttattttttttaattttttattgatcattcttgggtgtttctcgcagagggggatttggcagggtcataggacaatagtggagggaaggtcagcagataaacaagtgaacaaagaaacaagtgaacaaaggtctctggttttcctaggcagaggaccctgcggccttccgcagtgtttgtgtccctgattacttgagattagggagtggtgatgactcttaacgagcatgctgccttcaagcatctgtttaacaaagcacatcttgcaccgcccttaatccatttaaccctgagtggacacagcacatgtttcagagagcacaggtttgggggtaaggtcatagatcaacaggatcccaaggtagaagaatttttcttagtacagaacaaaatgaaaagtctcccatgtctacttctttctacacagacacggcaaccatctgatttctcaatcttttccccacctttccccctttctattccacaaagccgcgattgtcatcctggcccgttctcaatgagctgttgggtacacctcccagacggggtggtggccgggcagaggggctcctcacttcccagtaggggcggccgggcagaggcgcccctcacctcctggacggggcggctggccgggcggggggctgaccccccacctccctcccggacggggcggctggccgggtagaggggctcctcacttcccagtaggggcggccgggcagaggcgcccctcacctcctggacggggcggctggccgggcggggggctgaccctccacctccctcccggacggggcggctggccgggcagaggggctcctcacttcccagtaggggcggccgggcagaggcgcccctcacctcccggacgaggcggctggccgggcggggggctgacccccccacctccctcccagacggggcggctggccgggcggggggctgacccccccaccaccctcccggacggggtggctggccgggcagaggggctcctcacttcccagtaggggggccgggcagaggcgcccctcacctcccggacggggcggctggccgggcggggggctgacccccccacctccctcccggacggggtggctggccgggcagaggggctcctcacttcccagtaggggcggccgggcagaggagcccctcacctcccggacggggtggctggccgggtggggggctgaccccccaacctccctcccggatggggcggctggccaggcggggggctgacccccccacctccctcccggacggggcggctggccaggcagaggggctcctcacttcccagtaggggcggccgggcagaggcacccctcacctcctggacggggcggctggccgggcggggggctgatcccccacctccctcccggacggggcggcttgccgggcggggggctgacccccccccccggacggggcagctggccgggcagaggggctcctcacttcccagtaggggcggctgggcagaggcgcccgtcacctcccggacggggcagctggcctggcgggggctgacccccacctccctcccggacggggtggctgccgggcggagacgctcctcacttcccagacggggtggctgccgggcggaggggctcctcacttctcagacggggcggctgccgggcggaggggctcctcacttctcagacggggcggttgccaggcggagggtctcctcacttctcagacggggcggctgggcagagacgctcctcacctcccagatggggtcacagccgagcagaggcgctcctcacatcccagacggggcggcggggcaaaggcgctccccacatctcagacgatggggcggccgggccagagacactcctcgcttcctagatgggatggcgccgggaagaggcgctcctcatttccctagacgggatggcggccgggcagagacgctcctcactttccagactggggcagccaggcagaggggctcctcacatcccagacgatgggcggccaggcagagacgctcctcacttcccagacggggtggcggccgggcagaggctgcaatctcggcactttgggagggccaaggcaggcggctgggaggtggaggttgtagctagcccagatcacgccactgcactccagcctgggcaccattgagcactgagtgaaccagacaccgtctgcaatccccgcacctccggaggctgaggctggcggatcactcgcggttaggagctggagaccagcctggccaacacagcgaaaccccgtctccaccaaaaaaaaacgaaaaccagtcaggcatggcaggctgaggcaggagaatcaggcagggaggttgcagtgagccgagatggcagcagtacagtccagcttcggctcggcatcagagggagactgtggaaagagagggagagggagaccgtggggagagggagggggagggggagagggagagggagagcagaaatcttaaatgaaattatgtgcagaccaaatacaagacatctacgaggcaggctcagcctgtgtgccatccctgtgggacccctggtgtagacctgttttggggtatctggctggggaccctggggatgagtcatgcagatttacccaaaaccccagtgatctctgacctgatgagaagtcaaagtttttggcatccattatacaagttagtttctttcttttttcttttcttttcttttcctttctttttttgagatggagtctcgctctgtcacccaggttggagtgcagtggcatgatcttggctcactgcaacctctgccttctgagttcaagcgattctcctgcctcagcctcccaagtagctgggactacaggcatgcaccactacacctgactaatttttgtatttttagtagagatggggtctcactatgtttcccaggctggtcttcaactcctgacctcaaatgatccacccgtctcagcctcccaaagtgctgggatgacaggtgtgagccactgcgcccggccccattctacaagtttccatggtgtcctggcttctcacctgtccactagcagctggacgggaaaatggcaaggggtcatttcctgtactgtaccgtgaggcagtgattagctacgtgtggctcgtccaactagagatgtgctgtgagtgtaagatgcacactggatttctaaaactttgtgcaaagaaaagggaaatatctaattagtaatttcatatggattctgtgttgaaatgacaatattttaggtttttgagctaagtaaaaatacattattaaaattagtttcaccttttttattctacttcttaaaaatgtgcttgctgctagaaaatttaaaatgatagatgtggcccatattatgtttctgtgtgatagactgctctggatcaagagtcggcaaactatggccctcgagtcaaatctggcccgttgcttgcttttggaaataaagttttattcatgcatgcccatttgtttgcatattgtctgtggctgcttttgcactgccatggcagagttgagtgtttgtgacacagggcgtgacccatgaggcctgacctcgttcctgtgtgacactttaagaagtttgctgcccctgctccggctcagtgaaggcaggatggtgattattccctatttcattaattcttaaggccttgcactctaaggtctcaaaaagcatttatctcataaagataaacaaatgcatgatgagttttgatgatgtgctctaagaatttagtgtctcagagtgtgaggaagaacgtgagtattctggagatggcggtttggtggaaatatgggagagttcggtcagcctctaagtttaattctgatgctgatagttggagacaaacagttaagactgtgtgtgaataatgcagatgagtgaaacggacatgagcgtatgaggcagtggggatggcggggtctggagtgggctggggacacatccactaagccggtgccgctcagctgtggtcaattatggttttatgggaatgtgggctaaggggtgtccaagagtctgcttttttaaaacgaagtagaaaattcacgttttcatttaagtctcctgattaggaaacagtagaaattaatttcattgtttccttagaataatagtgagccgaaccaaacatggttttaaggtgacctgaccaagggcctgagtagcttctgctttctagagaggtcattttcagtgaacacgagtgcttccacgtcagtttggtttctcgccccaagaaaagcgcatccagcaggtcatgattttcccacacgtctctccactccacgggctttcactgagggcctgccgtgtcccccaggcgctgtgctagggcccctgccgtcactgagcagtgttcattctgacgttccggtgctggtcactgactcgacagggctgccacaggagcaaataagataacgtccataaaagggcttcgtaacatatcatgtggtccatgactcagctatttttgttgactgccgtgcataaaactgaactggtggttgatagagacccattggaagatgcggggaaaactgaaggtcttcaagtttgttgcctaaggacaggtgctgagcagtgtcattttgtccacctttagaccttcttaaaagccgtgggagagatccttctactgcctggttggattgctctgtcagaggtaagagaaaagaacatggtcggtcatggtggctcatacctataatcccagcactttgggaggccaaggcgggtggatcacttgaggtcaggagtcaagtccagcctggccaatgtggcaaaacccatctctactaaaaatacaaaaattagccaggcgtggtggcgggcacctgtagtcccagctactcaggaggctgaggcaggagaattgctggaacctgggaggcggaggttgcagtgagccgaggttgtgccactgcactccagcctgggcaacagagtgagactctgtctcaaaaatcttttttaaaaaaaaaaaaagagagagagagaaaagaacattttgatcttcaaaacgtatgtgcctcgggaaccattttgtcttcctagaagtggcataatatggcccagtcacatccacaaaaagaatgatgtatctcccagtcctgacatctgggatataagagctcattttgagtagacatgcaactgattcagaatgccttgtcctctaaggcaaaagaaatgcacgtgtgtcagtaatgtgttactgtcctaaacatggaagaaggaaatgatggttttttccccatgagaaatgtgtacttggttcatcctggtcatttcatgtaatatgtattttttttttctttaccatcccatcattcttgaatgacaatagaaagctttttatgttaaaagtcactggatttagtaagaaaaaggagaatacatgacaatatgtacttcatgattaaggtgcagaaaaaaagcttctcttgttctctttactcaaaatagctagaaaggagaatgaaataatttttcctatatttctgaaaataacttgattgtacttatttaaaaagaaaacaaataaatagttgtggagaagttagaaaatgcagataataaaaaacaaaataaaaatcacttcaaatcctaaaactgagattattaacattcttgtatatttccttatagtctagttttcaattcacttatatatgtattcaacagatatactgtatatttgacttaatttgtttttccttaattatgtcaataacactttccaatgatactaagtattcacctgcaacactgtattagtcaggacaggccagggtgcactgcagtaacaaatagatccctacatctcagtggctcagcacagtagaaatttacttctctgccatgcaaagtccagagtgagtcagaggagcctcttctccacccagatactcagggatcctggctccatctgtcttccggtgctggcttctcaatatgtggtttccaaggttgccaggcaggggcagagaagggtgaggaggactcttaactgccttggcccagaagggtcccaaccacaccaccatgatattaaagtgctcattctcctaagccctgataatatttgaaaatgtttgccagtttgagggcagaagtggcattttattctctcattattaataagattgcgttagagtttacatttgataaacttttgtttgaataatttcaagtggaatgagattaggtttaacagtggcaaagggagaaaaaaaggctcaagaatgtaagatggatacagtcttacctagaaaacaattcctttttaaaaggtttgacctctttcatgatttcaaggggactttgtgtccaaagctgcaggctgggaacacccagaggacagccaatggaagtatccaggcagacgtattttgtgcatgattttaattaactgcttttgaatgcaaaatatgcaaatctgttacaaaatatgaataaccaggaaactgtccagactcaggcagggtccaatatgcattaaagagaatgcatgaatcggtctctaccccacagaactgcatgccagaaacacagacttccatgtgcttaactgggcctggtgactgaaatcaggctatgggcctaaaagcaaatatctaaaattggcctcagcattctatttccagctcatgaggctcttctgaagtgcgtgtttgtgggagaatgctgaggacttagcagcaggcaggtgcttccccagaaaggcaggaagagaagcagtgaaggcagagctcactggcccagctcagcagggcttaagagaggcctctcccctggtgatgtgtgtctgaggatgagggccccctgctttcttgggggcagtgtctaccaggatcctctgctctggaactcagaaaggaaagagggctcttggagtagaaggcaagctcctgggaagtcaaggcagccagagatagctctgggtgccggcacctcggaagcagccacccttcatggagaaggggacagagctgctggtgtccccatcccagagtggacctgggggcgatcagcccctcctcgtgaagcacagggaggtagggggagggtctgggatgtgctgagggtccctctgtgagttcagggaggaggcaggaccaggagttgggtcccctcagtccccgtgtctgagtgtagaaatgcaggaaccggcgatggctggggtgatgggtccacctgggctgtgtccatgctccgtgagctcagtcgggtgtgtggcctccgtgtggtcccctcctgatccatgggaaggggcagttgtgtgacttcttcctccctcgtggccaacgtggggaaacttgattttgtgtgcctggtgcacctgcctggtgccctggctgagtggggtggattttcatggctcctggtgcttgtgttgctgcaggacagcgccgtggtactgagtctcatcgacactattgacaccgtcatgggccatgtatcctccaacctgcacggcagcacgccccaggtcaccgtggagggctcctctgccatggcaggtagctgtcgcttgtaagggtgagccacatggcaggggcgggggctggaggctgcgtttcactgcctgtctttttacacccttagcagagagccatgctctgtctccctgactgctctgcctggcacaaaccacatttggaaggaaaacccgtggtcagatgagggcaggtgtgttcggccatgatatgcagatggggcccataagcttttcccagtgacttgggagccaagctcctgccctgggatgatggtctcggttcagagcaggaggcagaagcagcagtgcctgcaagagtctgtggaataaaaggggtggcctcgggtttctggcgtcagcttgctctcagctgggctccagggtaattgtcacagttgtctaattgtagaggcagaggtgatgacctttcgattttaaaagtctttaccaggagtgcattatcctgctgatacttcgctgcaagagccgagctggggaaaatgggctgaagctacaggggttagtttagtcgcagtttgttggccgtgttgccctcgcctgctgcgcttggggaggagccgatgtcaccgcatcgctgagcacagcccatccttgcaccggccttgagagctgggggctgtgctggggcggagggcgcccaggtgaggagccgcgccccgtgggccggaatgctgagcctccccgtggcagtcactgcctgggctcttcattgctttaccctttttttttttttttttgaggccatgctttctaaaggtaattatacttcccgtggggagcttgtcctgtcaaaaaagaaaagcagacggggttttgcagtctgatttcctgcagcctgtgagctctgacgggacttccgctctctcgctccttccaccgcagagttttccgtggccaaaatcctgcccaagaccgtgaattcctcccattaccgcttcccggcccacgggcagagcttcatccagatcccccacgaggccttccacaggcacggtgagtgtggctgcgctggactcccttccggggcggctccctcaagtctttctgaagagtccccaagctttgctgggtgcccaccgcgccagggagctgcggtgctcccccgggccgcctgcggtgctcccccggactgcctgtcctgtcctgcaggagagggactgtgggcagccgttctcaaagcgtgtcctcaggccaccctcatggacacgcttgagaggttccttagtgatgctaatgctgtgcccactccaggccactgaactggaatttggggtggggtctgggagcatctcaacctgctcgcctggggaatccggcccactgggaagtcatcctacctacatcctcctaaatcggcacacacctggtcagccgaagataaaaagatggggccacctccccttcctgctcaggtagctgtgggccaggtgaggggttcatctgttcaggaacctggggttccactcctgtgcaggcctcagtcgagtcacataataaaaaatgagaggctcaggggaccccctgcctctgaccagggagccctgttgggagcccagatggccctggctattttttgctacaatgaccgtcaccctctctggttcctggaaaagcgaatatgactctgcagacatctccttcctctccttccctccctggggacctcgggcaagcaggggagagcctcagatttttgcccctgccaccctggccagaggccacgcccccttcccagggttctgccttagggatggggaccaggacagccctcatcagacatctctctctgcagtggggagcctgtctctgcacccaccaccatcttgattgtctgtgggaaaggtgccccgactggttctctgccctgtcctcaactagcatgatgtcaggtgtgccctgctcctagggcagaggcagggatgtccctaccccagaagccaagggaagggcccagggacgatgccaccttcctccagcatcagcagggagggcccagggatggtgccgacatctaccagcatctcctggccgcatgatctgctgggagtgccctgatttccaatcctggcagagccgtggccgagccatggagtgaaatagcaaaagcacatgtgaccctgcttcatggctggttataatagaggtgtgaccaggtgaaggcatacagacttcccagtggctgctgcccccttgaaaacctgcattctgcctcactcagtgttgccctaaatcctctgcgtgtggagggcagacgggatgcactcgtggggcaaggctggaggctggcactgccccctgttgacttgcaggagctgtctccctgcaggggctctgagactgtgtgatgccctgggtgagcctggctctccctgcaggggctctgagaccgtgtgatgccctgggtgagcctggccctccctggggggtttcagcctccacatgtctggagctggctcaggggatggagcagggatccaccgtcacgctgctgagttgctgcagagtctttgtccttgcaaattctgcccgagtgtccttcacttccttctccccagagggttcttaggagtgaggggcagcaccatgcatggcngggcgtgggctttgtgtttttcctgcctgtggcctggagcgctgacagcgcctgcccctctgctctctctgcagcctggagcaccgtcgtgggtctgctgtaccacagcatgcactactacctgaacacatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccagttcatcatgatggtttctagaccctgcttgatctcttcagcctcctgggcttccctggtctccccacagcaccagccccatcctctaccatgtccctcctggcttgggttccgctgtacactggagcctcgtccctcatggctcaccccctccatagcgcctgagtctcagactcaaacccccattcccccaccatggcttctgaggccccgcatgctccagccccagcccgtgcctctgacctgcctccatccaccctctcccttcatcatgggaaagcaagaccctccccgctcgggattggacttggggagctggttatgaaggtgagggaagccctgaaaaagcagagaaggcagtgaggcagcccagacagcggccaccgtgggagaaggcagtgaggcagcccagacagcggccaccgcgggaggacagtgggagaggggacagcagcagagccaggccgggccaccagcagaaactggaaccagaccagcctgcccaggtgaggctggcgcgggggtgcagggaagggtctgcatgcaggcgctggagccacagggggacgcccatgccagcaggagcccaggcaggaggctggccccttcgcccaccccagcagcaccatctctccttggttggacttggcaggaagccaagcgtagagcagagagcagggtgagcagaggatgggctcccgggcacaagagcaggaactccgggctaggtccacactccacccccacaccagcccttgaaccaaccatctgctccccaacctttgacgcccaccctgtcccggccaggctggctcctgcctgtctctggtctctccgcggctggcatccaggctctcacggggcctgtctcccctcagggcagccctcagcccctggctgggctgcactcctgcccttggctcctggacagcacgagtgaccaggccctggcggatctgtgactccaggcatccctggtttggcggccatccctggccgtaggcagccgtagcatgtgccagcagcatgcagccagcctcccccgggctgggtccagttgctggcacatttcacgtccactgatggaaatgaaccgacagcccggggacaggtagaaatgagctgcttggccacttgaggggtgctgcaggacgggagaggactggccacaggcaggagatcttccccgaggacccagctgggctgctgtgtgtttgaacagatgctgggactggcctgcctcgggtcacagtgaccttgttgaaagtgtcagctggggggaacatcaccctcttgttttccagaccaggaaccctgggggctcctgctgtctcccctggccgcacagcttgtgcatcagtctggggccatctgggaaaacagaaaccactccagcctttcaaagagtggaacatttgactcagggaattgctaaccctcgggaggggagagaaagggggacctcataggggtagtgaggtggcccaggaatgagcctcgccacaaatccccccgtggaagccagatccatagactgtccagcagggctgcagccacagcagaggcgtggccactgcccaaaaagccacgtgtaggggcgagagaagagctgctgggcctcctcccctcccatcacctgccccaagtgacagacctgcaactcagcacagtggtcggccgtgggaggcagagccgggcagcaggaggcaggtggatctcagagcagaacccaggactcaacatgactgggaactcagggctgagtccccactgtgccccagacgatggctgctttaaacagttgtggcgatgtaaacctggactggcagtgccccacgggaacccatcctcacagatggaggcgggatataaaactggaccggcagtgccccacgggaacccatcctcacagatggaggcgggatgtaaacctggaccagcagtgccccacgggaacccatcatcacagatggaggcgggatgtgtgcataggatgctggttatttgctgcggccaaagaccaccatgacttcagtgtccacccgcgggagagctatgcagtggttaacacgggagatgtggctctgtgtaccctgagaaggagcaacctccaagatacgtgcatacattttttaaagtgtgctatcttgccaggcatggtggtgcacacctctagtctcagctgcttgggaggctgaggtaggaggatctctggagcccaggaggtcaaggctgcagtgagccaaggtggcgccactgactccagcctggaccacagcgtgcaaccttgtctctaacacaaataaattgtaaataaaaataaagggtgcagtctttatgcttcactaccctttgtttaaaggaaggtttgcatccattgaggtacagaaaattttaaaaacaaacaaaaaaagaacaaagagcaaagcggggccccaggctcagcaactgcgtctggaatgacagaaaagcaagcgcgtgtctaggccgctgctctgggcagggccgggaggcaggaatggtggccgtgaccctaagccgctgctctgggcagggctgggaggcgggaacggtggccgtgaccgtcagtttccacactctgccttctgtgttcttgcattttcccacatgcatgtatcatctttacaaacaattcaacctacagaacccctctgtctcctgacaccccagcttcctgtatgtcccaaaaagaaccctcgagctcctgtcccactcctaacacgggggctggcggcttctcaaagacggcccacatccccactctaattcccaagattcaacacactcatgacaaaaaatacgtgttgaccagaaacctggcctgcttcagacgtcaagccctgaccacagccttgcagcccacagctgccccccaaagcgacccgatccctcggccgggctatgcgtccatctgccctgggaacgtccagtctggcccctgaccatgttcccagtcctggtcacccggcccaccctcagccccacagagtaagaccccaattctgagggtagccccgaaagaagatcccccaagacaggaccaccccagaggctgctgcagctccctctgcagagcggctccagcccagcacactccagagcagacacttcttcaggagaattagggaataaatgaagcaacatatgcttctcctctaaaaggagcagcctgggtctggttggaggaggcaacggcaattgaatttgtcaagaggggcaggggtggaaccctcagaaccttgaagctacgtctccctgcccccaggactgcaaggtgcccaggcagggctggggctgagctgacagcaaagctgagtcccggcagcaactggctgctgctccacctcgaagtgcaggtttttacctcttaggcccatttcccaatgtcccaggtggccagcagcctgagagtcggggggactgaagggagagatgggggtggcaggtgtcagccctgttcccagggctcactcagctctccactcagagaggcacaggccacagggtacaggggagggccctgggggctgagagggggcgtctcgagggagactggaggggcatgggaaggggtgggtagggcaggagacgggagggggtggaaggacgcatgcccctgcgcctcccccgggtgagctcccagctcccatccccagcccagctctcagcagcccaggacagggctcaggaaaactcatccgtaaggcggggcgggaacagcgtgcacccgtgcacctggagggcttgctggtggaatggtaaggagcccatgcagaaggacccagcaggctttgcccaccaccctctccttctggaagaactgcacaggctgggaaatcagaagggatggtgacaattttctgggtctctaagaggatggtactgaggatgcatgccctccccactcagccagaagacactggtgaaccacagtattgcttggggagtcgggggggcgctgctgaacaaaccaacttccttgttactcctgggcaaggcaggaccctcttctgcctccaggattagaggggtccagggatgggtggaggggcctctccttggagcccctccagcctccacagttacccccacccccatcaacagggcaatagaccatcctgccccggtgcccacagccacaggactgaaccttccttatgaagagtgaatggaaggagacttgtggccatgaacgggtcaatgctgggatggctgcagtcccaggtgcagtagccaggcctgctccaccccaccccactcccactccactctcaggggtcctcagggccaggacatccctagggacctcatactcatggctcactgtgacctcactctgtcaggcagtgtttggggctgggtgctgaggctgggtactgaggctgtgtactgagactgggtgctcagggctgggtaccgaggctgggtgctcagggctgggtgctgagactgggtgctcagggctgggtgccgaggctgggtgctgaggctggggactgaggctgggtgctgacgctgggtgctgaggctgggtgctcagggctgggtgctgaggctgggtgctgaggctgggtgctcagggctgggtgctgaggctgggtgctgaggctgggtgcttgggcctgagctgtgcttacttctgcctcctcatcaccaccacagctccacaaggaaagggtcccacccatgtcacagcggggaaactgaggctcagagcaggcacctgcccaaggccacctggcacatcactgggagggacctgtgtgtccagctggctgggaggcagaggggccactactaaccccagctgcatgcaggaggtgttattgggaggtggtctggctaacattcacacagagaccccgtggagggagcctgtttctgacttgagctgtacatgctgcggctgccggcactgcagttggcacagtcccgcctgtgacacaccctcgggaccgcaaatacagctcagagtggttctcacagctcccagcaacaccgtgtaattcaggcccctgccactgcccgccctgtgcccttccctggagccagggcccatctgagaggctcaaggctgcacctggctgggtaaccgcggggcacggggcctggaaccatgggtctgggcggaggctgcactgccgttcctgcctcaggaaggcgtggtgtgcccccacggtgcccttcctttcccacccgtagctagatttagaaatgcccagaaaagcctgcagttggtttcaggacacggactcctctgactcagaaaccacaacctcaaatgcctcctgagaggcagggcatcagctcaggaggccagtgggggcctgcagacataaccaccaggtgggactgtgctgccaaaacaagcatcctccctcccacagttctaacccaagtccttctcagtgcatatgtcactttcccaccaagacaagagcaggaagcatttcactgtctcctaaaagcagaagagcgatgcgaacgtgatgaggaggggcagctgcttgtggtacggggaggccatggggaccggggggccctggggacctcgccctgagtgcaggggtggtagccactcgcctccagcatcgtttccagccagagggggaagcccagcgtggccacatcttcctcttcttatttaaaaaaaaaaaaaaagaaatcccaaattttagataaaatgtctgtgttttggaatactgacaaccaatttttaaaaatttaagcctctgtgggctaggagaagcccagtcactggccagagtcagccttcagaccacggttcatgaccgtcctattgaaatgctttttccctgtgaccaccaggccccaggagcgggtgctcggggactggcattcccaggtgctcctgtactggcacagggctcctgcaccccccaggtcagagccaccccaaggcaggtgcccatgcctgggacgcttcccatgcctgaagcctgggaagtggccgcctgggaggaagtggccacctgcaggaagaaagagcgcaccgtggcgggccctgggactcctcccaacctcccacacgctcctcgaccactgcccttcccactgggtgcagccttggcaggactgtctatcaatatcgggggctctcccaccttagacaaccagaccatctccctggcctgcacaccctgagcggggaacacaagcgccaggagtaggtgcagctgaattttccctaaggccaggcccaaatgccttccacggcaccagtccccatgcccagcaccttcattgggtgtgtggcttcagcaagaaacgctgagtagtccacgcctgagccctcctctcggtccctggctgagccagcccacacctgcatccacccctgtgttaacctcaggtcctcactccctcgcaccctgccagccagtccttagggaggacagaaagttgagctcccacctacctgcggcagtacagaccagttgtgccagcatgactgggatccaccgactaaaccagcacgcatgtggcattctggcctccaaggagaacacatctctttccctaagttcctctccccttgtggaacagactcactcctccataccctcattcaaacagcaaacacaggcatgggcgtgaatcagcacccggacatcaggaaggcgcagtgaacatgaaacaccacccctgggtagcaggcctcagaaacacctctgccagcaggctgactttactcatttgatcatatcacacaattccacacaaatacacacctgggtcagagcccacaggctggtgtttacagtcctttctctccccagctcctgccactgcctcacctctgtggccccctcctcgccccggcccactaacaaccttgaatgcactgcccgtgcctttctgataatcacataccaagatacaaatgttgcatatttaaacacatatacagaaacacacccacgcataggggattttggcgtggctttacaaaaatgggatatgtatcactctagtctacgtcttgtccttttcacacaatgttaccttggaaatccctgcaaacgcactggcatggtgacaaccccattctttcacagttacaccgcgtttcgtgacttcatcattcctcttttagtatagagatgaataatctcccttagcgtggatgtattagaatttacacaatcattagtgttatgtttattcatgcttctgttatttctactataaataatgtcaatattctgattttatacttttttatgtcatcttacttgctgattcttttaattctctgacatagattctcatgggtgtactgagaagttacagggtctgttctggatgaattctctatctgttccaatggcctacttttctaggataattttatccaattaaaagaaaaacttgccttctctgggttcttactggatctggggttgctaatttcaaaggggcagaaatcaggcctggggagtggagcagttggggtggtgaagggtgggtctggatgcagatctactggacagcccaggggttcgttcccctgcttgaactgcactcagcaggagaagttagaagcacccagagatgacgccatgtttctgtgactcacatgtaaagcaaagctacccattcttgaccctggctggaggagcaataaattggtacacggttcccagagtgcaatgcggcaatgtctttcaaaatcaaaatgcctgtgccctttgcccacagattcacctgccaggaatttattctaaagaagcatgtgcagggtcatgcactccggaaccactggaagtcgccagacgctggaagccatcgcagtgtccatcagcagatgccttgacatggctcctcagggcctgggccctaatcaccatgttgacagcagcatgcaaagacagagtgtcgttttggggtctccctcccctggacagcagccctggagcccaccccagctaggtccagttcactcaggtgaactctgttgtctgataggctttccacaaaaaggacactgcccacttaggaggaagagggcttcccgaaacaaccgccaaggaggaggctggatatggagaaaagccaggggaaaacctcggagagagaagggacacgatgaggatgtgagctcctgggcagaaagcctgcaccaggaacccaaagaccagcagtgcgagcccagggccccgtggaagacatgactccaggtcacagaaataaggtcactggtgctatttttattaattctctgagtatgctgcaaatttggtttctacttatgatatcagccttaactttttttaatgttgatgagaatgttcatttttagcacagataattttaaaccattttcaaatcaaccttttctggcaatgaatagatgcgatttgctcccacgaagacacccacagactgtcaaaatccagtgtcactgagagggaacggtgacggatcgagaccgtaagtcgtctctgtcccaggttttttactcgctggactgggcccttcccttccttcctctaccacaaacacacaacacacaaaaacacagttttcagctgaaagtgtaactccccctctctctggccatgccaagaaggaagttacactgggctttagttctcagcctatagaggatccagaggaggaggctctgctcccaggcagctgatgctccagagcatgggcacaaccccaacattcgggatttggctcaaggctgggctctgccccctgatgtgacctcagggaatcacctatgactcttgtctgtgatggccacatgacagcacctcactcgtgtggtgtggactgaaggagagggcaggcctgaatgcaagccccaatgaggcagggagcatccacaggcagggagcccccataggcagggagcaccttccaggcaaggagcactcactggccgggagcacccatcaggtagggagcactcactggccaggagcactaccaggaagtgagcacccactggcagggagcacttgcaggcagggggtatccaacagttaagagcatctacatgcagggagcatctgaaatggtgcctgttactgtcttccccttactcccaggtggtcggctgtgtgaagctcacaatcaccagccagcattcaataaatggctcccggcagccagtggggccggtgcccactctgcagagctgtgcatgaaggaagacgttccccgttccctgaaggcaatgcctgtgtccagaagccccgcccactggcccttggttcgggctcctttttaacccatggtctatttcttttgtctctgaatcttccaggttctctcttcactcacttccaggctgaggacctgtctctccagttcccccctcagctcctgcgacaagggaagttcttcacatgccaacgagcacacatgtggggccggactatccatcctcagatttggtaacagttgctgcagccgggtcccatgacacgaacagaaatgcgagctgatgtttgcagactgggcgcctgtgcctggggctgctcagagggtggtctgggaccggtggggcctcactccacccgggccttgtcggaaatgaggatgccaggccccaccccagaccccctgaatgtggggtctgcatcttcacaagaccccaggcgtctggtcagcacacagatgacctctcacatatggctcagaagtaataactgacgacacctctaacagtcagaagatttcgtgggagaaacagatcgccagctttcttagtcgaagatggggcaaccctggtcatatgcagtgggactcgtgcccctccacccccgccacaccagcgggctgccgcttctcgagtcaccgcagcagcctccgccacctctcctgctccccgcctcctgcccctcacgacccctgggcctggagcccctgcctccgccctggcgtttccccgaggaccacccctggctgctccctccttgccctccgtccccaccctgtcctctgcccggactgtccttgctcagggccgggaggctccatcctctccaccctgagatgtaaaatccaccgccaccttctcaggcaggccctcctgggcttccgtctttcaaacagctccggcatcaccaggactgcgttttagagcctaattatccacaagtcatccgacatgatctcccgcgtggcccttacgggggcaggacgtggcgtgcactgacttgctgtgtctctgtgcgtgccacagcatcctcactgccaggtccccatggcccgggtgctacctaaacagcccaggctctaccggtaattcaataacacgctgttgaacgacgggcgaccaccagcaagcgcccccctctctctggggctcagtttctctgctggtaagacgagcagccttggccacagcaccgtgcagtccgcccatctccaggaacgaacaggtgctctccatgggggcagctctgcgccttctcccctgggctgctccctacgacaccacgagggaagcccaaagggagccctgtgggccgggccctggcgggaggggagaggagaaacggagcccgtgggaggagagagaaggcgtcacggccgtccgcagaggacggtgctcctcaaactgaggcctggtccatggcaagaaatttaaacccaggaactgtttctacgttcaccgccctctggtgtggtttcatttactctgtttaattttctttaaattgccgccaatgatccaggtcatggccctccccagccgcgaagggcccacctccacatggaggctgtggggtctgcaggccaggagaagaggggccactgggaaggcatggggggggcgtggggactgggaaggggcagtcgctggcggggcagctgctctaggggaaacactccttaaggaacatcccctcgggattatctggcgggtcacagctgcctgcacaatatttaccactgaagggtgcgggcaacgggtgggcttgggtcccaccagcctcacaacagagccgccccttcggaacctctaaaaccccacggccctgagccggaaagccccggcacgcaagggcttggcagttccacttgcttcgtggccggcccttcttgggggaccctgcggcatggaagctactgaggaggctgccggtcccctgtcacctgacatttcatctcacgcagcgccaagggctcctgggtccaggctccaaagcacgtaggtctaggatgctgggtgtgtgtctgtgcacgagggacccgagggtgaatggtgccccctcctatccacttaagatatgtctcagagcctgggccacaaagtgaggccccatctctacagaaaattaatacatgcacataaaaaagctggtgcagtggctcacacctgtaatcccagcactttgtaggctaaggtgggaggattgcttgaagccaggagttcaagaccagcctgaggaacatggtgagaacccattgctacgaaaaaatttaaaattagccaggcgttgtggcatgtgcctgtagtcccagctacttgggaggctgaggtgggaggatagcctgagcccaggagttcaaggctgtagtgagccatgatcaaaccactgcactccagcctgggcaacagggtgagaccctgtctctaaaaattaatttatttaatttaataaaaataaaatatggcttggacatctctctgcagtctccataagtaattcacagtgtgacatcaagcatgcattttgtgaaaagaaagggccttctctttggaaacaggaatagctgtttccctctggcgtcttctgcagagtgaggctcatacgcgctcacgtgagcagctgcccgtcggccagtgaggccgggatcacactggctgcaggtgccacgtgcgtctttcgccctgtgaggggctgcagctcaggagcatctgccattttattttccatggaatttaaagatgaggttatctccatctgccccagcagcattacaagtcacttccaaaaaccagggccctgtctccattgatctgagagttaactgtggtccatcaggcctctgcacacagaaccccgtggcttaggtttgctggtggtttctgttagggagcgaggggcgcctgggctgagcgctggatccgtgactgtgtcgcagtggactcgtgtccttcccacagcacccctgggaggctgcattcctgggccctctttctggaataggaaaagtctcccaggatgggagaaggcgaagctaggattctgcctccgttacaccttgaagagttctgtctcctggtcaacaggacagtggaagcccaacccattcaacacccccaaaacccacacaaaaccacgcaggacacgcggggcagcatcaccctctggcccagtgcagacactgcggacgctggtggattcaggtagattctgcctgtccacagccttgataaatgtgaccacagaggcaggcagtgacccaggcagggacgggtgttcaagccctggtgacaaagtgcctgctgggaaccacctgagcttggtgccccctcccgggagctgctgtgatcagagacatcctgactcctcccaaagccaccctgaagagccctagactggggacgagcctccagaagtcagtggccacgatgagcacatgaggctctaaaagaccagggcttcgcacggaagatgagtctcgtgacaaatctgtccgggagacgctggaggcgtcactgcttccctgcctgacttaccctccagcctggccctctctcaggccccaaaatgcccaacaccagccacaggttacagcccagcatccaacagatcgctgtttcccaacacatctgccaaacccagcctggctcggagcagccacatctatgctgtccaaaccagcccttctgtgagcgcaaccgacagacgtgagtgtgggtgtgcagtgtgcagtgtcagcagcaacacctccttccactcctggtttccacctacatgagcgtctacgtgccccaccccaaacccagggtagctcagaccaagctgctcccaggcacagctctccaaaggcttcgtatgcatctagaatgaaactcacgctcctccctgaggcctggatgctggagccgagcctgctcctccctgcctcccgcctccccagggccttggagctcagggtgctccatccacggccatgccaagccccttcctgccccttgtcctgtgcacttgctgtttcctggcctagaacattctgcccccaggccttcaagacatcagcttcctctggccattcagacgccacatcccggagacacctctcctcaccgctccgtgaagacgccatgctccccgctgtctcctcaccactccgtgaacacagcctcgttccctgaggtcatcttctactgggctgttctcttccactttcttcctccactgattcaaagtgactaaaaaatctgctggtttgtttattatctgtctttcccactagaacacaaactcctcaagagcaggactgtgttgtttttcttgtttacagcggagcccccagcgcccggctcccagcaggcgcccagtgagaatctgccagagggacagatggagggatgagggatccctccttggatccccccaggtgcagtctgggggttgctgtgcgaagcacaccgcactgactcgattacacaatcatgggctcctcggatatttgctgcacccaatacatgcaggaccctggactacagaagccaagagaatggattccgtctgtaaacacaggccccatggagtaatgtgcccagggcccgtgggcactggcgggcaaagcatcctcccgcccccacctgcagcctcatggtacgtcccccaggtcccgcgacccctgaggcctggctcttacctccagcgggaccacctgcatgaggatggcaaagttggtgaggtgagtgcagcggcagacggagtaggtgaggtttcctctcgtgagcgcacagccgtggttcgaccagaccccttctccggagctgaggacacaggagaaaggatcagaggaggtagcaccgcacccttggcaggcaggggactgagagcagcaccccccataacacatggccccgtgaactcatggcggcgcccacacctgccacgccaggaatgcacacccagaccgtggtgtgggggttgggaggagagattctggccatcaggctggcgagagctggagagtgtctgctgctggtcaggccacaggaagcaaggccctccctctgggacagggaagggggagctgcttcgcacaatcaccctgaaaagcacctggaccaagcccagcacaaaatgaaacgcacatggcccacagccctgcgcctagagaacgggcagcggcacacgccagggaccacattcaagcccagtcactgaatcatgagtgacggtaacataaatgcccatcgggggaaacgggtgagtgcagtgtgggagagagaaatatgataaaagacctcgcatcggttaaaaagaacatccttgaccaatgtgcactgataaggataaaataccaaaacacaacgtacagtgactaaccacgacgcaaggcccgtggagccaacagcaccacacacttcccacgaacacagctatgaccggcacagagactacagagaaaacgctcacacagaaactccccacggtgttaccgccagagacagggtgggagatcaggatgagacgtaaaggtctaaggagacccttgcttttttatgttttactttttacgtgaataacgtgtggatatattacttgcgtaactttataaaatataaagccagacaaaaatgactggaagcaaacgtgctctcggttaactgtggttaaacctgttggtgtgaatattggtgaatatcattttcttctctacatttctctatattttcttttttgtttgtttgtttgctttgagacagggtctcaatctgtttcgcaggctggagtacagtggtgtgatcatagctcactgcagtcttgacctcctgcgctcacgtgatcctcccacctcagcctcccaagtagctgggactacaggtgcatgccactgtgcccaattaatacttttctttttatttttgtagagatatagtcttgctatgttgctctggctggtctcaaactcctgggctaaaacaaccttcctgcctcagcctcccaaagtactaggattataggcgtgagccactgtaccctgtcttctatattttcaaattaaaaaaaaaaaaagatttaaatggttcttccctgaagttggaacctcaagttatcagtaaagacaaatccttacttcagccaaaggcaatggcccttgggggaaagcattcataaaggcgaataaattaaaaggctctagtttgtatttgctttgaattcactttcaactgcggtgtcagcatggatgtggcagatgagaactgtggctgtccgatggcatgaccgatgaagaccccagcttgtacctctctggccaatgtctaccagatggaacacgcaccagcagcctcgggcaacggtaaccctgcgttagccctgggcgacgtggagcgcgagggaggggttgggacggtctttccgacatgacccaggggtggctctgagtttgaggatggagactcagacagcagttcagtggtgattttcatgattaatgatctgctcttctaggggagggagaaggcatttagcagagagcagaggacaaagcgagagccactcagacgtaccaactgagaggagcaaaaccccattaataacttcagaattgatgggacttaaagacagggtcatgtcctcctcctctccctccccaccccttttgatctaattttcccaggaccttggagggagtcagcanaaaccagctgttgtgttatatattgcgcctttgtctgtcaattggctgcataagtaccatacttcaatttgaggggggggcctgaacattancaggcattggattaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttactttttgacgcatacccattttttttcagatttttaacctaaaaaataatcaaaataaaaaataaggaaaaaagtcataagcacaaagacattatatctattcctctattatatattatggatataaaaaatattgaaatgttacataaataaaaatatatataaaataaatatgtaaatgttaatgtatgacacagaagcatagaaacaatccagttataaaacagtgcaagatttttggtaaaatataatatgtaacggaacactttatattacaatcataattatgaacaatagagtaataggaaagtggtttatgagtgcacattaagtttaaaagcagacggtgggcctggtgcagtggctcacacctgtaatcccagcactttgggaggccgaggcaggcagattacctggggtcaggagttcaagaaagacaacgccaacatggtgaaaccccatctctactaaaaatacaaaaattagccggttatggtggtgtgtgcctgtagtcccagttacttgggatgttgaggcaggggaatggcttgatcctgggaggcggaggtttcagtgaaccaagatggcaccactgcactccaggctgggcgacagagagactctgcctcaaaaaaaaaaaaataaataaaagcagacggctgcacagcagagacaatgtaggaccatgtaaattacatccctgtaaattctgtaaagagtggaaaagcagcatgggtaaggaatgaatgagtatatctgggggtgtggcatgtggctgaactccgcctcctttgaagcagcagccgtgtattttgcagtaaattaccctgggcagacaaaggcctgtgcacgtccctccaggcctccttcccacgcttcctccccaggcatgctgcttgcccccggtttgtgttcataccccatccctgggacacaggctcccggggcatccccagagcaagaatgtgtggggctcacagcaggtgctgagtgaatgtctactgagtagatcccagcctgggatttcactgatgcgttaagagactcacggtcctgttcacattccaccagcaacagattttaaggagcacactttcttttcaggacatgagtttatttcataaaaatcacaacatattttcacaacttagtgtcatcatctttcttctactataaactaaacatttcattctttccaatttcttatttttggccaaattatgtatagataataaaagtactgcagaagccaaaacatagagcctataaataaagtgcatgactttcattcattggaaacaaaaggtttagacaggttttgttcattacttatcttgaaatattagctatatagatgaatacggcaacaattaaaaacaaataattccatctaaactaaagatagttccttacttgatttgtttcactagaaactaaataaggagaaatatccaagtgtacattgtaggaatacagtgttctcacttctaggtgctcaccggcgtgatgaggatctggcactgtggtccatgtgacctggtttctggggtcacgggagcctggggcagtggctaaacatgggactttagtccatactaaacatgggactcttcactgaacagcggccttggcctgcagcagccaggtgtgcccgccagagcacggttgcaggggccatacgcagggcccgtggcactgtcaccatgtggcaggtggctggtgcagcctgggcctcgcctgacagaagagcaaaggttcacccctgcagacatgctgctccctgcctaccctccccatgcaggagaggcctgcagatgagtggtccactccaggcgaccaggggaagagttacattaagaagccaccaggtgggctgcaaaagggccacaggctccatagaaaactcactctgaaacaaggcagacataggggtgtggaggggctgaatgaaatcatggtcacagttttaaaggaagagtttccagtatcaaaaccaggtttgaatgtcttacccacatttcacagacaccacgagtgctatcagcacagtatgaacctcacagcccgtatctcggtggtgtcttaattcacatctatgatcccaaacctgtgttccacaggatcatgcccacacatgggtccataacaattatcccatctcctctggggctgaatctgagtccataaatttccctcaacacagaagacacggctgtcaccagccctccctctccaggtcagtggggactcagcgcaggtcggtctcatggtgaccagacggagcgcactgtgctacctgccgcgtggtctgcccattagaaacttcgtagagtgcctgtgagccatgaggaagcctctggggaaagcagtgccctggaaaatgccctccactttccacctggacaccaggcactgcggggacacggccagctcctgtggcccaagaacaaccaaggaggctggcacacgagggaggagggcatcttaaggccgaattggggtccaaagaggcaaaactcacagcggatggccgagaagctcccccaagcacaggcaccatcaggcagcctcaaggcccagagcggctcttcacgtgagcagaggggacccccccaaggacagggcagaggggtcgccctcacctggagagtcaacgactcccgcccacggctcgagctcggcttgggcaggggcccccaactgatgacacagcacaggttggcccacgccggcaccacctacagagacacacaccacggctagcgccggctgtggggaactcaccactcagtggattcagacactggggactccgcatgctcttccccacacacccccagctgcctgcgcctgactgagggtgcgtggggacctgaaccacctctttggccctgagtccccaagccccaccaaggcacagaggctgaacatcccctcctggtgctgcgggaccggccccgagtgtcctggcctcgctgggtctgatgctgagtgatgaagggaggctcaagggcaccatcacagtcaggccactgtgtcctggggaatcccccgaggaagtcactcagcccacgggtgggatgcaaggcaggagggcccacgctggcctgggcatcagcgtgctgggctgagcagtgtgctccgacagccagagtcacaggggagacagctgtctcgggccacaacacccatgtccagacancagcaaggagagggtccatgagcaaaggtggagcatttcattctgtttgggggggtgtgttctgagcgcagcctgccgtggttggcagcctcccggctcacacggctgacaggtcgacgcggtgggcagagtggctgctcttgtcccaaggggctgagcttggtggaggccatgcctggccgggtcccattcatctgcaaagcataaagggatgagcagtgaagggcctgctcccagggggagagccataagcccagtgagtgcggggagcattgggcccatagctgcccgaggattctccctgcgggaggaaaggtgcagagagaagggagcccccatgctcctgggggagatgaggatgtgcgcactgtggcgtctccagccgcacggttctccacgctgactccccttaagggcactgcaggcgtgctgtgctgagcgctcactccctcctctgctcacccatctgcccggcacccacgctttcacccccatgcatctgtccacgctgcgttcattccacggtgactcatggagcgtgccacacacccggcgcagctgtagccgtggggctagagcagcccatgagccagccagctcccatggagcagggcagacgtggtccctaagcaaatggaaaatcacacagctgcgggcgggggcggagtgcgagaatgggtgggagcgccttcattgagcaccgtgtgcggggaaggacttcctgaggatgggacacctgagcagggctccagcaggggggaagcagcggcacagtgagaaccctaacagggcctgctccagactgcctgggggcctgcctgggctctggagggcggcggggatgggccacctcacggtcagttgatctctaagtccttccatccctaagtgaacacaagaagccctgactcttcggggtcaaggggtagggctgtggtgatttcatcaggacacagggcactgtgtgggggacacaagcccagagcacgtgcagcctgcaggcatgagagggggacaaagactgctgggcacccgaagccacctctgctgcctgcacaccccatcctgctgacaaccgagcctggggaaggaggatgggctgggaccctcggtttatggaggctgcactcacgaggtccgagtggaagggcttcgcgttggaggtgcgggcggagctgctcgtgagcgaccagaccttggttttgtgcttgaaggcggctctcaccttgaaagcggggaagggatcgtgagagcaatttcagaggctgcaacagccgtaaccagaggagtctgtgccggtgcaactccggaaccagatgtgcgagggaggttgggatttggaaatatgagtcggagctgctggctccacagctgagctgtgcatcgctgctctgtggggcagagccaggttgtatcgcaggccagggaagctgggtgtggagtggcctctgctgggctcctcacactcagcaatgaatgtcccggggtgagtgtgagagagaagcaaataaacaaatgcgtggtgggcaggcaggcgggtgggcgggcgggcttccatggctgcactgccttcctgccaccgggatccacctcaggccttgcaaggggtcactgggcgttgcgatcaaggggtcactgggctttgtgatcatgcagcccttctgcccggccaccatcctgctcagcgactctgctctgccctccttggcccacctggcctgtccttgcaaacggacaccgccactgagatggaccgggcaggacggcccctctgccctgggcccattccccatcccaaggcagctcccacaacctcagcctggtaggggctcaaagctgacttgggaaaagttctcccacaggaacagaagtccttggggcagcccctacctccccccagccaagtacatggcaggtgccaggcccagagcagcaccgaaagaataagcctgcgctggctgccccagagtccaaggaggccacatcacaaaactcctcttcccagctcccgtggacagaagtcctccttctcacagccaggccagcttccccaaggccctcgaggaggactgtggggagcacgcctacatctcactctccctaagatgcagtcgccaattctccagggagagaggatgcttgcatatcgcttagcaactaggcggggagagaagagctgctcagcagcaggccccagggcacacaacttggcatcaggaacgtggctggctcaggatttgagtcccagacaccaccctgacagggcagcgctgttcctgctcctgtgacctttcggaaaggaaaagccagctgcacctgcacctgccagcaagcagagcggacgtacctctgaattcaggagacaatgaaagaggaatatgaacagtccctgggaagaaagggaagaaacgcagagattagagccctttgcacgtagttaggaacactggaggttcctcccatgcagcctgggagtggcactggcaccgcacactgtgacaccaggtcccatgacctggggcccgtgaggacggagaggcgtcctgggtcccaccatgatccaacctagaatcaggcagctgctcggaccgagttcagagagggggtgctgcgtgggcataggtgcggcagcaggtgggttcccaggcaggctcagcgtgggcaagggcaggcacttccggaagacgtgccactggcctgcagacacagacgcaacttgagtagcccagggagggctgggagggccatggatggcgatggggacccatgcctgcccttccttgggggcctgtgggtctgagggccctgaccctgcgcatcccaagtctttggttcccagatgaccctccctggcccttcacacagagggcagcacctgggggaccgccctggccacctctctgcctttctttccagagctgccacaggcagactgtcttactgtcctccattcccagccaggacatgccaactacagatgctggccagaagcataggcagccccgccctgaaggggtcaggatcctgcaggccccactttctgagagtcctcaggcttcggggatgccccgcattacaggctcctaaggtgtggccgggagggcaggcctccctcctgcccctgcagccctagctccctgcaagcctgctcctgatggctggcggccccgcctccccgccagtccccgcggctctcacctgcagggagttgagcgtggcaaacatgtactggaaaaccacagcacaaccgttgacagcaagcacgccaaagacccacgaggtacccaggatgggcagcagcacggccgctgccttggccgtcaacctggagagaaacagtgacagtcaccctgagtggcaggagggcaggtgcaggctgtgaggactgccctcgagacgccaggcttccagatgggtgcaggcaccgccctgccgggagcaagacctggggtcctccctgcaggtagccctggttgaggcatttacctgggaggagcctcggtgtttccacacctccatccccttacagctggtgggtgggagagagctctggaaaagttcaggtagcacccagggctcacctaggccatagggagaatctgtccaggcccagggcttgcatttgagctgtttgcaaagatgaggaggaaccaggacggaggggagagattcgggggactgaagcagcagagcgtcccccgcagcgtccagaacccaggcctcctgtgagacgcttggaagggtgcaatgaggcctgggcctgaaatgaggccatggccaggaagatttctccaggcctcactgggctgcagcccgcgtgtcccccgctgatcacccgagccctcctgtgacactgacggtgagttctcagagggcagggccaagtggtcatcttcatggccctgctcatgctcaaaggacgtgctaaacaagggcttgctgaactgcactgtgaactgacagagccccatcgctgaacacaccagccccatcagcatgcgtttttatctccctagagcccatgggccctcttgacacaggagaggcaggttatatattgaccccattgtataataaggaaactgaggccccacagcccctggtaatggctaaggtgatacagggtttcatcaggggcagaaccagagggtatgcagacgtccccacctgggccagttagcacctgctctgactgggcacaccagctgcctgcctcaaagccattcctgatgtgctgtgtcaatcatggccaactacctcaagcccagtccatcctgacttctgaaacagctgggctttccacagcagggaccttctgcctttgagctttagagaaaagtctagagactagcggagttcctgctgcccaggtcagccactgtcacatgcctcggtttacccctcatcactcaggccagtgactgagattgtctccctcatagactgtgggttccttaaaggctggagcttggtctttttgtctctgtaaccccaaagtgcatcccagcaccaggactcagaggctctcaggaaataaacattgaatgaatgaatgaatgaatgaatgatgaacaagtggacggccatgcagcagtgctgcacacagatctggcacctccccggaggaggtgagatgcggccataatgagcttccttgtcaagagaccaagagcctggcactgacagctccgggcaaccggtgcctgtaaaacccagaagtgttccagcacttcagctctcagagaagccgcagccagcttgttctcataatgctaatgcaataaaaataaaacacctgtttctgggaaacaacaatatcatgcattattcagctacaatctttaggtcccgggaaaccgtatctgaaaggatcaatcactgagaaataagtaccaaaatgtgctacttttaaagtgatggtttgacttttcttaaaatgaacaatagaagaagatcttgggggaagacgctgagctgaagctctgcggactctcaacacggccagagctgtcagtgtccctggtcaaaagcagaagaagaggggtccctggatctgaaggaggctctaggcagggggtgtgctttcctctctgatctatgacccccttctgctcccccaaggttggccctggcctagggggctcaggccctgagtctccaggccccacagcccacctgctcgtgggtgcacttctgtgggggtctcaccctcacgcccccgcccccagggtcccacttgtaaaacctgaccattctctgcttctttttcaggagtctggaatcacaatcaataaacagagacttttttaaaaagtgaaagccaggcttctccccctgctcagacctcacttattctattctccacttttcttggggtaggggggtggcagggaagtgaaagccaaccctgtggagggcccctgaggaagaatcttatcttgttattcactgagtactgggctgcttggcactaagaaaatcactagaataaaaccagaggatgaagaatagcaaggtgctggggaagcttcctcacgatgcagtgactgcctcttcctgcctggcgcctgctccctggctgtgcttcctcagccctgggagtcaagtgttacacaatccacactaagaagattgtgaggaagcatccctgaggggcagacctggccgcccaaaggagaggagctgaaggcattgggaaatgtgctgggttgcacaatggagagggacccagagcggtctgtccccagagatgcctgcctgcacctccccggaagggacgcatccctgggctgccaggtgcagacgcaggtgggaaggatgggcaatgccttcagctgtgccctgcaaagacctgggcatgctctcccggggcacgctacctcgagccttcacaagagctgcagacacagtgccagcctgtcgcttggaggacatttccatggagaagcaaaggcagtggacagaagctgcttcctgggtgggcactgatgggaggatggggcacagtggggtagagatggaaggcggtgcacaggtgcggggcaggtgcacaggggtgttctggtgacagtggaagtagtggcctcatggggctcagacaggggattgtgagcttttgctggagacaagctggcaacagactggctgaccctgaacgctgaggtgagggcctggggagctgagggctggggtgaggaagggacaggtccctccccagccaggccatgagaggtccaggagaccatcctggtctcagcaatggaagaggaaaggacgtgatctctgaccccacgagcatctcttctcgcacggggcacaacccttgaaggtttccaggagctgaacagcccaaggaggctgcagcctcttgtcaggttaatttatggtgtttggaattcattacagactaattctctcatagattcgctgctgacatatttgccacttttgctttcacatcagaacagatacgcggtggctgaagtaacagtacagaatgtcagctgcctggtacccacgccctgcttttcacaaagcccctgaattccctgcgagggacagcctccccagctttcagccctgtggtttgggggtgctaactgaacagtcacacggtcatatgagtgaatccccctctacagggtctggctcagggagggcacaggtccagcctgagtccccatcgtcctccaggcgcaggcctccgtctcagcaggtgggacagggactcccccgtgggcctgaacccctgccgcagccattcggccaccagggggcagagtcgacctcggcctgaagccaacactaaggatgcgaaggcgagctgggcccccgtgctgcaactgccaaagaattcctgcaacgccagggcttctgagctccggacttcacagtcagctgcgtcagtgagtcccccttctgcttaggccagtgcatgctgggatttctgtcacctgcaatcggctgggccgtaagagatgcaggtcaggacacccccgatggcagtgagttgtgtggctggaatccctcccagaggcgccgcgccttctccaggcggggcagcccagagcgctccaggacactgctctcccttgcaccttccgtgatgtgccagctcagggggaccctgttatcatcccgttctgcacgtaaggaaggccaggtgctgacgggctaaactcgttgagcgcagcagatgcacagggcagatgcgggactggcaggggctttctggctctaggatattccccgttgccgccccccaggtgctcatctccctggggtgaagaaatccctaggagaactccgtagactccgttcttctacacatgggagctctggggctgggtaaaggccctgtcctgggtcacgagagccaagcgagggcgtgaaaccagagctgccctgagatggcagggacacggagcaagtggaggactttggtgccggccacaggaggcaggagtggctatctctcctgtgacctcaaagcatcctctgggggcagaagggccgtggcactgctggcagcctgaggtcaacttacttgaaggcactggggtctccatggatcttgtagttgtcggcgctgatctgtgagatgactctggtcacagcgatgaggatgccaatgttgacctgcacaagaaaccatggaggaaggtgaggggggcctgggctgcacctgcaggagagctgcgtccgcctggccactgccctcaccacaggctacccctgcccagccagggctcctgggacacaggggcgtcactgggacaaatctcaccctgttccgtgggcttttaccaacacacacaacatgcaagcttgcctctgagagcacctgcactgagaagacagcagagacgagttctagtcccaggaacacatccgggcatgagggcatgagcctgggccagacctcatcttagcatttgcttcgttagtgtgaccctgggcaactcacccaggtcctcggagcctcagtgccccaggtgatgagaaggatagtgcccactgtgcaaacgactgctcaatgtgccaggccccggcacaggagctggctctcatctcccgccccggcccaggcctgcggctgtgcgagccacagaagctgcggcagaggggcatcatctcctgccagcacccctccttgctgggaaactgctggaaggctcctgttgggacctatggggctgggcggggcactgaggggccccggcagaggcttcggcacaacctgcccctcacctgggcagctccctcagtaggaggctggcgaggcaggcacagcatggggaagaaccccctagtgtcctctggctgcggggttagggtgagggttagccttctcccttgtgtctgaaaaattctgaggccgtgtacagagtcagcaaggagtccagttccaggataaagtcctctgtgtgaactctcaggctcgaactttcaggcaatgaacagggctctacctcgccggcctcacagggcagctgctgtccccacgccagcctgggcgcggccagagcctggcagtctctgaagggagctgcagtcggagggcagccactggggccccgcacgggatggccagcttcgctctccccccgcacgggatgggccggcctcgctcttcccccgcacgggatgggccagcatcgctgttccgcacacctgcacccctcgcctaggtgcccgcgccaggcctttctgaagcaactgctgagcccgcctcaccctaggggccttgaagccaccttctgtgcccaggacttttccactgtgagcccttccccttcctcctcgcgcagctcccgagcccatgaatcagcaggagccctccgcccagggctctctcagcaggagaccggccctgtctgcacggaggcttcagaccctcctggtgctgttctttgggagagagtggtgcgtggtggggccgccccctcctgcctagccccttaggacactattgtggcagtgagcaccccaactgttccctcctcggctcctgtcttcactgaccacctcaacacctggaagctcagctcacgcccagctcagctgacagtcggatgcaccttagttgcccttattttcccatctgtaaagtgaggctaataacagaagtgtccaaaggccagggaagggaaaagaagtcaacacattagccacccagcatggtgtctgcacaaagagcatgtccagaaacgctgatgccccccagccaacctcactgtgtaacgacgagaagaaagccacactcaactaggagcagcaagcgggagcagcgtggatgacaggtcagtggttttcaaatgcagtgatgattcaactaggacagtgacaaacgcgtgactaatgtgcagttattacttcgagtggggatttcaattgcagatggctgatggtcactgatgtgtgagtgcggcccatgccctcagggcaggctggccttggccatctgcctgggaagcactttcgtgcctccagtggtggctacagcatcacacagagagggaggtggagatggaaggtgccccaagtcaaactgccacagaccctgcctgctcttactgagattcagaagtttttcttgaataaatgcttttagtgtgcatgcctttgtttctagaattccgactattttttcaaaacaattcttccagttctttccttgttttgggagtggagatttccccaggtcctgactctgccattctgcaactcctgcccctttcccttgagggatttctattccgggtacctcacccactgacacaggcgggggcctcatctgtaacaagattggaaacaacctgaacgtccacacccagacagcagggcggggctgtcactcacacccagacagcagggcggggctgtcactcacacccagacagcagggcgggcctgtcactcacacccagacagcagggcgggcctgtcactcacacccagacagcagggcgggcctgtcactcacacccagacaggagggccggcctgtcactcacacccagacaggagggcaggcctgtcactcacacacaaacagcagggcggggctgccactcacacccagacaggaggaaaaagcctgtcactcacacccagacagcagggcgggcctgtcactcacacccagacagcagggcggggctgtcactcacaccagacagcagggcgggcctgtcactcacactcagacagcagggcgggcctgtcactcacacccagacagcaaaaacggcctgtcactcacacccagacagcagggcggggccttcaacncnggttgnnnccccttaccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctagctagccctgagaaatacatgagcaacttgggaagcaagaagttaatagtggcgagaaacaatagtcaagagagttagagtcaggaattcattgcttccctgtagaaactaaagacaacatcgtaacaaacgacccggagttgtttttcagaacctggacccccaccaaatggatctgttgacttacagacctctgatatgggggagcggagagctgaactccaccaccgttctttgttctttgttttttgagacagagtctcactctgttgcccaggctggagtgcagtggctcaatctcagctcactgcaacctccgcctcctgggttcaagcgattctcttgcctcagcctcccaagtatcctcctgagtacaggtatgcaccaccacacccggctaatttttgtatttttagtagagacggggtttcgccatgttggccaggctggtctcgaacccctgacctcaggtgatccacctgcctcagcctcccaaagtgttgggatccacccctccgggcccaccactgttctttgttctaaatttcttcctgaggggcctggaggaggtcatgcccacaggccagagctaacattcttttttgctgatctcaaattttttgacaaagccttgccttcttaaccaatcacaaatcagaaaacctctgaatctactacctatatgacctgtgggcccccagttcaagatgtcctagctttttaggtcaaaccaatgtgcagcctccaggtattattcatgtgggacttagcctgtaacctctgcctctccaccttgaaaaaccctcccccatcagccatcggggagttcaggtctgaagtgtgagctgccaggttctgctcgcctggtgccctgctctaaatgcctcacttcctctcactgcaatcccgacgtccatgtttggctttgctgcgggagggcagagccaggctgggtttggtgacaaacgctgagtgctcaccaagtaccaagccctgttctcggggctggggtgcagagcgaacaggcagaaagaaggtctctgctctcatggggcctacgcctcggtggggagagactgacaataaatgaaataaacgtctaagatatgaagtacattggatcgtggttagtgggatcgagaaaatacagcaggggagggctttagggggagggagacctgctgtcaaggtgatgtttgggtgccgaacaccccgacgtttgggtgatggaatgagatgctcagagacatcagagttgcttggttccaggcccatggaccactcaaggccctgtctcaaatctccaggcttcaggacacgctgctttacatggaggcgggctcttcatctgggcctctgaacaaggcctgagacaggacgcaggcaaatagcatgaggcacgagagactgtagtccgggatggagagtcagagtgagtctgaggatgagtgcagatgcctgcagggcaagctctgctgaattgctttgctatctagtttttattacagtcattgaatcggggtgtctcccattatctgatgacaattttatgatgaaaagaaaccatgctggctttgttcggtcatggagatgggaaaggtccgcatattcagcaatctgttgaattcttccaggttaaaactggagctgagaaaaacctgcagctgcctgtccctcccttcacctcttccagcgagaggcagtgggggactggagagctgatgaaatggcagagataaaggttgtaaattagttttccctgaagccgaccagcctgagcaacaggataaaggtcgttattacagacagcccccggcctttggagttcacagtttctccattgctaggagatggaactctctggaacccttctccagctccacagagaggctcaggctatcagaggatctgagcggttgtaggctgcaggcacaagttaaaaataatcacctaacgttttgacagcactttctttttttctgtcccacagagattggaagtcattttcttatcctctttaggaagtatgttggattcaggattcttaattcccatttaaagtcaggacaattgagataactgtatcagctaacatttactgggtgttatgttatacttgctaataataatcatagctaacatttactgagtgataatttttcttaatagaaaatagcagcatttactgagtgccacatattttccaagtactgcctgaagagccttggatctgtcctctaatttattgttacagccctgaggaggaggaactattaacccccattttgtggatgaggaattcgaaaactaagagagatcaagtaatttgcctaggagcacagctggtgaatgttggagaaagtatgaagcggtaaatattacttaaatcacatagcaaatatagctgtgactgcaattctagggtgtgtgtctctgtgtgtccacgtgtatttggagtagatcggataaactttggtcttgggtaaactgaggcatgtctggcgaaggggctgactcttttctatcccattgagaacatcctcctggtgctggggtgggggtatatgtgggatggtgtaattgcgcagcgtaccttgtaattaattccgtagctttcactgacgtccgaaaggattagagagaaaaatgtggtcagcgcttaatatggagggcacagtgggtgtgctgctttctcttttccatccctctgtcaacttcattctcttttgggggcaaacaagactcagatctaaacagagtttatggtttgttttgcattttgtacttattaatatttatgccgactttgaaggtgctgaccagaaggcatcagtaacacacacacgcacacgcacacacaccacacaccatgtctgtttggtttgattctgagcctgagatcctggaaatatttcagctgttgttaagaggctggagttaggacccaggaaggacacagcagtggggatataaatagaaaaggagaacagaacaaagtttgaggagagagacttacatcactcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtaatgtccccaagtggccaggatggcgacaggcttggtttctccggaggctttccctgagtgtgtctcacactgtggtcttttgtgcgcaggtgcgtggcgtctactccagatcgcaggaccatccaggtaagagtgtttccttctcactctgagcaccgctctccccctgcctagtgcaggtatctcaggaacagcccacttgttcatctctgaggcatcagcgaatggcccttgttgggctcctggtccccgacctcactgcctcaccacacactgtgaccctgggcagctctgctacccctcaccggctgagcggtggatggagaagtggttctgggccccttgagctgggtcatatgaaacattgtgattaaggaaatatgatctccttcatttgaatgccttctgcctctttctttctctctttctctctttcttcctttcttccttttttttttttctttttgagatggagtcttgctctgttgcccaggctggagtgcagtggccgcaacctctgcctcccgggttcaagcaattctcctgcctcagccacctgagtagctgggatcacaggtgtgcaccactacacccagctttttttttttttgtatttttagtagagacagggtttcactatgttggccaggctggtctcgaactcctgatttcaggtgatccgcccgccttggcctcccagagtgctgggattacagatgtgagccaccacacccatctcatgtcttcagggcagattcactggtggggagttggagctctggcccatagcagggtctcgggacctccagcctcagagtgctgaccagcttagcctggagcagccgatgagtgggactcgggatagagggccacccttgctccagccccagagccacattccattggccattgtgacacccaaccaggaagcatcaggacggggcttctctcgggaagacagggaggcacacacccttcgctgttaagagtgtgggcacacgttctggtcagccaggggcagggatgggaagacgaggctttctgggagcagcaggcagtcactgggctgttgctccctgctggaagttgcaggaggtggggaggagaccctgctagtgcctgaacccctgctgggaagcctgttgtgagcacagcctctgcccccgccccaccagagcttggctgggcacccccccgagcgctattgtatggccctgcctgtctctgatgggaaatcagccttttttaaaaaattatttttgtttttattttttgagacaaagtctcactctgtcacccaggctggagttgagtggtgagatctcagtctcggctctctgctacctctgcctcccgggttcaagcgattcttgtgcctcagcctcccaagcagctgggattacaggcccatgccaccacgcctggctaatttttgtatttttagtagacacaaggttttgccatgttggccaggctggtctcgatctcctgacctcgggtgatccaaccacctcggccctccaaagtgttgggattacagatgtgagccactgggcctggctgggaacagcctttaatgatcagccacaaatggactcaggccagcactgtgggcagatcccagggcgatacccaggcctccagggagagcccctttcctggatggagcacaggagcctgctggggtctagggccaggggctgtgccctcagcctctgtctcctttccggctgcccggcagccccatgccaggatgttccaggcatcgtcgcctcgccaccacctccattcaccaactcgggggtggggacgctgccacttctgtttcgtccacatgcatagggagctccttttaaaaaggtgtggaagctgtgagtttccacacattcccctctcctcagccaaatcgctgaatgaaacaagggctcctgtggcttgggaacgaataaacatgcccagcgctgcgttaaagagaggacgtgtccaccttggacaccttgcttctcgtgaatgcaggcctcatggcttgggctgggctccagtaggggagaggactgagaggaggagaggggtagcccctcgaactgcagggcggtcaggcagagctgtgcacccggctcctgcagcaggcaggtggcccccgaggccccagcatggccctcactgctgctcagtgttggagaaaagctgtgcgggttctccccggacttctgcttatgatacagagcccacacgcattctcacacatgcacatgtgtccacatgccccccatgctacatgtctacatgtgtcaacatatgcccacatgcaccaacacaaatcacacacatccacacatggtgacacatatgcacacacacacacaccagatgtctacatgtgtcaacatatggccacatgtgccaacacacatcacatgtccacacaccactcacatccatacacatcagacatgttgacacacatacatacacatgcaaaagcatccacacatatgcacacacctgcatgcatcaacatgtgtccacatgcatccacacatgtgtccacacaattcacatgtgtagacacacatgcacacacatacacatccatgcacacacccacacccacatgtgccaacacatgtctacgtgcatcaacatacatgtatttacacatgttcacacatgtccacacatatccacgtgtctacacacatgaccacacagtcagactacacacatccacatgcatccacacacatccatacatttctacacacatgcatacacgtgcacacattcacaaaagtccacgtgtctacacacatctgcacatgctcgcacatctctacacacatgcacatacatacacacatgctcacacacgtacaccccacacacgtccacacacactcatatgcatgcacgtgtccacacacatcttcacatactcacatgtgtgcacacacatgcacacacaccctcacacattcacacacatcccacatccacacacatgtacacctatttacacagctcacatatccacacacgtacacatatgtacacacacatgcacacgtgcacttgcatttttgtatctaaacttgaaggagcagtttgaactcagtctttgttccatatagaagctttgttcttccaagtctggatttagggtagaaatcaacatttcctgatcaaggcactgtcttagagaaacgacggccatgctgatgacagtagaaagggacggaagggtgtggtgacccctagtctgtgtggaaaagcacagtgaaggcggccatgcctcctgagctcttgaaaccgcaaggtttctctctcctcagctttccaggttctagcagtccctctttttctcctcgtccttcctcgtcctcctctcactgcaaattgtttttgaacttttccttttttctcttccttcctccttccttcctttttagaataatggtgaaggtggacacatttgctgaatatttaggtgccctccatgaacaaaacatcctgctgcctgccttccttcccttcctcctcactgttcccctcctccccttctccccttctcctgccttctctctcactttgtttcctgtctcattttcttttttccatttccctccctcatttccttccctccctcccccctccctccatcctatccaatcctttctttttttttttgagacagactctttctctgtcgcccaggctggagtgcaatggcatgatctcagctccctgcaacctctgccccctgggttctagtgactctcctgcctcagtcacccgagcagctgggactacaggcgcccgtgaccaaggctggctaatttttgtatttttagtagagacggggtttcaccatgttgaccaggctggtctcaaactcctgacctcaggtgatccgcctgcctcggcctcccaaagtgctgggattacaggtgtgagccaccgcacccagccccagtccttcctttttgtcttctcttccgacatctcaggctctgctcacctcgtttcctgctgaaaagccgcatccctggctgtctgtgtgaagcagaatctaggggcctccttcatgctccagcttccatccttgaggctcgcctgcccccgggcagctctggcagaggaagcctggccctggcgcgtctcctcaggagcgctcatgacgggcacgggcgtcacaaacacaccaacagaaacaacctgtttccatcgcaagagaacagctccttaacacgtagcatttcattctaaagagtgctaaacagctatgaaaagcggccagtttgtctgcacgttgggcctttcaatgattttacatcatccttgcgagagccctgcggtggtgtcacgccctcgcaccgcgggtggagaagcgtgtctttcagacagaccaagcgatttgctcaaggtcacagggctcagaggacacaatattaagcccaagaggctcacagcgtgaggggaattaggggagacagacacagacagagattcttggaaaacagcagccgagtggtcagtaccgggacataggttcgctcaggtgctgggggagccttaaggaggagtctccagtatagagcgagagcctgatcttccaaacgccagcctactttccaccacggccacaccaaactgtagtattttgttaaaggttctcagaactattaagcatttcttgttttctgattctggcactcagcactgtgccttatgcataggagacacgcaataaatatttgttgggctggcgcagtggctcattcctggaatcccagcactttgggagcctgagccaggaggatcacttgagcccaggaattcaagaccagcctgggcaacatagtgagaccccacctttataaaaaataaacattcagctgagcatggtggtgcatgcctctagtcccagctacttgggaggctgaggtgggaggatcacttgagtccagaagtttaaggctgcagtgaaccgtgatcacaccactgcactccagccttggtgacagagtgagaccctgtctcaaaaaatatctatatatttattgacttgtctgtgcacagtcactgaagatttgctagtcatctggtaaaccgcgtcaataaagctagccaaccagcatgcattcggctcacaggtggctgttttggcttgtattacctggtttgcctgtctacactggcagaggtagccagatatttgccagatctttaccatgtagagaggtgtttcattttgtaagtaattgccaaacaacttgaaatcattttaagcctttgcatactctgtgcttatctgtgaccatagatggtcattctggaggcattatagaatgttgtagttgagggaccgtggggactattgagccacttctcactttacagggaagccaggaggtaggtttggagagggaaatccagggtcggcagagtccgggcccctccccacatctggaagcttttccagggcctcaggcggcccaatttcttgcctctgctccccaggggacagccttatgaagctgtgatggttgattaatctgaatccataaatggcactggccaataaattgcaggccattcttaaaaagtttataagcatgccattttatacatgacatttgtaatgaggaaaagagaacttaaaacaaacccaaagcatgtcattacccagcagtttcctggtcctggggcacatggcacagctggctccagccgtttccagaagtttggggcggctcacttcacccgctctatttaggggtctgggaggccaagcagataattacagtaattatcattccttagatctccatcatgccttagagtttctaaagaactgtcagaactgctaggccatggcagaaactggattcttcatcttcgtagtatttataatagaattttaaaaaaacaatgtttatatccgattgaagaaatggaaatttggcaaatagagattttctaaatactagaattatacagataattatactctatgtttattgatttatttatttatttttgcattttatcattcattctacctgtatagttagtttttaaattgctaacattaaaaatttgggagatttcaaatgcaaaaatctctctctcacacacacacacatacacacacacctcctgggccccttgtcttagacatggaggatacaatgtaaatagaacattcaaggaacagagtctgatataggagacaacacacaaatatactaacaaaaaaatcccaaacaatagtaaatgccatgagaaaaccaaataaggacctgaaagaaagagtggatggtggtggcgacgaaggggtggcatgaggggaggggtcctgtgaactgagacctgaatcaggatgagctacacaaaacgcggggatcagcattccaggcagtgggaacagcaggcaaagttatgcaggaaaaatgagctccatgtgttggaggccaaggaggatggagccacgaagccagcccgaccatcggcagggggcggcattcctctgtgtggtatagattcctagctggacctaagtcagtgcaacactgaagattatttctcgatgaacctgctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaattgcatccagactggttggagataaaatgaggagtgctacaactcgctgggccagcacagacaggagccctgggagcgctctcctctgagatcgatgaagtgagaataggccccagtaaagcagtggagaaaactgtcttcctgagccccctctagcccaaggattccagctattctttgcactcagcccccatggggttaatgatgaattattacaaacaatgaagacatttaaggctgaagactaagccatgatttgctgttctctgcctgttcacccccaactatttctaatcccactatttcctgatgagaacacacacttaaccagatattctacttcatttttggaaaatctcttgaagttgctttggatgagctgaggaaatgacatcatcaccccttgctggctgcaggagtgactgagcccttgggtttgggtggggttgggctgctggtgaacgcagaaggtgtggcgctgccgagagaactggaccccagaaccgctctgttctccaagtcagagtgacattcactcctcaggtgccaatgagttacagaggagtcatgtcaaactcacatttaactcgtgtgtgtccacaaagcagagtgagggatagtgaaaatcggtccagcgatcctgccaacgcttgcaagcgatgaccatggagactggggtgaaaatgagaatctgccaggtcctcagtcggtcccagttcccacgtgttgagtgtgtttccagtgcccaaaggtacatgctttccgattacacgtatctgaacataaccttcttcctcctctacagaaagagctgctgtccattccagtggtaagggagaggggacacctggccagggtgacagacggtcagcactgtgcctttgtatcaggaaaggccaccacacctggacggaccggtcagcaaatggtgccagctctggctcatgagattagaggaggtgtcacctctgcccaggtcactcagaaaaaagccccctctgggcacctacagccccagcacagcttcaaatgcagacaggtcttcatgtaaagaaagacttctacctacttgtgtggccatgtccccaccgaggcccggcctggctgggagcagactggatttcagttccagttgtcactctgcatggctgccctgaactcggctgtgtcagactcactgagcagtggtacacgggccccacacaggccttccagggacttcaagagccattctcctatacatgctttacgtcgtatgccttgtcttcagaccaggtcaccaggtgcaatgggattctggtcgatccagttctggttcagttctggttctggcgatgagggtttgctctgacaagaacaagaaccagaaacaagggcacctctttccagtgttactaaaacaagtaaactgtcaggagggcaggctttgtttgaagcttttcataacataaatacaagtgatatcttggtttcaaagtgacaactctaaaccctaggcaataaaatgcagtagattggtccatttttttcttctgaaggatgctatcatttgccctctgtcagtgctaggagagggaatgcattccgttttcctgggtggaagctggaagatgtaaatgtcgaaggctgtagtggacacaggctgttttgcctgcacagcatctgttccttctgagaccagcatacctgattgtcccctgggagtcccctctcctccacatgttctggacaaggctgacctcactgtcatttcaggggggctggggatgggggactatgacagagacctaagccagtcagcatattctgcactcccagacacagaaaatgactcatggaaggtgcatggataaatgtgagccaatgtgagtcctgcccagccccagcatgggaagtgataagagaaagaagctccctcttttccacagaggctgctgagggcagaggatgcaacactagaagcatgacagccaccttggcaccaggaggaggctaacaaaagagggcagggtcaaacgcagagattcccactgacatcatgtgagcacctggaccaaaccagttctgaagcagtttcccctagagcttccattgcaagagatgaaaaagaaacacatggctttcttggctaaagttatcttgaattgggttttctgtcatgcaatcaatagggtcctaacaactgagggactcaacgtcagaagcggaacgagggcaggcagcgtctggaactcaggcctttctctcctggtcctgacatccgctgtgctgggtcccaatgaagcagcagccacatgtttgtgagtgcctacatggggtctgtcattttttagcagattattttatgtggaaataaagaaacccattggggaaaaaatggtgcattcacttgtgggcagcatgaaaatggaattgtaggggaaagatgaatattaattttaaaaacagctaagaaccactggattcttgccatatgccaggcattgtgctaatggcctttattatcaacacctcccccagaaagggagtatttttatccatttaacagagcaaaaaaaaaatctgagagattaagacaaaaaggttatacgttacacatttccatttatgtggaatctccaaaataggtaaagacagaaagtagattcgtggttgccagagtctgggggaggggaaggcggggagtgactgtactcaccgggtgcggggtttccttttggggggatgaaaatgtttccaagccaggtagaggtggcagctgcataacaccgtgaatgtgccaagtgtactgacttgttcatttttaaatggttatgtttatgatatatgaatttgacctcagtttttaaaaatgacttcccaaagtctcacggctcattatggcacaatgaatatttgaaccccagtccacctacccacaggcccctgccccgaacaactgccctgtgctgaataggaagaggtatcttcggggctttccaagggcccatcccctgggaggcacacggctaacatttgttgatcaaaaacactaatggatctggaatacttgctctccaaagccttctataatcgtccatcacatataccttgaaaccccgtgatgatcaacagaacaatattcatctcaaagcatctctagtaaattattaactcctctatctcagggaacaggtgttctaacacacaactgtgtttataaggttcattaggacacatctcacgcctgcagtgctgatagctgcaacgggagagtggggagaaaggaggccgataccagggtgaccctgggaacagacagcggatctgccccagcccttcacactcactgaccaatggcagcagtgaagtacatggcgatctcatccggagtcagagcccgctcccagatgatgaactcatcgaaagcaccgttctcataacacttggcctggtcctgctcagaccctatcacgaggttgacgttggactctccatagtcacgagacacttttccactcggatcagaggtgctcagggtcccgttgacgtagactttcaggccctccttggatttccatgtaaataggacatgagtccaataggggcctggaaaagagtgaagatcgccattctgagtactgtgggaatgagctccccatgcacaggtttttcctgtttgtaggcacatccttctttcttaaggtgatcaatcactgttaactgtggtgcgtcctaatacaaggtataacacagacctgactttccccagtcctttggagcacaggaaggatgttatctttttgtccttatgccctaaattccagaagcagttcaaggagactccttgttattttaacatagtagttacaaattcaaatgcccacaagcaagtgtgattaaaatatttgaaaaatggcagggcacaagtgccaaccaatcagaccataagctcagttaagaaaaaatggtcaggagcgagacaaggatgtccccttttaccactcctttttaacattgtactgaaagtcctaactaatgcaataaggcaaaaaaggaaaaaaaaggaaataagaatataaatattgggaaggatgcaataaaactatatttattcacagatgatgtgattgtctatgtagaaaatccaaaagaatcaacaacaaagctgaaactaatgagtgagcatagcaagattacaggctacaaggttaatatacaagtcaattgctccccatctgccagcaacgaacaagtagaatttacaattaaaaaacacattaccattgtcattggtgccaaaaaaggaaaaagaaatacatatattataacaatacatttataagctatatataaagaaaactatataactctgatgaaagaaattaaacaagaactaaataaatggagagatattccatattcatggacagaaagactcaatgttgtgaagatgtcagttcttcccaaattgatctatatattcaacacaatcccaataaaaatctcatcaagttattttgtggatattgataaactatggagaaggaagagagccagaatagccaatacaatattgaaggagaaaaacaacattggaggaacaacactacccaatttccagacttactataaaaagttacagtagtcaagacagtgtggcattggaaaaaaacagatgaatagatctgtgggacagaataaacagcccagagatagaccaataaaaatacagtcaaccaatctttgacaaaggagaaaaggcagtacaatgaacaaacagaaccatttgttgcaacaaatggtgctgcaacaactgaatatccacgttccaaaaaataaaaagaatcttggccggacgcagtggctcacgcctgtaacctcagcactttgggaggccgaggcaggtggatcacctgaagtcaggagttcgagaccagcctagccaacatggcaaaaccccgtctccacaaaaatacaaaaaattagctgggcgtggtggcaggtgtctgtaatcccagctactcaggaggctgaggcaggaagaattgcttgaacccgggaggtggaggttgcagtgagccgagatcgccccattgcactccagcctggacaacaagagccaaactccatctcaaaaaaaacaaaaaaaaaatcttaaacctgtcataaaaattaattcaaaatggactataggtctaatataaaatgcaaaactataaaacccttagaagataatataggaaaaacatctagatgaccttgggtttagtgatgacttattagatccaacaccaaaggcacaatccatgaaagaaataattgacaagctggacttccttacaactaaaaatgtctgctctgtgaaagacactgtcaagagaatgagaagacaagtcacggatggggagaaaatatttggaaaagacatgataaaggactattatccaaaatacacccaaaaactcttaaaattcaacagtaagaaaacaaacgacccgcattttgggaggctgagatgggaggatcgcttgaagccaggagtttgagaccagcctgggcaaccaagtaagacctcacctgtaccaaaaaaaaaaaaaaactagtgagacatggtggcacatgccggtaatcccagctacttgggcaactgaggtaggaggatcacctgagccctggagttaaacgctgcagtaagctgtgattgcaccactgtactccagcctggatgacagatcctgtcagaaagaaaaagaaagaaagagagaaagagagaagagaggagagagagagtgagagagagagagaagagaagaaagaaggaaggaaagaaggaaaggaagggagcaagggaggatggaaggcaagaaggaaggaaggaagggagggaggaagggagggagggaaagaaggaaaagagagaggaggggaagaagaaagggaggaaggaaaaaagaaagaaaaacaatccaatttttaaaatgggcgaaagatcaacctcaccaacccatagaatgtacaacaccgagagcaaatgctaatgtgaactatggactttgggtgacaatgatgtgtcactgtaggttcatcacatgtaacaaatggatcattctggtgggggaatgtccatagtgggggaagctgtgcctgtgtagaggcggagggtaatgggaattctctgaactttgcactcaatttttctgtgaatctaaaactgttctaaaaaataaaatctattaaaatctaacagcaatacaggcactccatggcgcccaccaacccagtctgcagaggccagggagcgggtaagcacagtaacgagctttccctgaggacgtggcttctgtgctgactgcagtgcgtggaagggcggctgccccatcacgaggtggcccctactcacctcccccatcagtaacatgagagatgaagagcctgccttgccagtctttttatttccaaaagaaattggaaaatcttaattttaaaataaaatcataactaatgatcgtaaatcattccaaatatttttcttacaaacttggcctaggcaatcacaatataggaccataaaacccatctgaggacccaactcagcccacaggccattggcatcagcctgtgctctaagcgagggcgtataatgttaaccaacatgggagtgagttggtagagggaagaccaacctccctgctcattcaggaacctccatcaaccagcatttgtgttactcttctctctggcacaagaaccacgctcatcaacaagaatgttcatcagactttgactgttgattcccccacaaaggttccctttgttctgccagcatgtgtggtaagctgtcctcctgagcttgctgctggaaggaacagggcagcccttttaaaggacacacatcacctctagccagctatgcatcttagatcacccagaatgacatcagggcttcttgctcaagattgtgcaactttctgataattttgagtctctggagcacgcttggaccctaggttggtccaaagtattattgcccctgagtttgaaagtaagaataacaaacgccttcaatgcacaaaagagagcacattgccagccagaagtgtttctaattctcgccctttccctgggtggaaaagcagccagagttgagcatactttacctttgttcaaggtcaaagaacctaatggatgcctgaaaccacgttccaccagccccaaggagcagagagataagctgcttacaatcggactctgatagcaagtggaacaggaaggtcacggaaaaggttcagatggttctgtgtcaggggagggaggcagagattatttctgaccttagggatcacagagggcaaatttgaagtagatgtttgctgaactgccccactttacagaggtggaggtacaagctggtccgagcacaccgagcatccacagaagaaggcaaacaccttctgggcccactgtgccatcattccacgctttatgcctagcagcccacttagttctcacagtcaccctatgatgtgatactgctattactgccatattatgaatgaggaaactgaggtatagggcagttagggaaggtgcccaggttcacacaactaccaacgtccagaggcgggatttgatccagcctgtttgggtccagagttcacgctttttaataactgggccatgcagcctcccttaagaatgagccagaaaatggatttcccttaaatacatcaaagatgtttcctaccggaggagatcatcctaggcttttgtgctgccccctccacctctgcccttcccttgttgggctccagtcctgacttggcccccactccatgccaccctgagtccttctgtgtccccagccacctgttccccttctccagcttccacttcagaccttcgtcagcctctgcagcctactgccccacgtccatgtctcaacacccacctgcaaactcagccaatgtgcagggactcctgttctcttcccacacatccagggcccctccctcctccaagaccacgcacagtccagtgcttcatgcgctctcccctagccccttcctctgctccccgattcttcagcctctctctccaaaagcttcttctcgtcatgctttaaacaatttcaagtctataccactaagaagaaggaagaagaggagggggaggaagagaaagaggaagagacaaagactgtgagagaaaaaggaggcagatgaggaggaagagggaaaatgagaaggaaaagaaggagaaatgtaaccactgcttgcactttgcacaccatatcttcagcttaatgtcctggaaaccgtgaggtaagtactgtcaatatcatctgcacatcacaggtgtgatcactgaggtcagtgtggtcaggtaacctacagcaggcacacagtgcacgggcagacggagcccaggctctgcaccaaccaaaggcggcttaccaagggcacctccttgcctctccccatgcacctccccaacaacccttaaaggaaaggagctcgggtgccaggaggcagcagcatccctgggctccttgggctgcgttgggcttctcagcgtccattctcagagaagactccactcctccaggcagagcctcccgggaccgatgctgtcactcacctggggggctgaaggaggcctcccatgtcatggaattgtcccgcgtatacagctccacagagcctctgccaccgctggagcagactttgaacccattggagatgacctgtcccccatacgcagaagggattggtctagactgttctccttgtgtcttccagaaaaaagaaaacgtgacccctgaggaaagtcacaagatcagttattcacagagagcaggggacttgacttctcgcaagcacatggttctctttgctttttatttttcattcgaaaagcattttgtccccattctaaaggcagtgtatgttcagttcagaaaatccagacagtgatatttgctcatgtttattaagggctcacacagtgccaggcacttttctaggagtttgaaatgaattctcgccttttaaaaagtacaaaaatcctgcttcatccccactatacagatgaaggaactgaggctcattcactcaaggtcaccagtgactgatgaagatcgctgcagccccaggcagttccccgcccccactccccgggatcatgcaaatgtgaagacctacaccctccaggtttctctcctattcctccagaaatgtggttagggcggctccttcctaagcctcttctataaatagattttacaaagacacgaaccatctcaggcacactggtttataaacaacatttctataaagtttactccaccgtgaacttcctccgatgtccataaatacactgtcacgttgtcacttttatgtctgcacagcggcgcattctaaacaagcaccacagtcttttttttaaacagcaatcccctgttgctggatcttaaggttttcttccactttttgaagaaattttcaaacagaacttgaagcaaattcttttgcatatctcagactatatgcctttaggatacattcccaagagggcatttcttgccaaagggaagcacacttttaaggttgttgatatcttcaattgttcatttcccgcagttggatacagagggggcagcagctgaaacctttttcaagactctagtctgcacattcgtggtaagtcctgaccccaggcccacgctgcgggggaggagggattgcacctggactaaatggtctgagcgacgcatgttagcatgaatgagctggctcattagttcatgttgcctccgccaccagcagcagataggacatacctcaaatgtgttgtggcagtatattacagtaaattatgacaattagatattgtacctttgtgggtgcaaagtcctactgtgatcaatgtaaacatggaaaaacaatgtaatttttatgatcctcatgtgggatttctccatgtttttactataagaggaactgcaggccgggcgcggtggctcacgcctgtaatcccagcactttgggaggccgaggcaagtggatcacctgaggtcaggagtttgagaccagcctggccagcatagtgaaatgccgtctctactaaaaatataaaaattggccgggtgtggtggcatgcacctgtagtcccagctactcaggaggctgaggcaggagaattgtttgaaccacggaggcagaggttgcagtgagccgagaccacgccattgcactccagcctgggcaacagagcaagactctgtctcaaaaaaaagagggtccaggcatggtggctcacgcctgtaatcccagcacttagggaggccgaggcgggtggatcatgaggtcaggagatcgagaccatctttactaacatggtgaaaccccgtctctactaaaaatacaaaaaattagccaggcgtggtggcaggtgcctgtcgtcccagctgctcaggaggctgaggcaggagaatggcgtgaacccgggaggcagagcttgcagtgagccgagattgtgccactgcactccagcctgggcgacagagcgagactccgtctcaaaaaaaaaaaaagaggaaccgcaaaagcccagctcctgagcatgccccgcacccaccccgaccgctgttctgcactcacacccactggtctgggggccgggctctctgctgaaggggaagtcagggcagggcctggctggaggctctgtggagcttgggcctctctggcgttgcattttggagctctggttgtctctattccacttctctgcctccagtagcatctgcccacctggcccttctttgtgtgtaaactccagtgtgtgtgtgtgtgtgtgtgtgtgtgtgtgtgtgtgtgtgtgtgtgtgagccccctagcgcctgtcaaggnggtttttcaatgtctgctggnggttnctgtgaagtnggnnttcccagnncttactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttcagtattcaacctgcctcatactgcggcgtgggggtgaaagtccgagtgcctgctctgtgtcccttggagtcctggtgagggctgggtgccgcatggctactgggttcccccagggctctgctgatgccccgcattgcttctccccatggcttcacactcggtcttctccagtgccacctccctggggatgctcggggcatccgccacagccctgatacccactcagcctttgctcatagaggctgggtggggccacactttctcccgtggtatttggagtagctaattactgcctgtctaggtggcccctttcctggtcctctgtggttactggacatatcagatcaaatagctcaggaggcaaataatccacgcaggcagcgacagcaggggtcatgttcaaaagacccagcagcatggacaatgctgtgtcagagcgatgctggctgttaactgctggctgggtcacaccatgcagagactggccaagtcagtcctgggtgacagaggccgtggccaagggggccttacggacaccagcagcctctccaggggcatcagcagccgtaccactaaaccagaggagttggattctgattcttactctttgtccaacaacatcagagtcagttacccctgcctgtgacacctgatggttctgtgtcttccatcttccctcacgtatcagtagctacccctggattcttttgatcaaaaactttgggatgcggaatgtaaaatcacttatgatctcactgcctggagatcccattgcctggattctcaggcaacccttcttctccttgacccttgggccaagctcatgggctgtggtaattctggcctcccaggggctcagtccaccccgcccatgttacctggatggagaacagagtggacagagtcctgaaggtccctcctcctggggtgcattttacgtaacactgttcagacctggacacccgtgagactcatccctgtgaatgagctcaggatcatgcagggcgtcatattctccctcccccagcccccactgcaggcctcagaacaaatcctgcaggtcagcggtataagtataatgaggcttataacatcaggacctgcagtcaggagccccgcccagcctctcaaggtgatgcctatggcccccaaaagtccctgtgttcccacccccagtgactcaggctgggagtatgccttgaaggcaggggaggagggaccacaacccatctgacctggcttcgtgagaacgttagtcatgggtcctcttgggatcagtagccagctgtcacctgccgtccccgtcacaggcttaccactgacttccctgttcctgtgcagaactcagcaaatcaaaatgagacgtaaatattcaagcctctggcttaatagtaggatcctcttctcgcctgcccacgcttgtctttcccccagctagaaatcttgactcatttatagttgatctgatgttgatttaactgtttttttaaacttctattttggaataatgatagattcacaggaagttgcaaaaataattacaaagaagtcctgtgcacccttcatccagtttcccccagtgattacaaatgagagaaatacagcgcaatgtcaaaccaggaaactaacatcagtgctatgtatgtatatagttctgttagtttaacacaggtgtaaattcatggaatcaccactgaaatgaagatacaggccgttttaccagccagcagatctcctcgttgctatcctgccttccttctaccatccctaactcctggcaaccagtgttctgttctctgtatttatgattttgtcattatgacagtggtctgtaaatagaatcatacagtaagtgaccttttgagatggactttgccactcagcataatgcccatggttgtataggtcagttgtttatactttttcattgcttagtgtggtatttcatggaatggaggaaccacagtttgatttttttgtttgtttgttttttgttttttgtttttgagatggagtctcactctgtggcccaggctggagtgaggtggtgcaatttcagctcactgcaacctccgcctcccagattcaagcgattctcctgcctcagcctcccaagcccggctcatttttgtatttttggtagagacggggtttcactgttggccaggctggtcttgaactcctgaccttgtgatccgcttgccttggcctcccaaagtgctgggattataggcgtgagccaccgcgcctgaccaaaccacaatttgtttgaccatttgcccactgaaggatgttttggttgtttccagcttctgactattactaataaagctgctgtgaacaattgtggacggcattttgtgtggacataagtttacgtttctgtgagacaaatgcccaggagtactattacagggctgatatggtttgactgtgtcctcacccaaatctcaccttgaaaaaatccccacatatcaaagggggggccagatggtgataattaaatcacgggagcactttcccccatactgttctcatggtagtgaatacgtctcttgagatctgatggttttataaaggggagttgccctgcgaaagctctctcttacctgccgccatgtaagaccggactttgctcctcattaggtcaccctagccatgtggaactgtgagtccattaaacctctttcctttataaattatgcagtctcggatatgtctttattagcaaggtgaaaatgaactaatacaagggtcacgtggtaaatatatttaatattaaaaaaaaatcttccaaactattttccagagtgtctgtacctttttacatttccatgagcaatgtatgagtgatttagtttctttgacagcatttggtatagttactattttttattttagttgttctcatcatggtcttaatttgaattttcccaatgatgagtgatgttgaaaattttttcttgtgcttacttgtcatctggatattctcgtcaataaaatgtctcttagtatcttttgcccattttctaattggattctttttgtgttttatcattgaattttaagaattctttctattttatagatatgaattacagatagaatctatagatattatagatagatatgagttatggatctggattattatagatatgaatcctgtgtcagctacatggtttgtaaatattttctccttgtctgcagcttatctttttatccttttaacaagagtttttcacaaagctgaagcttctaaattttgtaaagtccaatttattgattttctaattctgtggatcatatttttggtgtcatcactaagaacttttcatcaaactcttggtcccaaagattttctcctttgtttttatctaaaagtgttatggttttattttttacatttaatctatggtccattttgaattaatttttttgtatgaggtgctgtttcagcactatttgttgagggggaaaaaaactctccttccttcattgaattgctgttgtttctttgccaaaaatcagttggctgtacttgtgtggggctgttcccaggttctcggctctgtctcattgatctaattgcctgtccctgtgccagtcccacacagtcttgattactgtagctgtgtagtaggtcttgaaatcaggtagagtgaaatcagcttgagcacatgattcatatcacgttattcttcttttacgaaattgttttagcttttctagttcctttgcctttaaagatgaactttagagtaagattttctgtgtctacaaaaattcttgctgggatgactaggaattacattaagactgtatattaattttgggagaatttatatctttattgtgttgagtcttccaatccattaacatggcgtatctctccatttatttaaaatcttctttggttttcttcatctgtattttgtagtttttggcatacaggtcctatgcatgttttgttaaatttacacctaaatgtacattttttgagtgactatgaactcacttaataattgtaggagtttctttctggattccttgaaattattgacataaatgctcataccatctgcagatagggacagtttcacttcttccttttgatctgtgtgctttttcttcctttctgtgctggctggaatcctcagtactatttgaacaacagtaatgagaccagacatctttgcttattccctgtcttaggaagaaaccattctgtcttcgactaataagttagctctaggttttttataggtgtccgttatttgaggaagtttccctttattcttagttttttgagagtcctaatcatgaacagatattggattttgttggtttttctgcctcgatatgatcatgtgatttttcttctttagcctgataatatggtgaattacactaattttcaagtattgagtcagccttgtattccacagcattccaattgaagactggggctatatttatatagtgcattttctttctaaatcttcattctgtgtattaggagaatactatcatcttttgcttcatgggccatgtgaatatatgggcacataatttatgaaacactgtaaggaaaagtgttggcacttggtctctttaaggagcacattttctaaatggaggaaatgactcaattgaggatcccatatcttctatagaaaagaccctttcgctactcaagtgagtttatcttaattcagagaaaccttaatgttttccccactctcatatgttgttttagaaagcaaagggaaaggagagttttctttgggaatcagtgaatcctcaagtgctgagatgctccttttgggtacactggtctgggtgagcgttcctgcctagatgcatagatgtgtaaattaattccatcaaactgcccagctcttgagctagtgagccagacctactgaacaggatgagcagcactaggcaggctgttatctcagccctcattcatcagattctccctctcctctctctttgtatgtatttaccttctactcccttctccactctcagaagtccttttcgaataaatctttccttggtccttgtagaagccacgtggccatcccattccccacactgatgccataaacatctgctctgcaaatcttaaatggtgccgggggttcagggttgatttttttctgtaccaggtgagtggctcagtagaggtgagagaaaacggagtgacagggtggcttgggaagcgattgaccagagtgaaaacacacctgttggtgttgctcctgccaggtttgatttctgaacaagagtgaaccttgtctgaaaagcaaaccatcatgagaacgctcgggccctgctgtagcagcgtggaccctcggctctgtctgctggagccgctgaccaaggctggtatgcagtgccaggaccccactccctctggagacagaaccggagtcacccctgtcccgtgggaggaggcgtcagagacaggcccttgcctgtcactgtctgtgtttcctgatacggatctgtcctgggttgggcagcttcccttgtacggatctcaggcgagaggcacccaggctctgggtcccttttgagaccaggctggagtctgtgatgggagggagggggtcagagtgcagggaaggcccctgccagaggccaggtgtgtttaaaggtgtgattcctcggttgttagttgtgcgcatgaaggagagggggtatttttatcagtagatgagggagaggtttgcctctctcttccccacataaggtaggataaaagttgttgtgacttgcttaccacagactctgaatttctgctcctggctggaagcccccatctcccaggttagggccctctccgggggtggaggaagagacctggctcagccctggtctttgggcctctcaggaacgctggggaccttttgagctgcccagtccctgtggagtttctggggacacctgatgtctctgtggtgaactctggcaggggtgaggctgaggttaaaccttagagccccagggccgggccaggggcccttagtccatttgagccaaactggaagcaaatttgtggggcaactccagactcatgagcaggcagtaaagaaataaaccctgactccagcagtcataggagccacaataggattgtgaccgctacaagatttgaatatttttagaaaacaataatcctggccgctcatcctctgccacggggagggcggaggatgtgatctcacgtctgcaagcaccgcaggctttggttccctagggtttcccgccgacgcatctgcacctgctgctcactccgaggggtgactccatcaggatgtttagggctcgggtggcctgtcagcaccttccaggctgtggggcggtggccctgtccgttcactcccagcagggatgcctggctgggccattgtcctcggccccctgtaccctccctaccgcaggccaccttgtgtgggttcatcccaccgaagttcacggagtgcccctgcatgcctgcccccgttcaggctgtgagggagaggacagagccagacagaccgaatcctgccctgtgactctcacatcccagtgctggggacctggggaggtgacaagcaggcagacagacaggcagtgacaggtacatgcaagatcagatcccaaggagcagcacgtgggaggcctgctggcaggaggctgccctgaggagtggccacgtggatggggggatcgtggggcatcgggggagaggcatcacacacctggctggcggcgggggcacaccttcaagtctgaggagcggccaggaggccgaggggctggaggaggcaggtcaggggctacgggcagatctttccgggcccgggggcaactttaagggcctcggctttcccctgagtaaggtgggtgcccccggagggtctgagcagagggacgaagcgatggacttgggctttcacaaaccctgtacagggcagggtgagcaggtagacggggctgccgccaggctcaggataggagtggaggatgttagcttcaggtctgctatggggggcttgctgacagggtcaaggatttgggggctcaaaaagttgaaggacagagtggccactaactgacaagggcatgactctgggacagtccagggctgggagtgaggtcaggagggaggtttggacatgctccgtttgggaggcctgtggacgcccaggtggggaagctgcattggtggtggtagagctggagctggaatggaggacggagatgcagattttgcagttgtctagctgggcacgttgccaccccgagcaaaaaactgcttctgttagtgagaaagaactggagaaagaatactggtcaggcgtcatcagggtcagcccaggccctggaggaggtgtgcctggctctgtcaggcctctctgggcctcctccagacctggcttctgagcaggggctgccctctgcctcctatatgtctgatcgctgtgcccctgatccttcttctgagcaggggctgccctctgcctcctatatgtctgatcgctgtgcccctgatccttcttctgcctcctatatgtctgatcgctgtgcccctgatccttcttctgagcaggggctgccctctgcctcctatatgtctgatcgctgtgcccctgatccttcttctgagcaggggctgccctctgcctcctgtatttctgatcgctgtgcccctgatccttcttctgagcaggggctgccctctgccttctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttctggagggagatttcagagaagtcccaccaagctctaaagacctcagccactttcctgaggccaccagatcggtcaccatggggaccaggggctggttccagaaccccatggaaacttggaatcccggacaggcagaggtctggggccgagtggggctgagtggctgcacacctcagcctgctctgttctggaaacccgtgttgctgggtttgatgatgcacgcttgtgtctcatgggtggcgctggaatggtcaactctgggcatttgggtttttttctctgcctctggcccaacattagacagaccagaatctcagatattctactaggaatgaaagaatgttcatcttccccaccagacagaggggcggggagggaaggcgtggagtgggatgagcttggccactccaggccttggtaccatgatgacttttccaacgtgaggagggtccaggtggctgaggctgtttgactccgcactgattttgacatgattccacatacaggcctctatgaacccctgactattctcatgcgaaaaaccacagcatatctgcttctcctgaaagtttaaagacactctggcattagcaatgctttccccttgtttctgtaagtcatccaaaattcttcttgggtagaggccagctataacaaaataaataaaaggataatgaatggattggatcttttgatggaaaccatttggccaacttcatgacaagaagaacaaagggaagaaaaaaagaaacaacctttaaattctagctgagatctcaagtagccatggcccaggagccaaattgaaaagctgtaacacttttatagacgtttataggtattgcttttctggactgactgcagcactgagattaggcagtagtgcccttcggcaggtaaacgtgttcattccgagcacagcagctatatggattttctgttctgcctctttctttactcctgaaagatgccattagatggaatttggatgctctggggccatggccttccatgttctgggaggctcgtggattcctgtggatcgtccccccgaccctgaggctcctggagctgacagagcccagcaggcccatcctccatctctgacgtcacaggcatctgagggcagggccatgcactacgagtccatgatgtaccaggcgggggagccagtggctattctaggaaaattccatctccagggcatgaaaagacagataaagatcagtgtaactcacctgtgctgagtaacatggtgggtcacggtggggctctggaaccaggatgtcttgacctgagtcctgaattggccccttcccagctccgtcacttgccgtgagtcctccaaccaccatgtggcttcgtggcttcatttgtaaagtggggcaagagtgtgcgcagctggcaagggctgagcaattgaatgacttcactcatgtaaaacagagcaggaccaggcgcagggcaggtccgtggaaaaggttaactattgccatcattaggaaccatcaaggggctcacacacatgatctcagtggaggcttctagcagcctgtgagggggtgttagagatgtctggatgccagcaacagacgctgactctggttctcctgagcagaaaggtagtttattggaaggataaggggagcacaatgtatcagagtgaagtcatgaaaacaagacaaaatccaaggtcttagaaaatatcttatatggtattattatatcatttttgtattcggcacaaaaagggcaggccaaaaataagccctaatgagacaactgtataaaaacgttttgagtagcctaatgagtgaaaattatttaaaacgtgttaattattattgcatgtatgaaagaatacaggtcgccttgttgcgatagaaatgccaaagtcccttgctttccaataacatgggcctgagaaaattcagtgtcactcatccacgacgatccgatgtggaggttcctattcccacggagatgaagccacaagcaaaggcctgtccgtgtgcaggtctgtcctgagcatgaacatcctgtcccagagagaaaatgctccctctgggaagagcctccctgggcaccccttgggtccttggagcccttctgggccacatctctgcttagcgttgggggacctgtcacacccgagtggggtgaccacgggctcgcgacctgtatgaggcgagactccagcattctaggggatgaccgcaaaaccaggccctcagcagaggccgcctccttccagagccttctgtggctgggcgggggtctccaggcagctccgcagcccccgcaaataccccctggtgctgagtccgcttatacagacagagacgaagggcagcgacagcgtttttgttttctgaagtgggagggtctcgtgaccgcagctcaggaggaaaacgaggcgccggctttgcaggtgggtaggagtttgtgttgtactcggaggctgggagcccctggggcttctgtagggagaggcggtctgagacgcgctttagaagttgacctgctgctctgcggggactcggtgcgggagacgagtggaggctgctgcgtcatccaggtgagaggagagccaggtgcgcagtgagcagaggtgggaggaaagctggttgccacggagatgagggcgtggccatcactgcaaggntaacacctgtagaactacctaaaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttttgtagttactcagcagtgtcttttgcccaccatgctttctgtgatgccttatgaattaacatatctgttagaagtccttcaaatgtcttgtgacaatatatcaagacaactatacctttgtgagttcaaagccctcgcaggattcaggaaaaacacagcatacattttataaccctggtatggaatttccccattttattttttaagagaagaagaacctcaaaaaaattggaagaggcctggacctttctggacctctgagaggctacggggtacaactccaagccctgcggcatctgtccttagggctcctgggaaagaaaacagccttcccgagtgcccagtaatgtgggttaccgcaaaagggtgcgactgtgggggttgcacagaggcctggggcagctgacgctggtgtccccagacctggctggcaccacccacacccacctcatgaacgggcttcctgcaacacctgccttgggcgctgaggggtacagaagccaggacaaccccccgagcctcccgccacttccctgccttgggcgctgaggggtacagaagccaggacaaacccccaagcctcccgccacttccctgcacactcagaaacaacccgtttcacaaggaagtcagcacagtgcgttgtgaaatttttgttatgaaacaaattcccagtaggattcatggaagttaattttttccaaaaactttgctgcattttaaaatttctttcactcaattcaaaatgagcctgtcttggccaaatgtctttctgttcaggaagaaaaataaaaataaaaaaattccatgtggtgttaggtaagggtagatcgaaggccatccatggtgccggtaaccaagcttttcatttagttaactcaacgcacaaaacaatgacttctacctgagcaacagcttatatttaagtatcaattcacgtcttcatagagtcataacaaattcacaatgtgccttccatattagccttttaaggaactttgcctcatggagttgggccatcaatacaacaaggaaaaatctgaaggaaaaagaaacaagcacaatattgacaaactaatttgataattttttcttgttataagcactgaatcctaaaacatccaaaaaataaaatgaggaaagatcttttttgacaagacaaaaaaaggaaaaataaaaatctaggagtcataagaaaagactaataaatttaagtgcataaatataatattctgcaaggcaaaaaaaattaccgtaacaaactcaaagacagacaaccatccagggaaagaatatttgtcacagatttactagatgagaagttaattcccttcatatgtagagaccacggcataagacaaaggatgatttctagcaggtgaggagaacttatatgggctgaggttaaatcctcccaacaacctgtgaactaggggtcattactgtccccatttcacaggggagaaaactgaagcacagggaggtgcggtaacttgcccaaggccacacagctggtctgggacgagtcaggatttgaacccaggcagcctggatctggagtctgcgtttgtaatcactgtgctgtggctcccgcccttcccttggagatcatgcatgcagctgcccttcccaggcccacagactcagcaccctgcaagagcatgatcaacacatgccaacaaagcagcggcccaggagggcgcgaggttatacaggcatgcgggcccgcctggcgtctgtacccacaccccagtcaccacagaccacacagctgaaggctgactcgggctgggcctatcagaatcaccaggactgacccaggcatgggcaggctcacctgacaaaaccagaacttggagcttctgagcggatgctgctcccacaccaggaaagcagccttgagaacagagctggagcaaggcagggacagggtctgatggccgttctggcacccggaccagcctgtggcccaccacgtttcccaaagagccacgaggatgcgcgtcccatacgctttcacgcaagactcagagcccgtttcccggctgcctcatgggccctgtgcctggtgtggccaggaggagacactcgtttgcatatcgagcctttaaaattctcactccacacccccaccccaaagccccactctaatcgcttcctgaaatgactggggctgtaggacacccactttccccatgggaataagaaattcttccctttcccctttccctgctcctctaacaaagccacacgcaggccatcctggggaatggccaccaccttcagtcacagcgacagacagcagagagtcctgcaggctgaggaaaactggaaaatgctggccctgccttaaggggcagtcactccttacccctgaccaactgctgccagtggggtgcaggggagcagttctcatattttaagagaagtcagaagtgtagatttttaaatgaaattttcccatatataaaggttgaatttttttgagacagtgtcttgccctgtggtccaggctggagtgcagtggtgcaatcatggctcactgcaggcttgacctcctgggcccaagtgatcctcccacctcagcctcctgagtagctaggatgacaggtacacaccacctcgccctgctaaattttttttttttttttcattgagacagggtcttcctgtggtgcccaggctggtctgaaactcttgggttcaaacaatcctcctgcctcggcctcctaaagtgttgggattacaggtgtgagccactgtgtcctgccagaattgaatgttaattttaaaagaaaaacactgaaagcaccgggagaaattccatttctggaaacctcgtgggctggggtatttggatccacccacctggcaggagacaatgtagaaagtctcactctaaaaacagaagatcaacacggcgcccaccaaaccaagcacgtatagtcagccgcggattccgggatgtggtatcacatgagttgcgagatcacctggagagactggctaaaaatgcgattcccaggggcttgtccattgagactcagaatcagcacgtcctggttgggggctgggaacctgcagttgctgcccaccaggggctacgagctgtacttggagatacactgtgccacagcatcgtggcagctcaggctcatcttgcatccctctctgggcntcagtttccccatctgttcaaggagtgtgctgaatgaatgcttctctgaggatcatctgctccacaggcctccaagccccctgaccccagatcgcctgagtaagagagtagctagatccctgccaggcccgtgtcccccaggcccctctggaaatttctatcctaaaactccacctgcaagtatcttagcaaattgttgacagcgttttaaatttaggaaacaaatgcaaagggggaaaaagtcaactcaaagctgagaagagggaaatggccgtgcggagatgctccagctgctgcctcgggacctcagcagcctctctggggtttataagcagaagaagttcttaatgcatgtgaggaaaaagcaaaggaaacattcacagagggaggaaggtgaagctgaggggctaatcggggaggctgcctttcccaggagctgccaaagccattcacaggagagctggaactagaagcaatgggccgaagttactcgagacggaatttagcccaatatcagaaataacacactaaaagtcagaggagtccaatagcggaatgggcttcttttctgccgttgtctgtgtttttacttgttatatcaaataacatcatcttaaccgacacagcaataaatcagaggtagaaatgagagtaagcaaggaagagattacctaataatctgcaccttgatgctggaaatgaccttttttggattttatgcaatcagttccctttcatttaactttattatggtcacagacttcacatgagatctacctcctagcaacatgcttgagtgtccagtcagtattgactataggttcaatgtaggggaaatgatttctctaggagtcgtgaatggcccttgttcagtattcaagtgaaggtgcagcaaaccctggatggagatgcattcagtgtgcagtatctatggtgtgccaggcactgagaactcatcactggccaaggcagactcagtcctcgtcctcactgagctgaagaccaagtaagggagacggaagtgacaggccatcgtcggccgtgcaagttgtgggaagaaatgtagggggagcaataagggcatgagacagaggaactcacctggactggagctcatccccgtaaagtttacacttgagctgagccttcaaggtctccaggtaggtgaaagaaggtgccagaacattccagcaagtgccccttcctattttcagcttccccacctgtgtgctcactggtcaggggagttgaaagacagaatcctgagtattgagggaacagactgtgttttctaagcttaacattcaagaatggccagggatccaaacagcctttttctctccaatgtcctccaaagcttgccccattagcagcaagtgaccttaagaacatgtccccagaaggcaccatttgccaaaagacaggacccacagtagctcctagaatgaaggcaggcagacaagcagcagagaggctctggaagaagcaggggtggagggagggccgggagcgggggtccggagcagggccacagcagggacctctgccttctatgggcaccctcgggggacagccacatttctcagcatcaaccctgtcccctaaaacattatttgttaaaaaatcgctgaaaatatgaacagagaccacatcaggatttggaaatcagaaatataaaagcagtgggcctgttaggcaggggctggagagcatttctctatttaagcgttgtttttcgttataagaataacaggttataagtttgtgcccacaccaataagtgtggcggaggactcgctgaacacatctgaaaaggctaattcaatgcttcccacgttctaatcattcacaatttttatgagatctgaataacacctgaattatgattattagggaatattttcctttaaatctacccatttttaaagctcaatgctcactgaagtctcctcttaaataatatatgtgaaaactcgtttctgatgcgcccagtatattaaaataaaaacataaccattgatttttgttttagttgctccaggtgccccctgagaaggcctcctctgcctcctgctacagggactttaatttggaaaatgctgggcaggtcttccctgttcacggcttgttttcccgcacacagaagtacaagctcatcagggccccaggagaatccgcctgagccaaggatacagcagaggaaagcgggaaaggcatgccatggccctcgcacaggctcatggcccggtcaccttgtgaggctgaactcaagacccaggggggcacagtgagaaatgccccacctaccctctgcgtctgcatcaggcctcacgagagcagcctctcaccgagccagcgttgattgaaggtttcctgactttgtttcctttcttttctttttctttaagttagagacaagatctcactgtgttgccgaggctggtctcgaactcctgggctcatgcaatcatcctgcctctgcctcccaaaacactgggattacaggtgtgagccaccgcacccccggtttatatctggccatgctctaaagaaagtggccacatgaacagtatcttaaaagttctgcttaaccatgacacaaaagaaattgtcaacagcgggacatgaagcccgagttcatggctctttcttcacccatgttcttgtgtgtctcatgttgggggcatgaaatgagtgaatacatgtttgggattagaccaaggattggtgcagagtcggggctcaacaagggtatgcagctattatgatcagttcaaccacaacggcccgtctgtcagaagtcaccctccaagcaggcaaagtggtgttcttagaaaagataccctagtgatgaaggggaagtttggaatcatggacacatgagcgataaacccaaaaggcctcccgacagctggaccaaccacatgccaggaacatgctgtaatagttcttccagtcttcacagcaactgtatgggaaggtccttttattcactcactttacagatgaggcttttcaaagggaagcagtggttgcccaagatccccacaaacaggtcggaaccggaagtggaacccacgccttctggccccagagctcatgctgcggacaggctctgttcgacctgaagattattgaagagtcgagaagtctggtggggactgaggggaactggagacggaagtccagggccaccgcgacttagctccagccagccagagaagtcaggagagatttatcaagaaaaactggaaatctgtggaaatttcctatttttcagtgttgacagctaattttaaaattttaacccgatgcccgtccaaccgaacacagccacaggccagaatcagctcaaaggcctctcatgtgtgacctcggcgtgcagataaaacttgtccagtagctctgatttcccgctggtcccatcactgtctcctttcttgggttcattatctgtgatagtcccaggcattggaacccctggcacctgcaccatccttgtcctcaaatgagatcaattccagtgtggttgctggagctttctggatgcctctactccaaagagaagccgttctctagaaacccagaaaaagccaccacagatatgcccccgcccttcccgaatccaatgcaaggaaggagcacatattactctcccgtcctcctcgcccctgccaccgagctcacgccgagcccatggttgttttttactttgtaaaaataaataagcctgggatgtttatggagctgcttgaactcaggaacagcataaactatgagtttgtaaacctgaccgtggttttgggcctcataaccattgctcaaaattctggtttccacaaagcccaagatgtgtcctcccacatgtttttgccttgctaagctgttgtttatttttactggaacaaagtccattttgtcctacaatcatgtacaatgaactcatcacagaaggccatctgatgtccaaaatgccttagagcttcctacgaggactgcattaagctttgttcctccctagaaatcataactttcattttgcctaggagaaaggaacttgaaggctccaagctggtttggaaggcagagaacaatttcccagaaaatttgcaatgtgatccagacgtgcattgcctgaagcctagatacgagagagcaggttacacttcacacggtaaaagcaaacgaaagcaagtcgattgccagtttttcttttgcatctctgctctgtccatggcatgactttagccacaagcctgcgaccgcttgccgggacagttcgagccactgcccagcccctctcgatgaatgtaaaagaaccaaaaccaggcgcaagtgttcttgggtatgccctgcccgctcaccgtcaacatcccagagccagaaatcacactgcaggtgccatgccatcaatttccttcccacaaacgccacggccctgtccagtccccactgtgacatcgctgtgtctgttttttaggaaggttttttttcatcctttacaagattaagtattttgatctcacatctctgtaagaggatgttataacttccagccaccaggacaagtctctgcttagtaacctccttgcctgtattcctccctcccctgccctccgatccatcgttgacattctcacgcattctgcaattgatgagaacctcaggttcacatcttccagtcaccagaggagcaggtgctccctgagaatgaaatgcttgacaaagatgccgcagggatcagccactcaccttcagggccacactgctctggcttgctgatgcaggagctgttgtacctgccgtaatagagaagcgtgactcccttttcctctttcaggtaaatgcctttgttgaccttcccttccacaatatctaaggaagaaaaatgacaacatcatatgttaataaccttccgagattaaaagtctgaagatgtgtgtcagacctacaaataacttatgtgtaagtatgcattattatttatctaagtatatatttataacatcatatattattctatgataatattcatagcatcagtaatattattagtaattaaattgtaaattattaatgtgtatgtcagataaaaatttaatattaaatgatattaatgtatttgtatataatatgcatgtattatatacaaatgcatacagacctttgcatatggatttcatattgcatatcatatcgtatgatgatgtgataattgtgatatttgccaacagatgggttaccaagcgtggcgtggcgaccgcctcctgtcctggactttgtgccgacctgcttttcgagccctccccactcccgtcctcatgctgagtgttccaagtggaacgtttcagtgcaagtgtgaacgtgaagctacagctgaactccttctccttttgagttttaattgaaatcccctgaacctggacaggtagattcgggattttagcagaacccattttcaggcgccaggaggaaaaccccgagtaacattttgcatagtcccaggagagccctgtgggtgacaagcccagctggccgcaaatcccgaggggcactgcccgtccaatcatcttgtgtcccgttcccatggccagggtatctgatggtgagtgtgtggggtaaatcgtttacagaatagataagtgaagactgtaaaaatcaggagcgagtaggatttactgttaactggggtcataatcgctcagagatcttgctaccacatgggtcagggagaatgtctgagcccccggcagccgtcagcccagctgaagacacacgggagagctaacagggtctgtggacctgaccccaaccccagctcaggctttccagctatattgtcacatggataaccgactcaagggacctcagtgtttttccttactgcttttaaactcatttttaaattttatcccatttttgctgagggacacctatatattgcaaggttaaatggatcactagtggttgcgtaattgagctaggctgtataaacccctaagtcagactgcttgactggaaacattaattttggaagccaatcaccttacagttgaaagagcagtcagtttttgtgttgaaaaggatcacagggtaagattgacagggtcagaactggcttctatgctgatctaataaatgcctcagttgctactaccccttttgctttgagcttcatgttgagccatgtaggctctggaggttatcagataagacaataatttaactatgattcttgtgggtatatgtttcacaaacagcttttaacgatttttttaaagtccagctacagacgaaatgctgattttaatgtttataagaaatcaaatgtttgatgaggtatttttaaattaactttaattttccattaaaatggcatgcttttcctcccccaaagaagacaattcatttaaaaatccaaacaatctctatgtctagaaaaggtctcatcttgggtctgttttgttctgaaaacaagcagctggcttagacaatcctgggaacttgaaagaatatatataccttctagtgcagtggtccccagcatttttggcaccagggaccggtttcatggaagacaatttttccatggatgggttggagaggttggtttcgggatgattcaagtgcattacatttattgtgcactttatttctgttattattatattacaatatgtaatgaaataattgtacaactcaccatcacgtagaatcgggggagccctgagcttattttcctgcaactagacggtcccctctgggggtgatgggagacagtgacagatcatcgggcattagattctcataaggagcatgcaacctagatccctcacatgtgcagttcacagtagggtttgtgctcccaagagaatttaatgctgctgctgatctgacaggaggtggagctcgggcggtaatgtgagcgatagggagcagctgtaaatacaggtgaagcttcactcactcacccaccactcacttcctgctgtgcagcccagttcctaacaggctacggattgctgccagtctgtggcccagggactggggacccctgttctaatgtattgcaatcttcctttagacttaaccctagtggttattttttaacaccttggatctgctgtcttgactgggacatttgctcacttgctagccaagacatagngaattcagatactaccanacagaattggccttagaatccatcgtagatccaaacttgacagaccgaagaccaaagtacataaatgctcacctacagttgcagagagatttgagtaggcagatcattggaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttctcctccacgcccaggatggggctctgccagtcatctccacatcccatgtcacaggggtgatatgggggtggcagaggcagagtgtcggctcccctgaagggggttgggggcttcacatgtgctcttgacctctcaccagctggacttgctggtggtcaaaggcccttcaaccctgaaacagggagagcagatgcttgtcggtcacagagctctctctggccctgccccagcactggggcttatgcacacagtgtgctgagtggaaggctgagggcgcagggtcagccggggccagcagtgcttctgacactgtgaatccagcagcggacggcacggtgggtgggcagccccgcaccatctgtgagtctcgcactccccagggagcacgtttcctttcacacatcctgcagctggccaggagtgcacctatgtctgtcgtggagagctggaagcagccgcccatcctcgggtgtctttctgcacccccgctgctacagctgtggggcggcccanatgtgcagaggggcctgcccatctttccccgggtttgagcccacagcctacgggaagcgctgagaatgggtgtgtgcatgtggggcctggccacccgagggagtctttggtggatccggggctccatggatttgcggggcggacggcccagcctttcaccctcccagctgacgtgcagtttagtaatttcttccacaatgataataggttgtctatccagtagctttttatagttcacagaaatactcttgtgttctgagaaaccagtcttcatttgtgggcagggcagggataattttcagatgctggcgtggccctcctgtgcaccacggggctacacccacattccaggagccaggtccctcctgaagggctgggcggcagggcctgctgtctcccctctccgagactgtgcagggaaagggcctccagctggtggggaagaagcctgcttagcttcctgacactcagggcaagaggaggggtctgagaaggaagaaagaaaggaagcacaaggagaatgggttttaagggatgggagagagagagagagggtgagaatgggttttaagggatgggagagagggcgaggccaaaggccgaggaagggagtttggaaaagcggatgatacttcatatgctgtacgtcacgagcactctggagctggaccctcaggctcaggtgcctgctcctttgtggattagctgtgtgactgtgaccgagtccctggggtctctggtctcagcttcctgccttatcaggcggggccttggatactgtctgagcccagggctggcacaagggctgcatgccgcacatatggtgggacctggccttggggggcaggttgtgagccctgcgctgtcaggcatggccctgatacccgtcctctgctcctctcactcccgccccacctgtgtgcctcctgcacactcatgccccatgcacttcctccactcgatgtggagaaacgtcttttcgatctccacgcctacttttccctcactctaagccattatagccagagattctggacacagagtgttgactatgtcacttcctaatatgccttagaatgcacatgtcactgaaataaagtgctcatccgtgcaccacccagagtgaccttgtagatcagcagtgacctcatgacttgtctcctggcgagcactggttaatgggattgccggcctccctggctgccccacaggatcataaccatgtgctttcaagtgtgtgctgccgtctggggtgcgagcaggggcggccgtgtaggctgcagagtgagggcaggtttggggccgggcagtggggctgcctttaggaatggctttcctggagcgggggagagcatgggcccagccgtccagcaggaccagctgtgcctgtgagtggggtccgtgggggactcggagccactcccagtcaaggtctctggctggagagggcgtcgggggagacacagcaggaaaagatgggaaccgagcatctaaaacctggacaagcaggacagttgtttgtggcttgcagatgtcaccctggtggtccaggaagagtcctctgcctgggcttggccctctacctgggaaactgggcacgaatgcttctcttgcatagtgcttggcacatagattggatacacgggggtccaggaatgcgtgcaggaagctgggaattcagtgtgtcctcctgggccagcacaaacctcatcgcctcttggtggcctgttacataacacattttcctgtctcaagttgaaatcaccatcgtcatcgtcatcatcatcatcatcatcatcaatgagattctcagtcaggacatccggtgctattcatagccaggaagtgctgttagttgggcaggccaagtactctggagttgctggaactaaaatttgacttgtgtttttctagcccaaatttcccaagatcacgagccactcgtgtgttgccctgtgtgttagtctgttcattgctataagaaatacctgaggctgggtaatttattttaaaaaaagaggtttaattgcctcacggttctgcagggggaacaggaagcatggtgctgacctctgctcagcttctgggaaggcctccgggagctacagtcatggcagaaggtggagggaaccaggcacgtcttacatgggcagatcaagagaggtggggggtgccacacacttttaagcgaccagatccacgagaacgcatgatcgtggggacagtgccaagagggatggtgttaagccagcggtccccagacattttggcaccagggactggtttcgtggaagacaatttttgcacggatggggtgggggatggattcgggatgaaactgttccccctcagatcatcaggcactagactctcatgaggagcttgaaacctagatacctcacaagcagagttcacggtcggtttgcattcctatgagaatcaaacgcccggctgatctgataggaggggagctcaggtgggaatgcctgcttgcccaccgctctgtgtgctgtgtgcccggttcctaacaggccacgggctggtcccggttcacggcccgggtgttgggaacccctgtgttaaaccattcatgagaacaccgcccgcatgatccagtcacctcccagcaggccccgcctgcaacactggggattatagttcaacatgagatttggtggggacacagatctgaaccacgtcctgcctcagacgggcactgtcctgcccagctgggggaggaagatgcacaaagtctcgcccatgtcccggggtgctcgtgcttgtgggaagttcaggattatgctgccccaggaacgattccttgtttcttttgattgacatcaacaatagccaatggcctgcttcattttccttcttttctgctgtttgatttgaaacagaacttgggtgtttgtattcaaatggtaattttccatcaaaattcctgtttaaacaaattgggaatctcaggaacaacatataatgttctggaggagaagatccttgagagagcagtggatatctgttttctttctttctttcttttctttgttttttttttttttggagccaaagtctcactctgttgcccaggctggagggcagtggcgatatcttggctcactgcaacctccatctcccaggttcaagctattctcgtccttcagcctcctgagtagctgggattacaggtgcccgccaccacgccaggcgaatttttttgcatatttagtagaggcggggttttaccatgttgaccaggctggtctcaaactcctgacctcaggcagtccacctgccttggcctcccaaagtgctgggatttcaggtgtgagctaccgcgcccaggcgatagctgttttcctaacactttcttagcatttctctaccagtaggcaattatttaaagaaggagaaaacattctgtttccagagtggtggagaattgaattgaattgaattgaatatgaattgaaacatacatatggagaggatcaagtttgcttcaaaggatgtttccaaactcgcatctccctgctctgtgtttcttaattaaatggcttatgttgagatctcctcctcctgcttcagaaatcacatctttcataaccctgcatggtgagctctgatctgaaaacttccagctcctcctggggcctgcacgggaccctcctttattaccccaagaaggttgtcctggagagaagggcttgcaggagccgagctaaggggaggctgctgctgctccacaaattggaaaagctctgcctgggaacactgggctgtgcgagccactcccggggctcattttctctgagatgagaacccctgcaccgggtcccaccctggtcagggccgtgtcctgaggctggcgtgggtgggcacctgctggcttcctgctgtttcactccgaccttgtgcccacatcaccatcacttctcgtcttctcacctgttcccgaactcagtccccaaagcgagctcttcttctatagctggaacattcagggcaagagctctgttcttcctgagggctcttgcttcacattcactgaggaattaaaaggtgcttccagggctctcctggaggtctgcaaccaggcatctgcctccgccagggctggcacggtctgctttattcaggagcagtcgggggggcataaaatgcacggattggcttagacctagggaatggggagtggtctttgtggggggaggaatgagaggctcactagagtgaaattaaattagggttaaatggacagaagtgtgagtagcttctgagtagccaaaacaacccacctctaggactccatttcttcctgttggcctcatggcattgactccaagaggatgctgtggtttcatgagcccctgaggagccgtaggtagctctggaggggtgaggaccctggagagggcaggtgggagcatctgccactagacctgctgaaggccagccagtcccacatctctgcttgtggagaacacgacactgtctgccaggtgcattcaagagctgggtcccaaggcacctcagccccagtttatagcacagaatatgtccatggctgtttttctgcctgatccagaaaacatgagctccctctgccatacagtggggccaaatgatcctttctgcacaggcctgggcctttctcggtcagatcggggcactgggacctcccaagtcactcctggtggcatgctggtttctaaagcataatttacagtccttctggtagctctttctctgacagtgcccacagagtcactgtgatgacggagtgcaggctggtgatggcctgggccctctgctgtctgcttccacttccctgccccgttcctgtgctgtgaacatttgcaccctgctttcttcacgtgcatgtgctgtggcatgttgtcaatgttttattttcttggaaacccgtcttcattcgatcaaggctgcttaattctgctgaagtgctctgctaaatcaggaaaatgtgtatcttttaagtaaagggttttctgtagaagcaaacatagtgatttagagaggacctgacatgatttttgtggcctgagaatgacaggtgatcatttcagaagtaatcggccatcaccccacagtaaccccataaacagggctgtttttaagaattttagactttccataacatcagtcaaagtcaatgaaccagaatggtgctaatcaacatggataaatctcaagaaagtaaacccaaagacaaacatccaaagtgggagggcggtagtgtgctgcgacaaccccaccactgactcagccgttactctactgatggttattcatgtcgtttacttagggggtgtgcttgggaatggggtcacatggtgagaaacacttcagttttgctgatttttgccaaatttctgtccagagcagcaccgatagcccaccagtgtagtagacgtaaagtcttgccaccctcactggtgtgaaacaggatctcactgaagatgtaatttgcatttccctgattacctgtgagtgtgagcatctctcacctggttatagcccgtcccatttactgtctccctcccagtttctgcttcccctcaccttgggttttaacccctcaccacaagaacccaaacctgtatcagagtccccaggcctagagctgcttcacctgcacagttacaaacaataaaaaaaacaaaaacacacttactgaggtgtaactggcaaaaaaataaatgcacatgtgtaaagtgttcaaagcatttacccataaaaccatcaccatggtgaagacgatgaacgtgtgtgtcaccccgaaagttccctgggtcccctttgtaatccctgtcccctccctgttccttcccacctccctcccctgtcccaaggcaaccgctaatacttgttctttcgccatagattaatctgcattttctagaacttttgtatgatggaattgtatagtatgtactcttttctggcctggcgttttccactcagcattattgttttgctaagccattagtgtcaagctaagtccagttttgcttactggactagcgagccaagacccttctgtgcgctccacccagtgccctagaagttccaaggtttccaggccggcaggtgtggactcaggctattcctggccctgtgtgagctccagttcggttccctgtaatccattgggtggttctttccctgttctgggcgcttccttcctgcatgtgccagtctctgtgcgctgagaactcgaggggccctccactccatgcagctctctcctctccggtcactggtcttggatatctgagcaccagggtctctgccgggtcttgcctaggttcccctcgctgctgcagcgtctgggaactgtctcaaggctgagctccggggcagttatagagctcgcttctgcgctgtttcctgtccctcatgcacccctccccttcattgcctgatggatgtccagtgctgtgaaaggcacaaattcacaaactcaccttaggtttcagttggtgccaacgggcggtgagtccggtcttgttacactgtcttgggcacaagtctcgactgagcttgttactttatgtttctatcctgtttctggtgcatggaaattttatttaagttttgaacttggccatatctttttagtttggaaagttagattttaagaaatacgcttaatttgtggagggaaaaattatggaagattttgaaatagaccaaaaagattgctgaatgcgtttcatgggaagtgggtgttatctgggttacctgattctcgggagtctgtgctccctaccatgtccctgagccacctcacaaccctgtgagtgacagggtgcccacggattcacgtgatccttggccattgacatgtaggtctcgtctggttgattcagttgattcttctccctggacatcaagttctgccagttttgtgtctattaagcacactgacttcagcgttcgggatgggctcatgtacatatggttctttgaatttccctttgaagtgacggtcacatctcacaggttcccttgcccattaacacgttaaataatatctttgatgtgtgttcattttatctctgtatgagagtcacgatttaccttgttaaaagttatcctttaatatgtgggggagaatttcaaggggaaggctttctatgttgttgacttcagagttcttgtgcgtttgtgtgctccaggcctgggaaaacctggtttaaactgtttcatttgtgaacttacaaagtagcatagcaaacaagggaaactgtgagacaaagcagacgaacagaaatatgaacgagcacagactctggggacagccacagagcttcacagagcatatctctccttagacggttctagaagcaaactgtgggctgtcagattcccccattcttttctaagtaaaaccactcatctttcatggaaaataacatcatttttgatgtggcatatcagagggctcaagaccacaaacatgaccggttattattaacagccacagagctaggctgtaaaatagatcagaattttacaaactttgaaacccacaccattattttcacaggagtgaggattacacccctgggagctcctgatatggtcccctgggggcaaacctatgatggaaattttcccatcatctgaaatcttctaccctgaaggaatatattgagagtcctgttttgtagattgtgttatgaaaatattatttttttcctcttggttgaggatcactgatatgcatagaggcagtgttaacttgttctgatcgtaaacgctttttcagacacacattagaggttgtactttagtttacaatccaggaggaaagtttgccggctataggggaaaatcccaagttgcggcattggaaacaggaaccagtgagaatgatcaatgcaaggaccactgcccattcttttgatctttataaagaatgttctcctaaagctcaggtctagccacactggggccctgactctgtcaaaattcggggacaagaggccaaggtggagggttcctctgggaacatggagcccatcattgctgaggctgtattttaagctaggcttctcttttctcctctgatactgggctatataccagcaccggatacattaacttgaagttgtggagaacttggcaaaatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccctacgttcatcagctcacgcgggcgtgcggtgtgcgtgcggtttgctcgggtggctggcacagggatgccgtcccacacgcaaacactgagaactctggacacgagtacgggcgcttcatgccgggcaaggaacgtgaagcgttttgaaggccacttgggaactgcaaggctggggccaggctggtggagtggaggtcaggagcacgggccagaagaccctacccacccgcctggacagaactgtgtgaccttgggcaagggacttaacctctctgagcctcagtttccactgctgtgtaatggaagacaacagacctgtctgtgtcagtcatgggcaaacacacagatgggcaaagccatttcacatcagcttaagtggaaggccaggaaactgagggctcaggggactgaaaagggaggagcaggtgggcctcagtcatggctggacccggggaccccgaggacgccgtctagacctgctctgtctgccccctgcctctgctgtcctccagacaggcccctccataggagcagagctggctcctgcagcatcgcctcatgtgggtttgggtcctgagaacccagaaggagagcaaggagggtggggaccatgaggggggcggcgaggctggggaggatgagggaaatgaggagggaggggaggggatgcctctttcctgaggaatgtagtcctaaattttgtgatctggaggaaacaccgtcttctgcgtcagatttcttggggaaagcctgcatgcttaccgatttcctcctaatgaaagaaagtggggggcctgccactctttatgtgtgatttccaaaattcttcaggaaaatggtcaaagaaaaatgcaatctattttcctcaaaaagatgccatctcagttatttggggagatctttccaagatagtgaatgaaaagttgacccttccttggcccctcctgctgaagtttccaccaggaagctggccttgctgtgaaatgtatgagacgtgcatttgtgaggtgtcgctgtgtcttgtgcggccacagtgagaacctgcgtgggaaagcggcatccgtgccacggcccacaacgtcacaaaggcgggaggattgcttccagatgcagggtgcacacatttcaggggcaattcactgtgaccaccagaatctgactccagccaggtgtcagccagctctttcatgaagggccagcttgtaaatcggcttggctttccagaactctgccctcacagggtgaaggcagccagagacactacgtggggaaatgggggagtggctgccttccaatacagctttatttacaaaaccaggcggccagcccaagagctgcagtttgcagatctttgccagaccctctattagatcagcgctggcagggatgggcagaggagaggctggcggggcctgctctggggagcccacagccttgcagatggaagacagtctgtctcgcctgtccccagggcctcagccttcactctccctctgctgtcctcacggacccaggtgtctgcagacaggacactggagccccaggatgcaggccactgtgtcccagaacaatgcagctaactctgacgtccccctgcaaaccgagggcctggaaattggacagccaagtcatccctggttcgtcagcattgacaccagccccacaacaagttccatgagcagcacatttacgtgctgaagccaaagcagaactggctgtgcagcgatggaacatgtttttcatttgcagtgaagttggatcttcagctcaggtgaagctctcttcagcacttagtgcaaagatgccttgtcatcaaaattcacctggaaaaaaatgcaaacagctcatccagtaaagtctctgtacttgttacattgtacctgtgtaccttgtacctgtagcagaagaggtggacggaagtggaggggacaaagagtttggttcacaggtgccctccttatctgtgtgaccctgggcaagtgacttgagcctggaggcctgtgttctcctcttaaaacaggagtaataatagcgctgatttctgaggattgccaggaggactgaatgagttaatggtgtaagtagggcttggttttcttaaacatgacatacaagtgcctgcttttgtgattttgtaagctgattgggcatttgtgccattttgcctttgaggtaattatcaaatcctgggcacgatgagaagcaggttagtgcagctgccgtgcgggcagcacgtttatgtgcgcacatatgccgggttcctgccagcctgcaggggacttccctccgtctttgtctttgtattgtgtgctgtcatcctcatacatccgcagtgtgttgtgaggatgaaaggatgctttggtgccgtagtgtcctttaatttcttctccagggatgagggtgagggtctaagtcagtacgtgagtctcagtgcacaaagggtggggcctgggccggaaggaacttttgtctccacagccagccccaggcagaccattccagggctcctgtgatgacggaggggatgatatctgaccacccacggcccggtgggggcttagctgcttcttgcccggctgcttgtacccctaggatcctttgagtctcactcgctgcctgaccccgcaatgatggagactgttcagcttttacgggtgctcgtgctaggctcagccagcaccgggacagccggttcctccaggtggacggggctgagactggcctgctcccagtcctcctgtgaagatggaagccacagcccacagagggaagggcctctccccaggctgtgagggactcacgggtgctcgagaaagatgagtggggaggtggacccggctcagcgtgtgtccttagtcactatagagtgacacggagcaccgatggaaccagtaggtcacggttctgcagccctcagtgcagtaactgacccaggcagaagctatcagtggatgtgcacaccagcgggagcagggttgcggggcgggggacctcaccgacctgcagagtcctagctgtaccaggtcggagggtgcctggtgatggggatgtctgccgcacgcctgcagccaggtggccacactcaacattatcaacgtgggacacgttgtgggcccgtgtctcttgctgtcacgtcatgggagacgtccatgcctcctgtggcatactcctgtcagatgcatggcctcacgcccctcacgaggaagcagtcagacacacctgaactaagcgatgttgtgtgctgctgtggtttcgattgcaagggagaagaagttgggcagttccggattgggggagactaaagaggttcgtgcctgagctaatgcacattcctgggttgagagaagtggagttctggaggacgtgtgtgatggtggggggtgtgtgcagttgactctggactgtgcattagagcatcttgtggggtcctcgttaaatttctgagtgtgatcattgtttgatggttatataggaggcagtctccatttttaggagacacgtggtagagatggagtatgctgtgatgcctgcaacacaccgctagtgcttcagcagaaaggaaatgtgcatgtgtgcgtgtatttgtgtgttgtgtgtgtgcacacaggtgcatgtatgtgcttgtgtggtgtatgtgcgttatgtgtgcacatatgtgcatgtgtgttttgtgtgtgctgtgggcatgcaaatgcgcgtgtgtgcatttgtgtgttgtatgtgcatacatgtgcgtgtgtgtgtgtacatgtgtggtatgtgtgtgtcaagtgtgagcgtgaccactgccagataaagtgaacatggcaaatgataagagctgagagtgtaggtgaagcctatgcgttgtactgttttctggcagatttcctgctggtttgacttttaacagtgcaaagctgcgggggctcctggcatgggcaggaattgtggctgttgccgtcctttctgaaaggccctggctgcagtgctgctcgaaacagagaacaacgtcacctgggcagcatcggtgctgaggaagtcgcctgttaccctcgatgctgtctccttctgctgtttgcgtcagtcaggggctcagtctccttcaagaattcaccatcacccaagatcacactcagagatgctgccatgtgccaccttgttggcaagatttggagtttccttcacactgtgttcccagggtggcgttgaattctcgcgctgagggaaggtgacaagcagtgtgtgacggatgggtgaggggattccttgagcacacaggcatgtgtcagcaggagccagttatcaaggagttcctttaccagggaatattttcatttgcgatgtttgttcactccccaatgtgacatggtaactgtgaggacttgataattctccaaataaccgaataacagccctttttcttactccacttggtctgacttctttggattgagttcctgagccggtcttctgcacaggctgggaagtctctgtgtctcctcatagatttcagcactcctctgaagcctcatgtaactttaagtcccctctttgtgtaacggaaggcggagcagcagcgtggctttggctcagatgtgctgcgtggggtgaaggacgcagagcctgaccatcggtggggctccgtggggccaggtagtaacttggggcacattgaaggaaggcggatttgcaaaggtgcaatcaggagtggagagctctgggggacggcacagtcacgggccaggaacaagaatgggggcacgctgctttccccagggccagccaggcaggccctggaagagatggctttccccgggcagagatggaggggcccccggggcagcgactgtgccctggtaggctgagggaaaagaatcctggccccactatctgctccgatgccctctgaccttctggggcttcccttttgctgagcacatgaagggagagagcccagagcctggctgatgggcacaggacggggcgggtggaggcagggtataaggggcagaggaagagccagcacagcctctgcccaaccttgccccacttcacccttgcccaaccttgccccacttaacccttgccccaccttgccccacttcaccctttccccaccgtgcccaacttaacccgtgccccacctttccccacctcacccttgccccaccgtgccccacttcaccccttccccaccttgccccacctcaccccttccccaccctgccccacctcaccccttccccaccctgccccacctcaccccttccccaccctgccccacctcaccccttccccaccctgccccacctcaccccttccccaccctgccccacctcaccccttccccaccctgccccacctcacccctgccccacccttccccacctcacctctgtccccacctttaccggaggaaaatgctcctaaggaggcgtctggccccattctcatcttgacttggccgacatctggcgtcgcactgattaccaaactgggcctggtggaggccacgtgttcccggagcggaatccaggaaaccactccagatttgctctcatatcatttgtgttcatagaaggttctcacttaatgttttccttatgtttttcctaagaaatggatctaagtcatcgccgcttgcctgtgagtagattcatccactcgctcactcactcacgtgtgtgctgagcacccactgtgtcaggcgtggttccgggagctggggagagcagtgaaccaaacgggaaagcatccgggccccaggggaatttctgttctgggagggagatgatgaccaccggttgcaccatcaggaaatgtccacggagggaaagtcaaggggcaaatcatgctgcgtgtttagggcctgaagcccacagctgcgactttctgttctggctaatggcacagccctaagtgttgctagcaacgtggtttttccagcgcgtttggtggaattgcacacgtgttgagttcatggagctctgcagaaaaggccacgagcatcggggcactgggcacagagagtgagaaccaggctcctggctgaagcgaacacaccacacgtcttagggccttggagtcgcgtgcggggcggggacaaggttctgctgagtgagtcaggctgggcgccgcggggctctgccttggtcccccccaactttctgcggcctcgagcccaccctcactttctgcggtggggactgagcccacgcatgcccagtggtgaatgttctcagacggtgaatgttgttcttccggggaaacatctgagatactacccgggtctgcggctctgcagagtggaatgtttatgtacgttctgtacgtacagcttgtatctctgtgggactaaaactttctgggcaagtttattagaaaaaaatgtctaaaaagcctcttcagaggggctataatgaaaaaaatggttgagacacgtggacctagggtgatgctttctattcattttttttttttttttaagtatgtgttttactccatgtgtgtcatctggactttgggcttggatcaataacatggtcacatagaggaattgccgggtcgagcagtcgcgtctgttgttactcacaggcctgagaatcgatgaccctggtttgctccagaccctgtgaactggtgatgatctgcaggaagtcgcttctgcgggaacagacagggtgttcattctctatggcgccatctttgtaaacactttgtatttacaattccaggaataattctgcgtgcttcttggaggcctgctctttctcagggatgtgtgtaaggagacagtgcagaggccgggggtgaggtgggacgtgctcctgctccatgagccccaccgcccatcccaggcagggtcactgaacacggtgtttgaatctagttagaaggaaaaacaagttgagggaggaaaaatatggtgcccccagctcccagagccctgtgggatgtcccaaaggtggttcagtgggtgtcgaaacagggacctgcaggttcctcagtcagtcagcgctttggatggtggacgggggaggtgcacaggacccgggtgaggcccacacagaagcagacggctgggtgaccgcggggggcccggtgacagcacgtctcaggcatctttgtgtagtcaccccaaattcaaattcatggaacagatacttggtgacctgctgtgtgccaggcagggctgggatcaaatcaggcaaatgggctgagggcacaaaattaaaggagctggtcatccttggggtcgtgcccagtgtgagcaccttcttcaatcttgcccttcaggtacctggcttccctcaccctcctcctggccctgaatatcttttcaagctcataaccccacgagacagccactgtagacatcagttaggcttctttagattgggctgcaaggggcggaaaacccatctttaacagttttaggccaagggggagtttattggatcacgtaagccgagagctctgcagagggctggttncaggagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgctatgagttcatcagattatttccctgcagaaaccaagggataaaggtttccctggacgcacacaaggagtaagtaacagggaaggaagaagaatagggaaatctggaagaaaaatggaaaaggaaaaattaaaggttttattaagttgttttgagtattaatactctgtctttcatctctctcctatgtctgtctctgacacacgcacacaccaaacttaataaaacattacatatggatgataaattatttctgaagaactgtggtgatgtgggctgaaaatacccctttttctctctgccctttcctctctctctctctcgttctttctcttcctccccacccctcctccattttctctctggctctgtcccctgctacttgttttgcaggctggggttgttttggagtcctcaaatgggccatggttttgcttggctggctgacctgcctaagaagacgtttagtctttagaagagtttggtgaaaatcaaggtggttgcagagttaggtggtctcatgccaccttctcaatgggaaaaatgccacagagtgcctttttcccgaaagaatgagactttcttgctctgatgaaacttgtaggactatgagttattttactccttgagttggaaaaggaacctgtgggctgaattcagcccatcccattagcaccacacaatgttttattttaaaaaattgctaacattaaaattttgatagattttgctttaaaaaaaaatctgaatttctgactctgctttaaaaaatgaagacctgacaatcctgggcaaagcttcctgcagagccgcaatgcttcgttcggcatcaggaggcactacttaatttagacagggcacagttttccgcgtcgcctccgcctctcctgccctacgactgcagtggtgccagctgatggtttccagcatctgctctgatgagtctggcctgtgccttccagcttgttaactaccttggatgccatccctggactctgtccagtcacttctcaggactcgccgtcccctgcgggtgtcacagcttgcagccccttcattgcttgtttccagtcagtgttgctagttgcaaaacatctgtggcaactgaggtgttttacacttgtctgaagtgcagtggtgtggagagaaggcagtgttctggcctcaaccctgctcttctcatcactggccacctatgaactctggctggctttggggtgaacgagacaccatcactttactctgtcagcctttctgccaggactgattgtggccatttgtaaatggaaagaatgggaagggctttatcgtccacagggtttattttataaagatgaggattctgaagacacatctgttctttgtataacagatgttatttccttttacaattttttttcccagatgacttgaataacaagtcaatgaggttttgtcctcttcaaaatgaatatcctagactttagggggaaaaaaagcacagtgggaatgaaaatgaatctttttgatttttgcatttcagattcttcatattgcattacaatagtagaactatccccactggaaatcaactgaagtcaggccttactttctaatgtgctactttatctagatagggctattttatttagagagtaacaagacacttaagttattgtttagatacttctctttagctcatattacagagttaactttgttcctggcttacattttgagcttgtgtacataaaactggagggacagatgcaaattgaaaagtggaaccaaggaacaggacacgtgtggatgttgggcgccctgtgaacaaaaattcagatattacatggggtgcgtcagttatctgaaaatgatggtatgttcataactacctatggcacttcaattgtgaaagcaagccttaaaatatttctaaaggaatacagattgaaaaattcaaatagaggcctggcgcggtggctcacgcctgtaatcccagcactttgggaggccgaggcgggcggatcacgaagtcaggagatcgaaaccatgctggctaacacagtgaaaccccatctctactacaaatacaaaaaattagccaggcgtggtggcgggcgcctgtagtcccagctacttgggaagctgaggcaggagaatggcgtgaacccgggaggcggagcttgcagtgagccgagatcgcgccactgcactccagcctgggcgacagagccagactccgtctcaaaaaaaaaaaaaaaaaaaaagaaagaaaaattcaaattcaaatagaacagaaagataatgcaatgtaaatcttcttcttacatctcgcactcagcttttcgatttcttcactcccaaaacagcagtattggtttctgcagtatctctccagacatctctctctcttcttctctctccatccctgccctgaaccaactatattttacacaaatagctcatagtgtacacatttttatcatctttttaaaaattagacaatatcaatgaaagaatatgccatctaagttcatttatgaaccttagtattcgtcccagctgtattccagtccagagtgtagatgtgccatatttatttagccagcgctctgtagatgagcatttaggctgttctcaggtttctgatactattaaaaaattctacaacaaacaagccttgcacagaggtctttgatcatatgtatgagtgtatctctagaataaattcctagaggtggaattactagatcaaagggaatgtacacttaaaattgggatagatactgccaaattacccttcagaaggggtgtactgatttgaactcccatcagaaatgtggtggaagttgccagcttagtatagctaactttttgcttgccagtctgatgggtgaactctgataggctcattgttgtttaatatactttttaaacttatgagcaaggttgggcatcacttgatatatttatacgtaatttttatttctttttcattgaactatttgattatctcctttgcctcaatattcggttggttctttctaatagtaggagttgtactaatataatacgtttaatacctctaaaaagaaatcagtaccgctgctgtaatatgtatttatatatacatattatatagtatgcacagaaactttgttttctgattgtgttttgttttattttattacatgtaaattttgatctatctggaaattgttctggtataaagagtgaggttgggatcttaattttttccatgtggtgaactggttccaatgtctttgttgaataatatttctcctctaatttaaaagaccagctttggggccaggcgcgttggctcacgcctgtaatcccagcattttgggaggctgaggcaggtggatcacctgaggtcaggagttcgagactagcccggccaacatggtgaaaccccgtctctactaaaaatacaaaaattgccgggcgtggtggtcggtgcctgtaatcccagctacttgggaggctgaggcaggagaattgcttgaacccaggaggcggaggttgcagtgagccgagatcgcgccattgcactccagcctgggcaacaacagcgaagctctatctcaaaaaataaataagtaaataaaaaataaaagaccctctttatcacaaactgaatttccatatgtacttaggcatctttgtggatttttctcccgctgaactgtctatccgcgtgtaacaatcagccatctttattgtagtttcatgctgtgccttatcattgagtgtgaatctcctctctttatcctcttctgtttcttctccagattttctttcttattttttatataaactccataatcagatatgtcccccacaaaattctctcagcatttttacaacaaattttctaatactcatagattaaagtatagtttacgacattgagtcggcttttccaagaataggttgaatccttcatgcattcgagggtgctttcacatccctcagaattattattttttattttcttcatgaaaatcttgtacaattcttattcttgttttcataaatattttctttttgttggctgcacttaggagaactcttctttttagagggattattgttggaatacagaaagcaattgacatttgtatattaaatttgtacaagcctccttgctaaattcttttgttgtttgtaatagtgtttcactgacgaaattcttttcttatttgtaatcgttttccactttggttatcaggcatacatcatttgaaaataatgatcttattatctcctctttaaaaagtattttttttaaaaaaacaaggactaacatagagactattagtctgtccttttctatgatctagcagtcgcttggggcagttgattattgtttagtcatctgaaccattatttccacttctgtgaatgaatcccagaggactaatccccgagaagactaaaattgtatgcataaagccactcatgtcagcgccacctgtacgaataaggatggaagctattgattgttcattaacagaagaatggcataacatgttatggggcagccactcaagagactgttacccaaactcaattatgagggttagatagaaacaaagaaataattcatatagcattcaatgagaagagcagaatagaaaataacatacctgcataaagttatgtttactcaaagtataaggatcacgaaggaaatttcaaactgagtaatgcttagtgtggaggaagcatagagggaaaatagaatgaccaggattaaattgagaaagtgagtattgcgtctacaatgagctggcagtgtgattttgtgcaagactttcatttcctgtctttacaaataggctaagaattcaattttcttatagattattgttagcatgaagtgaggaagtgcttgttaaggacctcagtgtctggcataccattcatgttagttttctcctcttttaaaatgattttacccttatttgtttctatagtgtgattgcattgatattaactctaaaataatggtaaataacagcgggatatggaacattcttatcttttcctgacatgaatgggcaagcttctagtgtgtcaccagtaaatgcagtggcttctgttttcatgcaacaagaggcatctattcctatttaccctgttttgtccagttaaggaactatttaccaacttctaatttaagagtttctttttctaaccaagagtgtgtgttgaattttattaaatatgctttcagtatctcccacagacatgggatccttttactcttcccccataatgtgtgtgctaagcggttcttaccctctggttctttcctctctaatgatgatttaaaatttttattcttttttccccaaggatttcaggtgttggcgtctgcttcccattactggccactggagaatgtggatgggatccatgaacttcaggatacaactggaggtagagacgcgggtgctgagagcggctgtgggcgcgggaatcccagggccatcaggaggcgtgggtgctgagagtggctggccttgaaatcccagggccattgggggacgtgggtgctgagagtgactgtgggccggggaatcccagggccatcggggagcagatgtggacacaatctgctttgaagccacggtgatagagatgaacaaatacttgtgtaacttcccgtaatagttatttcaaagcttttttttttgtagagatggggtcttgctatgttgccaggctggtctcaagctcctggcctcagcaatcctctggccttggcctcccaaagtgctggaattacaggcgtgagccactgtgccaggccacgaagcattttactagaatttttatagagagagctattgcgtattgaatgggagaatttctgattcaaaatatgattaaaatgtgccttttccccaacaatcttgaaacagaagctggcctgaggatgcctctatgtgcaagtcaggcgtctgttttctacgttgaatggactagcgtcatctgcacactgaccacagcaggggcctattgatgaagcagatgtcaaaggtcatgccaactaagaccaactcacatgtttgaagggcccccgtttcattcagcaaacgcatccccatctaccagtcagcttccccacacatcagctccatttgaaaagattaagcatcgcctaagacgtttccagtgaggcccaattccaaatagtctgtttgagttcattcagacatttgctggtaggagaaacctcacatctttctgggtatttttttcccctttctaataaggactttttaaaaaccgtaagctttgtatgacagttttccatttttatttttatttactgattgctcttgatcatgtcagatggctgacatgggcggcgagggtttaccgtacagcaatcctagcacgtgcttcggtcgtccctgttccgtgggaggcgttttatttttaaaaccatgtattgctggtgactgtgatttccacattgacacactggcattttccttactcctgtgatttaatgtgttgctggacatcaccgctgaagcttctgaaatgtttccttaaaatttgcaaactgagacccatcggtgctgcctctgttgctggtgttctcagactggggcgccgttgaggagcacgcgctccgtgaagggcacctgcgtgggtgccacgcgctccctgcccagcatcgctctcatccgcctgcctgtagggcagcaacatggccacatttggaaaccaccctacagccagatgtcttttccaaagggtcggcctggcagggctgagaaagcccttgtgcaagtttgtttcaccactggctcgggttcaaacgaaccacgttcccttgttggcatccagttttcttttttcaaggcctttattttaaagccatggaaagggggtcatttcaccaagtggaaatgccttcttgaaacagctcactgttccaggacccagcaactaaaatgctaggagttttttcaaacaaaagcttgaataactgtcagtgtctttctctcttcacccctatacctgaactcattgtggtggcttaaatcagtaactcttggtgctttgaaacctttacctatgaaaaattcttctcctaaggtgatatattcacacagatacagttacacactgtggctgaattttgctccctgaatatattgacttccagtaaagcactaatatatccgtgttagtcctggaacattgcaatgtggaaggtttctctgcacttccctactggatgcattctctaggttgtaatgctatgctggcatatttgaattgattacagccttcttaagggagaaaagaaaagaatagaccccatcagcacattttgctgcggggaacaggtgaatagctttggcaagccttttgaggatgtgcggctttgtcgtttgttgccgaactctccgtcgttttgtccatttgtcatcatctcacgcagtcattttcatgcagagtgtctgtctcatcagttcttgtgacatcataaccattcatccttttgttgagcctgtgttatgagtggccaagttcaatttcatatctctcaactaagtatctgcctatgtgttggagccagaaaattagaactatcgcttgcggccaaattcagcagccatcacgccctggtgtgggaactgagtggggccactggagtggccgagctgctgaccaaagtaaacaagggtggtggaggctgggggatgtgaggtccgaagagaaagtccagggtgctcttggatgaaagagcccctcctggtgctgctgcaggttgagagatatgttggtcccatttgtcttttgtctcactcacttgctgtgctttttctttttgttgtttcacccagcgtcccgaacccacaagctcactgtgcttccttcccgtaatgctacttttgtgtattccaatgattaatgcctactcaaatctctctgcaaggtagtgagcttcagaactggtttttnccccgacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatactttaggtaacatgcgaggagaattcgccgatgacctagggttccttcgcagtcgggtttgttatccgagtccccgaggagaaggcaccatgtgtccttggacattttattatcggctgcgccccaggcccctgcacggggcagttgcccagcaggtgaggaaagggggccactgcgccccagctgccacttgcccacagggatatttttttacagaactgatgatccagatttttttggtaaagttatgaactgtcccaatttttaaaatgttagcaagtgattcaaaacagcttaagtgctgaacaggccaaacccagcccttccatggggccacatcctggacctcccagagcccttggttggcatcatcccgacaagcctcccactccccagtgagcctcaggttccggagcctgcccagcgctacccccagccccctgagccgcgttcttgctgccccgacactgatgagccaagaggaatgttccagaaacagcctcatggtacacagtaaatatttgttgaatgaatgaatgaagtagacataagaaattacatgtgagttaaagaaaatccagcagacaccgctcctgacttcatgtctatacgtcctccacttgaaaaccttgaggactcgtcactctcccagctcagatgtttggtttctaaaggaaactcccaccaggtagcagccttgctgctggcttctcccagctccgtgttcggtcccggtggggtcacaggcgctgcggctctgtctgtcgcagcccaggtgagccaggagggggacgccgacctccaaccccggcatggcgtctgcaacacaaaggctgttcctcctgagcgtgtgggagcagcattcgagccagagtttgaaattgatggctttaggccagcagaataatttgatttagctggcaacagttacgaattggttgatttcacatgaaatctgcactagggcctgcgggcacagctgggcgcattccccagtggtaactgtcggattgtccgcagctgagtgtctgcccatgcgaggctgcggccctccccgccctgcggccctgccaacctgtgccctcctgggcagggcccagcctggcccctgtgggcaggtgagttgttgcccctgctttcagctgggagcctgcaggcctcaagtacatcaacccaaagctgagcaaagagcaaagtgcagggtggggttgggagcgagacaggccagggtcctgtgcaccctggagcagcccggcccggggctgagcatgccgtgcattttctcagatggcctcctgtccgggttcattgcttcctcccacagctctggtgaagagctggggagaggccttactacctttctgcagatgaggaaactgagacttgtggaggtcctgtgagtccagacctgccactaagcactggaaacgggagtaggaaccgcatctttgggcccctggactgacaggggtgaaaaccatccctttgggtgcataccagctctgggctcctccagcagccacgctcactgccctggcaaaacatgacttggctgtgggcgtgtggaacgcacggctttgtccttgcagacaccatgcaggcctctcccctgcaggctgcgtgtgggcaggaggctggctctccttctctacaccctttggtgagggaggcagtgctgcctgagggccatggggtgcccagcactggacagaggaagacgccaaagctcgggtcccgggatggagggccctgcgcacgcacacagggccacacggggatgcacgtggggcagagtgcacccgcagggctggggaacgggctcgtgcggctggggagcaggctcgtagtgaccggagggcatagtgactggagggcggggcgccctggttccctcgggaggatgtgagtggcttcttggataattctgcaggtgggtgggactgaaacccaccaccctgggatgagtgggaagtgcacctgttccccatgaggaggggggtcttttggggaccttattctgaggagcagagttgggagggaagcatttggccgggccactagaggttccctggttctaccaggcgtcaagacagcagggaagactgggtgttaacttcaggcctcacaccgtgtaggaactccatcaacaagaaatagaggttctaattgggtttccatagagtgaactgaatctctacacacctctgtggggacttagaacaggttctgataaagcatcgctttctcactggcagctgtgaagtcctagctatgtgggaagtggtgttaggaccatttaatgatcgctgagtcttgttagaaggatgaagcggccgtcctcacatgggtgcccttgtgtcctgtgtgcacaaaagcatcggggccgaggaggccacgctgtgtctgcagagctgggtccgcgcgtgttgctgtccggctcccaggaacccgtccacccacgagttccccccttgacaggagaggcagaagcacagggggctgaggggaccggtcctgggtggggtcccaagagactcgcagctcctggtctcagaggactggctctgcaccctttttcttttaaaagtggcctctgaaaatatttatttgtaattctgtaaacataattacatctccattaagacctgaaacattccaaatgctggcagtgtccttttcaccacgattcccaggcctggtttatcttcccctcccctgagaccaccgctgccctccctcccacggctgtccttccagatttcccctcgtgtttagatttgcacccattggaaacctctgggtgtgcgagtttctttttacacacacacgacggcatcacgctgccagtgtggttctgagccgcagcggcgctctgggagacttccttccagcacacagagctacttcattaaaggacaaaaatgaaaccgaaacccgaagagcacgcccgcctcgcgccgtattccaccgcgtggctgcgccgcggttcgtgtggctggtccctgcggggccgctctgttaccgatgttcaggcttcgccctcttgttcctcgtgcgtggtgctcgggagcgccttctccgcaggccgtggtgcgcgtgccggtgggtttctgcggcgtgtgccacgcagtggtgttgcagcgccaggagcggatccgaatgcgaatggctgctgtccagggggcctccaggcaggcacacgcctcccacaccacccgcgggcgcattgggcatgccgaaatccgggagagcgtggatgagcctggccctcgtcccccagtccccagggcagcccgcaggacctgtgggtctccaggtcgcggccgtcatgtgggctgagccctccgtccagcactgcttcatgtggacgccgtaggcgggacagtgttcgggaggcagggatctcgtcttctcccgaaacctggtgccatcatgttggtctctgggcatcagccccaggcagggagggcgacaggaggatcctgaaactctgttcacaaggggctccaggaggagaagagcggggcagcctctgtcagcgcacgcccgggagctgcggcagggcagtgctgtacagggaccccccccccacccccgcctccctgcccgggcacatccggcccacaggccagcctcgctcagcacacggctgtacctggatcacgcccatgcccaccgggttccttcttacaacagctgagagggatgtggggatttacagttggggaaactgaggctcagggaagtcaccatgctgcccaaatccacagcggagttgggattagagttgagtctcattccgaagatcatgctttctccttgggggacaaagcaccacagctgccggcaccaggcggccagcgagggagctgccctgcggtcctcagggcgggcacaggctgagatgtgaccaaggtgatagcgcccgtcctggtcagtgctccctgccttgtccatatccttcctggtcagtgctccctgccttgtccatatccttcctggtggtgctcccgccctggttggtgctccctccctggtcagtgtcctccctggggagtgctccctccttgctcagtgtcctccctggtgagtgtcctccctggtcagtgtcctccctggtcagcacttctcccaggtcagtgtccttcccggtcagcgtcctccctggtcaatgctccctcccaggtcagtgtcctccctggtcagtgctccctctctgctcggtgtcctccctggtcagtgtccttcctggtcaatgctccctccctggtcagtgtcctccctggtcagtgtcctccctggtcaatgctcctccctggtcagtgtcctcctggtcagtactccctccctggtcaatgctccctccctggtcagtgctccctccctggtcagtgtcctccctggtcagtgctccctccctggtcagtgtcctcccttgtcagtgtcctccgtggtcagtgctcctccctggtcagtgtcctcctggtcagtgtcctccctggtcagtgctccctccctggtcagtgctccctccctggtcagtgtcctccctggtcaatgctccctccctggtcagtgctccctccctggtcagtgtcctcccttgtcagtgtcctccctggtcagtgctcctccctggtcagtgtcctcctggtcagtgctccctccctggtcaatgctccctccctggtcagtgctccctccctggtcagtgtcctccctggtcagtgctccctccctggtcagtgtcctccctggtcagtgctcctccctggtcagtgtcctccctggtcagggtcctccctggtcagcgctccctccctggtcagtgtcctctctccctggtcagtgtcctccctggtcagcgctccctccctggtcagtgtcctccctggtcagtgccccctccctggtcaatgctccctccctggtcagtgccccctccctggccagtgtcctccctggtgagtgctccctccctggtcagtgtcctccctggtcagtgccccctccctgggcagtgtcctccctggtcagtgctccctccctggtcagtgtcctccctggtcagtgccccctccctgggcagtgtcctccctggtgagtgctccctccctggtcagtgccccctccctgggcagtgtcctccctggtcagtgctccctccctggtcagtgtcctccctgggcagtgtcctccctgggcagtgtcctccctggtgagtgctccctccctggtcagtgtcctccctggtcagtgtcctccctggtcagtgctccctccctggtcaatgctccctccctggccagtgtcctccctggtgagtgctccctccctggtcagtgtcctccctggtcaatgctccctccctggtcagcgctccctccctggtcagtgtcctccctggtgagtgctccctctctagtcagtgtcctccctggtcagtgtcctccctcgtcaatgctcctccctggtcagtgctccctccctggtcactgctccctctttagtcagtggcctccctggtcagtgtcccccctaatcagtgttcctttcctggtcagtgtcttccctggtttgtctctaaggcagggaggacggagcccattgagggcaggggcgagtcctgtgaagatctccagccctgggtgtggccagtctctgtccttgtgtgctggcctggaggaggggagtcaggtgatccacggcgaggagacgttgtggtttggagactgctccggtgtcctccgcacctggagcctggacaatggggggacagctctgaagggcagatgggtgggagcattccaggagcaggcagccccgggcccccttttgcaccccttccgcagccatccagggagccccctgtcgggaggagaggggcagatacagagtcaggtcagcagcctggtgagaggagccatagaggcagtgacataatgtgcaatgtgaggacagttgcaccgccctgtgagctcacgtggggacacttcctctgccgggctggggctgggactctcctccatggctgtgaccgttccagacaagagttagccagccattgtcagtgccagggacgtcacgactgtgcgtggctttgggggttgggtgaagccataaatcncccactcagcatttnctggaagacgtgaganctnctngaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacacgggaggaacgcttgaagccaggagtttgagaccagcctgggcaaccaagtaagatctcacctgtaccaaaaaaaaaaaaaaactattgagacatggtggcacatgccggtaatcccagctacttgggcaactgaggtaggaggatggatgcaactgaaaatcatttgtcataccgagaaccggaaaaatctcaacttgaatgagaaaagaaaaacaacagacatcaacaccaaatgatgcagacagtgaaattaactgacaaggatttttaaaacagccatcataaaaatgcttccatagttacagacactcttgaaacaaatgaaaaagagtctcagcaaagaattagaagtgcttccaattttggactttttcagattttgacatttctgcattatatgtacccggctgagcatgcctaagctgaaaatccaaaatctaaagtgctccagtgagcagttcctttgagcgtcatgtcagcgctcagcagatttggagttttgaagcatttcagatttcagattttcagattagggatcctcaacctgtataaaggaaaaccaaatggaaaatttagaagtgaaaaatagaataactgaaatcaaaatctcaatggatgggctgggcgtggtggctaacgtctgtaatcccagcaatttgggaggccgaggggggcagatcacttaaggtcaagagttcaagaccagcctggccaacatggtgaaaccccatctctactaaaaatacaaaaaaattagctgggcatggtgtctattagcacacctgtagtcccagctactcaggaggctgaggcacgagaatcacttgaacctggggggctggctgcagtgagccaggatggcgtcactatactccagcctgggtgacggagtgagactctgtctcaaaaaaagaaaacaaaacacctcaatggatggctcaacagcaaaaataaaaatagagaggacagaggaaagagtagtggacagaaggataatttgaagaaaaacaacataaattacccaatcagaacaacagagataaaatagattttaaacaattaacagagccttgaggacccgtgggacaacaacgaaagatataatatccgtgtcactgcagccccataaagagaagagaaagggagtggggttggaaaaacagtccaatggccaaaatttcttaaatttggcaaaacatataaacacacagattcaagcagctgagcaaactcaaaccggaaaacctgaacaaatcactgccagacacattatagtcagacttctgaaaaccaaagacaaagaaaacaaattgttgaaagcagggagagagaaaggacatctcacctacaaggccagacaattagaatagcgtggatttcccatcagaaactgctgaggatggaagggagcggcctctctcaagagctggaggaaatgaactgtgcaccctgagttctatgtccagcgaaaatacccttgagggatgaagaagaaacaagaacgttctcaaaggaaaacagagaatttgatgccaacaggccggacataaaaaatgtctaaagtacatttctggaaatggaaaggaaatgataaaagaaggaatcttgaaacatcaggtatgaagaaagatcagtggaaaataaaaatatggtcccagcctgcaaatgtgtacggtggtaccttgctcagcaactcaaacccagcacattccaaacagatcactgaaagggcatggaggtttctgttaggccaagcagccgacccgccctgggtcacatcctcttgaggagctccactgacccaggacgctcacgacgcttccctagaatccagcaagcaacagacacagctactgaaaatgtgttctgtaggatctggaatctgagccctctggagggatgctatgaaataaaaaacccagactctgccatcaaagaacttctagtctcatggggagggcaaggccagaatccatgaaaaaaatattgtcagaaatgaaaagcacaaaagagtaacctctgaaacccctcttgctctaaacttctggatctaggaagttgctgtctgcttctcttaatacttatttcccaataaagttacaaaggttaaaataacagaagctcattctccctggtgcatagacaaggaaaaacatgaacaagaaagaagcgagatgagcacgaagacggctgcggtcagtcctgcaggaaagcacatggggtccttgactagggaggtaccagtgaaggcagagacatgcagacccattttctgcctcatcccagctccacctgtgttgtgggttgaacggtttccccacaaaattcatgtctccccagaaccctcagaatgtgaccctatttggaaatggggtccttgcagatgtcattaatgtaacgttgaagatgagactgtgctagatggggacgagccctcagtcccatctgagtgtcctcgtacactgcgggaaaggacaatgacacacggaagaggaggccgtggggagacggggcagagactggagttggctgccgcaggccaggactactaggagacaggcaggggtggacgttcccgctgagcctccagaacgaactagctctgccaacgcctttgtctcagactcgtggactcaagagctgcaggagaacggctttctgctgtttaaagccactagccatttgtcacggtggccctaggaaacggccacagcagcgcagactcggctccgctgccatctggccccttttctccaccgttccccttccaagcattctctggtccgcggcgtgtctcaacacattaggaaccactgatgccatccaacccagcttcaggggtgaagcacagagcttctctcaaacaccagcaggcgctcgccaggcagcgttccgtgcagttcttcaaacctgtttatcacagcgggggtagcctgtgattatttcctgcaacaatttcctccacttcaaaaattacacccaagtcgttgccacaaaatcatctctctaaattttatcccgttactctaatcattgtggacaatgctaccataattagtaattatcctccccctccttcccagcatcctaaatctcatctatttgtcgaatgtcaacacacgtgagtccaagacccacggcacaatcaacgcctccacaactggctcctgggacatgggtgtcttcagttctccccagggacatggcttccttcgtcgtcctaggggcctggaagctgtattaacacctgcttgcatccagaagcgtgtgctttgttttctctttccaacacaaggatctcttgtgtggtcacgctagaaccaggggaagtgattatcccacggggtcttncgcctgtgtcaggttcatggtncaccacatcaaggtgctggtctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccctccgaccacacacatgcttggcttgtgcggtgggtggctgttttctacatttccttgaagagtgatttagatctgaagtcagagtgtcaggacttccagaggccacagcagcctcttctctgctcccttgggactgcgcttccacacgtggggcagaggcgggggctggcactgggtgagggggtgatgggaagaggcgtcgcctcactcctgagaagccttgccacgtgttgatgtgtatgggtctggctgctggcttccccaggtcaccgacttattttttaaatttcctttaaattactcaggtaacacacaaatacgcctccttgttaaaaaattacatataacgctgtctgctggaggctttggccctggtgtagcctgggcccaaggaagcctcattacacccctccgagaaccaggctgtggccaccaggtttttgttcatcttttctattatgtgaggttggtgctgcagttttcctgctgatgcccctctgtggtcctggtggctgcaggacacagggccctctgttgtctgtgcaagagttcacagcaggctgtggctttgggaagacagaggagaagatgtcttttccaggcggttttaagagaccctgtgatggattaaaataaccctaagatacggggcggcaggggtgggggacaaagcaaaaagagtaaacgttccattttgccaaaacattagtagtagacagcactaggataattgggttgaggctggaggagctgtcagacagatgctgcgatgatagccctgtgagtcctttggttctgcagtggggtccgaggtgcctgtcaggggcaccagagctgctgcttcctgggaaaggaggggcttttggtcgaggccaggatggcgctcatgaggggggctgccctcgtggctctgtcctgcacaagtcagtgccttcctgagggctggtcaccctgaaatgggggaagggtctcattggagcaatgatggctcaggaatgggtcacagaacagagcaggcatcggacaaataagagatgcttgacttgactgactgggaatccatcagacaccatttatcccggagccatgccacctctgagcagccctgggtcctggtggagtcgctggcctcctgagcctccaactatggctcctgaaggtgtctgtgcctttcatttagggtagagcatagctgcagagtcctccgagctggcacccaggagcagcccaggagagaacgccagtctccggaacaaggtggtctcatggacctgttcactgattcttttgttcattcattgaacagatatttagtaagcacctgctgtatgccagatgccctctaggtcctggggatgcagccgtgaatgagacagaagctctatcctttctgtagtggatattgtagaggggaaggtagcaaacacacacagtggacagtggatatgtaatatgccacatggtgatcaagactatgaaaacatcagtgagtggaatggagctagagtgggcagggtgccggtgctgtttagaacaggtagggaagggaaggtctctctgaggagctcctcctgcagaggcctggtagggagtggggaagagcctgtggctacctggtggggagtggggagggagcctgtggctgcctggtggggagcaccctatggggaggcacgtcctaggaggaggagtgtcctagagggagggcccggcacctgccagggcccttgggtgggttggggagggcagagcagagggcagcatgacctgggccaggtgatgtgggaccacacccacaatggatggagatagacatcagtggctatgcctgtccctacctgaggtcgcccagctgtaagggtctcgctctcacatcagtgctgagaaccaggggcctcttcagcagcgtcatgcatcgtgtttgctttctttcatttcagacacgtaagcagcacagtgaggccaccaacagcagcaaccgagtcttcgtgtactgcgccttcctggacttcaggtaccctctgcacaggggagagcaggtgggcatgaggtgtccaagcccaggccgccccatgccagcccaggggaggatctgggtcacccatttctgcagctgacatggttgcgttatgcgaaaatgctggaaatgctggagatgtgggcagggcctggtggcagtgctgggtggaggcctcccctccagaccatgcgaggaggggcctgctgttgcacgatgtgtctggacaaagcctctgaatgcccagggcaactttcaagccagtgcagcagatgctcgggggagctggaggatgctgtccgttggagcaggccctacagccctggctgtccccctcgagggtcttggagcagctgaggaagggggttgggggagtggcttctgactagccacgttggcattttcctgtttgaaaccttgccggctccactggagcaggctgaccatcaggcctgcctaaaactctgaggcctcagcctctgccacttgggccctgactgggacgtcctccccagcatctcccatgtccacttgtcacacctgtcacatgcagtctcctcccgccctcctagcccctgccccagctcgcctccacggctcacctgcccaatgtctgggggatctcccaccatcgctgtgatcacaattctcctctagacgtgagcccaccgtgaatggctcccacagtcacagcggtgttgaaaactcagctccccgcagggccggggagtggagggaggggtggggctcccggatcctcagctgctgctcagctgtggcccctggggcttgttccatgtgggatgcaggttgcaggtcctgtgttgccaggtcatcagttttcatggctggatattgtttttgtttttgtttttttgagacagggtctcactctgtcacccaggctggagtgcagtggtgtgatcttagctcaatgtagtctgaaactcctgggctcaagcaatccttccgcctctcaaagtgcctctcaaagtcctgggactacaggtgtgagtcactgtgcctggctatggctagattattatatgaactgtcccaatgtttaaaacactgcacaggcagctggaacacatctgggacatccagttcacaccctgcctagtggcccatcaccctgcatgttgtcagggctccccaacacctgggcatcttcctgtgcctggactcacttccccagctccctcctcctgctgcttcagggcaggatccacacaggctgtgccacctctgctggtatggtccccgtcagagaaagcgtctctgctccctgcacccagagggccaggagattgcaagacgctgagctgggggtgcagcagcaggtcggcataatctccctttatctctgttctgtgaacagcgaggaaagtgcagcccagctcctgtcacctccagcaaacactgcttacatttttgaccccgggatgcctcactctggctatggccgtcggcgtctggctatgaccgttggcgtcatgcctctgcaatgtggattgatgctctgtaatttcagtgattttgccctggtcaggctcagcaggttgcagctctttttcctttatttgtaaattgtgaaaatttggaagcatgtgctcctagaaatagttattccaattccggggcactgtttggagaaaaaaattatgactagaaaacgggatgggatttggtaagaactaaattggcatgttgattcttatttttgaaggaattttaagaacatagaaaagtacggagaataatataacaaatgcaggtacccattgccccaaatttatagttattagcatgtttatatttttgtatttttaagaatgaaacaactaaaacatcacagatgatgttaacgaaccctccacctccttctgttcttttccctcaattcctagaggcagccaccatcatgaatatagtatctgtatccttcctgtccattgtgcaattattacttattattatataattgatattcagaaaaatccacacttgtagatgattgtacagttctgtgagttttgacaaatgaatacagttgtgcaaccaccgtaatcaggattagaacaatccatcaccctccaagatgcccccgtgtctgtttgcagtcatcccttcctctcacgtccggctcctgcaagcaccgatttgtcttctgttcctatatagttttgcttctgccagagtgtgcatagatggaatcatggcgcaggaagccttttggagtctagcctctttaattttgcatagtgtgttgagcgtcaccacacatgtattgttggatatatcaacatcttgttttcacatttcactgctgagggggtattccgttacatggatgtaccgtagtttatttatcttctcccgagtagaggaacatttgggtagttttcagagtgggatcattatgattaaagctggaagtttcaccagctttgcttttgtggggtaaaccacacttggtcatgatgtattatctttttgtatactgctaaatctaattggctacagttgttgagaatttttgtgtctacgtgcatgttggatattggtctgcagttttctttttttggtaatgtctttgtttttatatcgcaggtaatgataccttcnataataagttatgcatgaactacttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttccaggcgactctttcacagctgtcttgaggtcctcatgccctcttgttacattggtagcaacaggcagattggaagggaggcaagagctgaatggggcagccttaaaagatcccaggttcaggctgggcgcggtggctcacgcctgtaatcccagcactttgggaggccaaggcaggcggatcatgaggtcaggagatcgagaccatcctggctaacacagtgaaaccccgcctctactaaaaatacaaaaaaattagctgggcgtggtggcgggtgcctgtagtcccagctactcgggaggctgaggcaggaaaatggcgtgaacccgggaggcgggtcttgcagtgagccgagattgcgccactgcactccatccagcctgggcaacagagtgagactccgtctcaaaaaaaaaaaaaaaaggttccaggttcaagtgcagaggccagcaaactgcagcagtgtggcccactacctgcttttgtagatcgagttttcttggcacacagccgcgtccattgatttgcacattgtctgtggctgctttcaggctaaaacagctgagccgaatagttgcaacaaagactgcgtggcccgcaaagccaaaaatactaactggctcttggcagaaggcatatcaacctctgggccagggggtgccgtggaggttccagcctacccctgcggggagtgccgtggaggggagttgggggtcttgtccctctcacgtcttcagaggatcccagggtttgtgccatctgggccaattcctcatttacccacaagtcatcagccttatttccagatgaagaaagcaggttttgggataacaagtatagcatgaccccatttgtttaaaaagttaaaagctctatatgggtacacacccacatgtgaacatataactgaataagaaaatgcccagacagatgcacacaaaataatggttccctaaggagaggtttgggtttggggagtatgtgcttcaagattatatgcacctaaaaacacccatgtattgcctgcataatttgaaaattaaaaacttttaggaagctgtgtgtttacattagaacatcagcttccctgtgtcctggcaaggttcatcctgaaaaggcaagaatttgggagacagtaaagggtcactgtggggcctgctgggcctagggttgaggagaaaagggcagagcctagccacttccagtaacaccccccaccaggcgtctacagccaaacacacacactgcccaccgccccttctcgaattgttctcggctctaacacacactgcccactgccccttctcgaattgttcttggctataaggcagggaaatggcttttcattcactcggtgattctagttacacaaaatgcgaacatggccataggcccgttattccctggtgtcttagtctatagggctgctgtaacacgggaccacaggctgcacagcttaaacaaatttattttctcacagttttggaagccagaagtccaagatcgaggtgtcgtcggggttggttctcccgaggcctctctccttagcttgtagataactgtcttttccctgtgtcctcacatgcttttccctctgtgcatgtctgcgtcttaatctcctcttaaaataagtgactgcctaagccagtcattggattaaagctcaccctagtgacctcgttttaacataattatgtctttaaagaacctgtctctaagtggtcttgttcttaggtacggaggcttagggcttcagcatatgaatttgaggggacatagttcagcccataacgcctgattttccagaagccacagagcctagacaccccgttcccccaaagaacagggactctggatgtcaggggcactttagcctgagccttcaaaatggcttgttctgtgctggccccaccgaggaaagaaggagagtgcctccaggtctggggaagagaaggagtctctgatttaaaatctttgtctcccttggggagaagccagggtagctatgtgtctacatagagacagagatatggttacagatatatatacagaggtatagatgcaaacagatacatagagacagatacacagatggaaatgtagatacagatataggcagatacatggatacagatacaaatacagagatagatacagatgcattgctatagatgcataggtacagataagcataaatatagatacagatatatacagatgctcctgaacttacaatgggattaagtcctgataaactcatcataagcagaaaataccataaattgaaaatgcatttaatacatataacctacagaacatcatagcctagcctacctcaaacattctcagaactcttacattagcctagagttgggcaaaatcatctaacacaaagcctctttataatgcaatgttgaatatcaaatgagttgaatactggaagtgaaaaactagttgtataggtttgcagagtacagtttgtactgacatgtcttgctttcacaccactgaaaaggtgaaaaattattactcgaaccttcctaagttaggaactgcctgtagatacatgtagatactgatacatagatacggatacctaaatacaggcagacagagacatactgctgtggtttgaatgtttccctcaaagttcatgtaacttaatttccagtgcgacaggttcggagaggtggaactttaggagctgattaggttgtgagggctttgctctcgtgaataagttaatgctgctgttgtgggagtggtttcattattgaacgagtgggtttctgatgaaaagatgagttttgcccccttctctctctctgtgctctcttgcttttccgacttctgctatgggacagtgtagcaagaagtcccttaccagatgcaggcccctcaactttggatttcccagtctcccaaactgtaataaatctctgttctttataaattacccagtctgtggtattctgttatagtagcagaaaacagactgaggcacccactgttgtgtaaactagctatttgtatgtgtgtatgtacctgtatagccctttcattgtgaaatagtggtgtccagctcagtgtttattcacaaatcaacattctggtgaccctgagctaggtcaagaaacagaacaccaggattcctatgcagtcctgcctccctcctcccaccagagatcaccgtgatcttggccttcatagtagccacgagacctttgctttacagttctactgcctccatgtgcattccagtttttcttctgcagtgaggcctgtgagttgtttctttgacatctgcctttagtggggagatgcttagctgctggaatatccatggtactcacactgtacatgcctcagtcccagggcattttccgatttgtagtcgagtgtgggtgtaccatacagcaaggcatggatgaggatgagtgaaatggagtgaggggggccaggcctgattctgtattatattttcatgaaatgtcagatttgtgccactcgcagccaaagtcccccaccgcaccgatgcaggattggaggccatggtgagccgctcctcctcttaggaagccacagcaaatgtatcatcctgataagatggaaaaaatgtgcctggaaaatgaaaccagactgacccaggctaaaagaaaaaaaaagacccagcaaaatctttggagaaaaaggaaagatgatgaattctgacaagtaataatgtgatcagcttaactgttatgaaacacttagagtgcatcttaacgcaaagcggtcaagataaagtaaaggacttgaaatctcaaattaatcactcgtagtgtttcatgttggcaaaacattttgctgcaagttgatcatcctttcggtggccttgtcagaaaagtctgggaacagtcatgtgtgcatctttcagctttacagctgagaggtccggggcagaaccacgctttatagcctccagaggcaaagcaggagtgatgatgagactctgagctcatgtgggtgttggttgtgatgggacctgagctcagatggggtgttggatggggttggtttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacgctagttcatcacatcttccatcctgatgcatgattccattcgattccgttcaatgattattccattcgagtcattcgatgattccattcaattccattcgatgctgattgcattcgcgtccatcgattattccattacattccattagatgattccattggggtccgctccatgattctcctcgattccattccataattccgtttttttccgtctcatcgttcgattccattccattccattccatcataattccattcgattctacgcgatgattccattccattccatttcaagatgattccattcgagaccgctccatgattgcattcaattcattcgctgacgattccattcaattccgttaactgattccatttgcttccatttgctgctgattccattcgattccatctgatgatgattccatgccattccattagatgatgactcctttcatttccattcgatgatgactccattcgtctccatccgatgatgactccattcgactccgttaaatgattattccattcgagtccattcgatgattccattcgattccattcgatgatgattgcattcgagtccatggattattccattccattccattagatgattccattcgggtccattcgatgattctcttcgattccattcgataattccgttttttaccgtttgacgctgattccattcggttccattcgatgataattccattcgattctatgcgatgattccattccattccatttgaagatgattccattcgagaccattcgatgattgcattcgattcattcgatgacgattccattcaattccgttcaatgattccatttgattccatttgatgttgattccattcgattccattttatgatgattccatgcaattccattagattatgactcctttcatttccattcgatgatgattccattcgtttccatccgatgattccattcgattccgttcaatgattattccattcgagtccattcgatgattccattcgattccattcgatgatgattgcattctagtccatggattattccattcaattccattagattattccattcgagtccattcgatgattctcttcgattccatttgataattccgcttgattccgtttgatgttgattccattcgagtccattcgatgattccattcgattccattcgatttttattgccttccagtccatggattattccattccattccattagatgattccattcgcgtccgttcgaagattctcttcgattccattcgaaaattccgtttttttccgtttggtgttgataccattcgattccattcgatgataattccattcgattctatgcgatgattccattccattccatttgaagatgattccattcgagaccattcgatgattgcattcaattcattcgatgacgattccattcaattccgttcaatgattccatttgattccatttgatgttgattccattcgattccattttatgatgattccatgcaattccattagatgatgactcctttcatttccattcgacgatgattccattcgtttccatccgatgatgattccattcgattccgttcaatgattattccattcgagtccattcgatgattccattcgattccattcgatgatgattgccttccagtccatggattattccattccattccattagatgattccattcgggtccgttcgaagattctcttcgattccattcgataattccgtttttttccgtttgatgttgataccattcgattccattcgatgataattccattcgattctatgcgattattccattcctttccattagaagatgattgcattcgagaccattcgatgattgcattcaattcattcgatgacgattccattcaattctgttcaatgattccatcagattccatttgatgatgattccattcgattccatttgatgatgattccatgcgattccattagatgatgacccctttcatttccattcaatgaggatgccattcggttccatttgatgatgtttcctttgaattccatttgatgacaattcctttcaataccaattgatgatggttatttttgattccatttgatgatgattacattcgattccatttgatcataattccattcgattccactcgatgattccattcgattccattcaatgatgattccattcgagttcattgactgttccattccattccattcgatgattccattcgagtccattcgatgattctattcgattgcattcgataattccattcgattgcattcgataattccattccattccatttgaggataattccatttgagtccattcgatgattgttccattcgattctattcggtgattcattcgattccatttgataatgattccaatcgagaccattcgatgattccattcaattccattcaataatgatccctttcgagtcgattcaatgattccattccagtccattcgatgattccatctgattccattcaatgaatccattcgattccattctatgacgattccattcatttccatctgatgatgattcctttcgattccattcaatgataccattcgattccattcgatgatgatttcaatcaattttattcgatgattccattcgaatccattcgatgatgagtccatccatttcaatttcatggtaattccattcgtttcaattcgatggtgtttccatttgattcatgcgatgttgattccattagcttccgttggatgatgattccattcgggtccattcgatgatgatcacactggatttcattccataattctattcgattccattcgatgatgattccattcatttccatccgatgatgattccattcgattccgttcaatgattattccattcgagtccattcgatgattccattcgattccattcgatgatgattgcattcgagtccatggattattccattccattccattagatgattccattcgggtccattcgatgattctcttcgattccatacgataattccgtttttttccgtttgatgttgattccattcgattccattcgatgataattccattcgattctatgtgatgattccattccattccatttgaagatgattccattcgagaccattcgatgattgcattcaattcattcgatgacgattccattcaattccgttcaatgattccatttgattccatttgatgttgattccattcgattccatttgatgatgattccatgcaattccattagatgatgactcctttcatttccattcgatgatgattccattcgtttccatccgatgatgattccattcgattccgttcaatgattattccattcgagtccattcgatgattccattcgattccattcgatgatgattgcattcgagtccatggattattccattccattccattagatgattccattcgggtccgttcgaagattctcttcgattccattcgaaaattccgtttttttccgtttggtgttgataccattcgattccattcgatgataattccattcgattctatgcgatgattccattcctttccattagaagatgattccattcgagaccattcgatgattgcattcaattcattcgatgacgattccattcaattctgttcaatgattccatcagattccatttgatgatgattccattcgattccatttgatgatgattccatgcgattccattagatgatgacccctttcatttccattcaatgaggattccattcggttccatttgatgatgattcctttgaattccatttgatgacatttccattcaataccaattgatgatggttatttttgattccatttgatgatgattacattcgattccatttgatcataattccattcgattccactcgatgattccattcgattccattcaatgatgattccattcgagttcattgactgttccattccattccattcgatgattccattcgagtccattcgatgattctattcgattgcattcgataattccatgcgattgcattcgataatcccattcgattccatttgaggataattccatttgagtccattcgatgattgttccattcgattctattcggtgattccattcgattccatttgataatgattccaatcgagaccattcgatgattccattcaattccatgcaatcatgatccgtttcgagtccattcaatgactccattccagtccattcgatgattccatctgattccattcaatgaatccattcgattccattctatgacgattccattcatttccatctgatgatgattccattcgattccattcaatgataccattcgattccatttgatgatgatttcaatcaattttattcgatgattccattcgaatctatacgatgatgagtccatccatttcaatttcatgataattccattcgtttcaattcgatggtgtttccattcgattcattcgatgttgattccattagcttccgttggatgatgattccattcgggtccattcgatgatgatcacactggatttcattccataattctattcgattccattcgatgatgattccattcatttccatccgatgatgattccatttgataccgttcaatgattattccattcgagtccattcgatgattccattcgattccattcgatgatgattgcattcgagtccatggattattccattccattccattagatgattccattcgggtccattcgatgattctcttcgattccatacgataattccgtttttttccgtttgatgttgattccattcgattccattcgatgataattccattcgattctatgcgatgattccattccattccatttgaagatgattcaattcgagaccattcgatgattgcattcaattctttcgatgacgattccattcaattccgttcaatgattccattggattccatttgatgttgattccattcgattccattttatgatgattccatgcaattccattagatgatgactcctttcatttccattcgatgatgattccattcatttccatccgatgatgattccattcgattccgttcaatgattattccattcgagtccattcgatgataccattcgattccattcgatgatgattgcattcgagtccatggattattccattccattccattagatgattccattcggtccgttcgaagattctcttcgattccattcgataattccgtttttttcggtttggtgttgataccattcgattccattcgatgataattccattcgattctatgcgatgattccattcctttccattagaagatgattccattcgagaccattcgatgattgcattcaattcattcaatgaccattccattcaattctgttcaatgattccattagattccatttgatgatgattccattcgattacatttgatgatgattccatgcgattccattagatgatgacccctttcatttccattcaatgaggattccattcgtttccatttgatgatgattcctttgaattccatttgatgacaattccattcaataccaattgatgatggttatttttgattccatttgatgatgattacattcgattnccttgtgatcataatccattngaaggccggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtaagcccctaaaggccggtccatggcaataccctatttccaattgaccacttcacctgggaattctaatgggagtcccttgagccctcaggatattccccacagatctgagatgtctccacaaaccatcatgatcttcccagtcagggagaaccaaacgggattaacccaactgcttgtttattgcctactgttcatgagcaaggtacaccaaagtgtctccttctaggagatacatgcagagagaagaaaaacatttgatactcatgatagcctgttaatgccccttgtatagaaatgtgctggctttatgtaagtattgctagggtttgactgtgtcccccaaaagctcatgtgttggaaccttaattcccaacgcagcagtgttgggagatggggcctttaagtggcaactgggtcatgagggctgagccctcaggaatggattaatgtcactgttatgggagtaagttagttcttgcaggagtgaatttgttctcatgaaattaggctgatacaaaaagcaagctcgactcgctcttgcagtctctttcactcacactggctttcctttcccttttccaccaagaggtgaagcagcacaaggtgttcaccagacacggctgcccgagcttggacttcacagcctccagaactgcgagccaaaataaacttctttcctttataaattacccagtctcagatattctattataacaacagaaaatggactaggtgtacagttttacctgtaaataatttggggagctacgtgtccaacattgtcccaagcaaaagagagatggcaccatggtccttaaatttgatggtaagtaaagcaatataaggagccgaaatactgaccccagagcagtgggtcaggtgcaggtggatctcagtggaacatctggggcagccctctgtgccaccctcttctccagcccatctcacaactaaacagggttcagggctttgaatgcttgaaatgtcccacctttagggaaatcaaggataacagaagtaatgggagagatacgacaaggaaaaaccttgaaccagcctctatctcttggtgctttctgaggtttcttgctttcaaagagtcataagacagtccagcatggatgaggcagccacagcctgatagaggctaagacaggactttcagaacctggttccagcacaggaagaaaaaggtgggaggtgggcaggaccctgaatgaggcatttcaggacaggttgatgagctgggccaccccagtgctgagaaggaaaggttaggccaggtgagaccctgggacagatggcccagtagagcaggggcacatggtggggatttactactctgccttcaccccactagtgccatctgcatgtgggcctgtctggttaagtcactctccccagtgctggctcctgggcagaggtgagcagtgccttggggcgccaaggatacccacagatgctgctcagacccttaggacatcccactcagcccaggctgcttcagaaaccagaggcatccttcttccaacatgtgatcaatccatctgaggacaacagcagaggccctggaacatgacacccccaagtcttccctctccaggcctcccaggcccatgagcctgcagagatctctttggcattaaggcagcttgaaggggtctgtcctttcaatggaataagtcctgaccacagaatgcaggcgccaccccccacacacatggtgctgacatgtgcacgtccttattttgagatcatggggccagatctcaatcctagagagcagcctccccaacctcacaacctactgcttccctcttcaaaggcaactgagcacagccaagaaacaccaggcagaggggtagacttgtgcagacaagcacagcccatggccacctgggacgcaccagggtcagagagacccaccgatgccccctacttcagaagaccccaggaaacatggtttttgccaaagaccaagaagcttcagtttgctgtctgttcatcgtcaaggtgggatgctggtctggtaagagacccaccatccagtgtgaactggactctaaactgtgtccctccctccaaggtccccaagtccctgtctcctctgcgaaacctcaggagtcccgtttgagaagaaaggggcccgcagacacctgattctcacgctcggtttgtgcacaggtgccagcctgcaagccggagaggcatgcagagaggaaactgcattgctgtttcaaaacccaaagaaaagaaagtactctgaattgcgtggggatctggagttagggcagcttgccccgaaactgaacagaaagtgttttcacatcaccccctcgccccaggtagcacccagtcacgcggctctcagtggaaagcgcggcacacgaagccaggccgggacccacagcccaggttctgcatttggcatttagcagctgcgatgtctccgagaaccctgcagagacggagcccacagaggagggtacagcgtggaccagaagccaccagaagccgggcgaggcggctgagttcagtgctgtcagccagaggctggggagggagcaccctggtgcccgcatccctggtgagccttgaacccggcatccgggtctccactctaacattcctcgggcctcctggacacataggacccgccagtgcgtgcacaagttgccctctgtggcccagcagcactggggtcacctgcactgtggccatggtatgtgtggagaggttccatccttgggaaagaggtcctgagtgtcctgggagccaggaggaagaatctccagagacaaaccagagaattaaccacaggaccccgcccccttaactccaccccactcacattacccttcccactcacatgacaccttcccactcacatggctcctcttctcccagtggcctcgccccactcacttagccccaccttccttgcacatggctccacctcctttcacttagccccacctccttgtacatggctccacctcctttcacttagccccacctccttgcacatggctccacctcctttcacttagccccacctccttgtacatggctccacctcctttcacttagccccacctccttgcacatggctccacctcctttcgcttagccccaccctccttgcacatggctctacctcctttcacttagccccacctccttgcacatggctccacctcctttcacttagccccacctccttgtacatggctccacctcctttcacttagccccacctccttgcacatggctccacctcctttcacttagccccacctccttgtacatgccccaccctctatcaagtggctccagcctctcttacattcccctgatggtgcagcccacagccccttctcaggcccactctgaccccaggactcttctccaccatcctggatggcagactcaccctgactctccaggatcgtcccgatgcagacactccatgaccactatgggcagggcactagaggcctagcccaactagatgaactgagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacttgtttttgctataatctgagacttccttttttctgagtcactcttactataggtttattaattttattgatattttctccaaagatataacttttggcttcattgatttttctctcttgtgtttctgttgtcaatttcattggcttatcctctttgtctttaatttacttccttcagctttctttgagtttaatttgctcttctttttaaaagttcttaaaatgtaggtttaggttattactatgaagctttattattttctaatataaacatttaatgctatattttttctgtgagcactgatctagctgcattgcacacattttgatatgtttttattttgattaaatttaaaatattttctaattttccttgtgacttcctcttcaacctcttcaacctatgtgttattttgaagtgtgtagtttaattccaaatagttgggaattttccagagagctttctgctgttgatttgtaaatagtttttttatgatcagaaaatattctttgtataattttagttcttttaaatttgttaaaagtttttatgacacccccatatatgttcagtctttgatgaaagtcccatgtgcacttgaaaaaaagtatattcttggtggagtgttctataaatgtcaattacaccaagtcgattgatagttaagattatgtcttctatattcttactactacttttctgtcaacttgttctgtcaattaaagagagaggagtgtgaattctccaattttagtggtggatttacctatgtctacttctagttttattcttttttttatgttttttgagacagagtctcgctctgtaacccaggctggagtgcagtggcatggtctcggctcactgcaagctccgcctcccaggttcacgccgttctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccactgcacccggccctagtttatgaatttttctttaatgatttttgaagntctgttattaggtgcatgtatgtttaggattgttatgtcttcttggaagattagcccttttatcattacataatgtccctctttaccctgggaaatatgcgttactttgaagtctacttagtttaatttagataaaactactctagctttgttgattagtgtttgagtgctgtatcttttcccataatttaacttttatcttatttatatatttatatttaaagtgagtttcttttagactgcatgtagctgggtcgtgtcttttctttaatccagtcctaaaatttctgtttttaattgacatgtttagacaatttatatttcatgtaatcattggtgtggctggattaaaatctaccattttgctagatgtcttctaacttttctatctttntaaaatgttgtctttttctgacttcatttggattgttggatatcttttatgatgctatnttatctctactataaatgattttaaatgtatacctccttttaacttttttgatagtggttgacctaagcttacagtggatttatgtctaaatcattcatgcctgccctcaagtactatgatatcattcccaaattattctaagacattgtacaataaggttcacacctcctcctgcccggttctgtgtgttgttgttgtagtcacatttcacctttgtacagacaccataaacgcaatgcattgctagtattttttcccccggataatgagttatcttctagagcaattaaaattaagacaataataattgcctgtttaccttcacttattccacttccagctgttctatttctttgtgtagatttttgtctagtatcatactcctttaactcttcttgcagttctggtccactggcaatagattcagttaccatttgaaaaagtattctcttttagtcttgaaagattttcattgggcttagaattctgggccactttttttctagactgatactttaagaaattatacaagtaatatatcaatatattattttgttcaaaagtaaaacattatagaaaagcaagtgttccctttgatctttacctcttatcctgatctccacccctttccccagtaataaccacggtgggagggttttttatgtgttttttcaataatttatatataatttatatttataatcataggaaatatatggtgttgcttaattcaatgtgtcttccatccttcctccaccttttgtttctgtgttttgcctgtgtggacacacatgttttttaccgtatttatgcatgttacattttatgtatgcatgactgaacatttttctgtttagatgcagacttcctgggtcatagggccgaacatatctttattgctattgatactgctttatttggcttccatagggggttgatttgtgcgcaaactgcaagcctgactgtttggagggaagtgaaggcctgagaaggtgatgttagttgctacccgtggtggaatccctactctgccgccccccgtccttccacccctctcgtccgcggcgttcgtctgctgcgcctctccttgtggccccccattacctcttcccttgctgtccctgtgccgccagagcttagtagtctctgtgtctgcttggggtcatgcaccgccccgtaggtgtgcgccctacctccctttttgtccttttcccattctccgttgtgccttgcgcgaccgacgtaccagtatgtccgttcggcctccagtgtccagtatgcgtcgtctgtgcgacccgagcggcgtgttcgtccgtgtaatggcgggcagtcggcgtgccgccgtcgcggcagcagttttgatatctgctcgcctattctcctccgcccctccccgttacgcacgttgccgcttcccttcctttcttccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttggtaacagctcttccttgttgaagaagccacaccccacatacactgaaggccgccatggggtgggtatgtagttacagtccccctatctgcacaaaaccccaggatacccatgaaaccagcatcacgggttgcctgtttggagggagggtggaaaccagggaatgcaaaaacatacataggcagacacatttatgcatagattcttaagcttttcctgtaaattttgtgttgccaattcaaaaatcagattctttaaattttagttttaaacaattataaattaaaaggaaataatatgaaacccatttcctgtgaatgacggagcagtgtccttggggtcaggtggaatagaaactcagccatgcagtgttccagtgattcaggggatggagaaaccatgaagcctgggacccatgagagggatgcctggagatgctggagaggatctcgagcaacttgagtgagtgcagagttcccatcaaccaacaccccacctgagctcagggtcccatcacaaccaacccaaccaacaccccacctgagctcagggtcccatcacaaccaacccaaccaacaccccacctgagctcagaatcccatcacaaccaacataatcaacaccccacctgagctcagaatcccatcacaaccaacacagtcaaacaccccacctgagctcagaatcccatcacaaccaacacaaccaacaccccacctgagctcagagtcccatcacaaccaacccaaccaacaccccacctgagctcagagtcccatcacaaccaacacaaccaacacctcacctgagctcagggttccatcacaaccaacacaaccaacaccccacctcaccgaanaatcccatcacaaccaacacaaccaacaccccacctccacctcacactcccatcacaaccaacacaatcaacaccccacctgacctcacactcccataacaaccaacccaactaacaccccaccttacatcatactcccatcacaaccaacccaaccaataccccatactcactcactttcccatcacaaccaacccaaccaacacctcatctcacctcactttcccatcacaaccaacccaaccatcatctcatctcacctcactctccatcataaccacacccacatcacctcacatccctatcatcactcctcctttccctctcccccctatacatccttcttctctcctccatcctctcattttacactcacatatccccaatcactttttcccacacttctcttcatatccacccttctcctcctcaccttcctttaccctcctttctcacattaacaccaccacccttcactttacccttcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgccgggcctcgtaatcccccaccttagcctcccaagtgctgtgaattacaggtgtgagccaccgcacacagcctaaacttttttaataaataaaaaaatagagaaacatttttcaccactgtggagatgcaacaatttctactcccaaaattgaaatcaaaggaaaagaatttagcatttattctgccttttttattaaagaactgtaatttatcacatgagagaaagccctcatttactgaagaatgcctacatcttgccattcccaaagaaataactattccaggctcagttcatcagcagatgttaaaacttttaggctaaagattattgaggaatggaatagctgcaggtaccaaagtctcacccccaatagccccattccttctattggagaatgggttttaccagatagccagagttacctcaccggttaaaacctattttttatgcctaagcaaagagcgaatttaaactaagcttatacaagcacttctgtccaatcttcaggattactttcagcataaacaaggcagatatcgcctttatgacgaatgagatagaaggaacactgtgaaaatgtggaggcaatcttgacaaaactaaacgcttgtgcctggaatcaaaaaaggtaggatgcaatggcttcacagacccaaactgcaagtaagctggtaggcttagataagagaccagactgtcaattatgagcttagcaggacttatttttgcagtccaaatggctcagagaatatgtcacatattagttacccactgtgaaagaagggcggctgtttattctttgtattgtgggagcgataacgatagtggttacaagagcatagncaaccaagaaaagtctctcctctgactcaaatccccacaaaacctcaggtgggcacagaaggaattgactatgggtaaaacagaacagtgccccacgcagggtaaccacgaagcattttaagcttctttgatcctatttgttccccccaaaaagacctctggccccaggaaagacctgggcctttttccccttttggaacccccaaattcctaagcagataaagctgggccttttggaacagtgtctattttttctccaattgccaaggaccccgaaatttgttgttttccccggtcccgttacccccggagaaaaagagtttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaggcagccattcctttccagattatcataggattaccacatgatccaccaattatgctgtctgggcacataaccaaaagaactgaaagtagggtcttaagcatatatttgtatacccactttcatagcagcattgttcacattatctctaaggcggatgctacccaaggactatggacagatgaataaacaatatgtggcctatacataaagcggaatattattcagtcttaacaagaaatgacttgtcacatgctacataatgcatgaaccttaaagacattatgctaagtgatataagccagtcagaaaaggacagatactgtgtgaatccacttctatgagatagctagaggattcaacttcgtagacaataacagtagttaccagggactaggggcaaggataaatggagaattattatttaatgggtacagatttttagttttgcaagatgaaaacagttctagagatgcatggtgatgatgggtacacaacaatgtgaatgtaattaacgtcactgaacacttaaaaatagttaaggtggcaaatgttatgtgtattcaccacaatcccaaaaagctacctcaaagacaaaaaaaatctttcaaaatgtcaattggattgaggaatgtgcaatgaggaggtctttggcagttctagataagtgctgaggacagaaggcagagtggactagattacagagtgaatgggaaagtggagacagcaaacgcagaccatttccaacaagtttggataaggagataaaggtaccgactggatgattgctaataaagaggattcacatttaagggagagctttgagggttttcgctttattttatttgataatgataacaggcatgattgatcgtgagcatgcctctctaggacagaaggaaagaaactggtaaaatgggaaaagttgatgctataggccctaaactggatgaattcaagtagacggagtataggagactcaggcctttccttctgaaagatgtattatgactgtattaatccagagcataattcagaaatccccaggaagaacttgttaaagaaggaaatatccaggcattgggatcaagtaacaacccaggacagaaacagaatgttgtnaaaccagggttatganncccctacagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaccctgcactaagggacaagtgcactcactatctaaatcagattgaatctttggcattgacattctttctacacaatgctcccactacactttaataactgtctttgggcctcataaatctcattctgccatgttctttaattatgttaccaaagtctccaaagtgacagtagactttgtaggctaaaacatttcagaccacttcattctcatatatctggatttgtgaaacaaggcaaaatttcactgaagaaaatttcaagacttacactattacagtataccccccctcttttttttttttttttttttttttttttttggaaactgagtcttgctctgtcacccaggctggagtgcaatggggggatctcggctcactgcaacctccgcctcccaggttcaagcaattctcctgcctcagcctcccaagtaactaggattacaggtgtatgccaccacacctggctaatttttttatttttagtagaggcagggtttcatcatgttggccaggctggtctcaatctcctgacctcgtgatccacccacctcggcctcccaaagtgctgggattacaggcttgagccaccgtgcccggccacagtattcctttttaaaaagtttagctatatatatgaatctttcttaaatgtgatctctattatctatgaagcattgtttatattcctaaagcctcaaggttaacataatgacaactttcacagcagaaattcagtgataataccagaagtaactatcaatgagcagggctccacaaacagacacctacacaaactggctcaccagactgcctgcttatccagtaatccagttaatcatcatccagaagtcctgttcatcttttaatttttttctgttgcctatctctcctctttaatggactggcatgagctggtaagaaacagtgaatcatctgagaagtgggccggggaaggagggttgctgagcacactaaaagcttcttttctgattctttggttcttatttattttacatttctggaaaaatccgcctgagaaataaacgatttcccttctttgggaaagattgaagtttctgtagggcccctggtgagggctctaatcttctcatcctggcctangatttggggaggggcctggggggatttccggaggcccaaggaggcccgccttttttaaggagtttgcccggttttcatcccaccataattccggccttttgggtctcatattatttgggctttcttgccctataaaaaggttttttcccccttctttgagctttaccggctcgggcggcccccgaaaaggcgcctgctctaaaactctaccccgaaaaaagtgtgtctcccttccccccgtgttaaaaaaaaaactttagggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgctgtaggtatcactacttctagtttgtatctcttgctcaataagacctatgggtaatacggtagaaacctcctaactagtattaacagttggtcagttttagccaggcatgatggctcatgtctgtaatcccagcactttgggaggccgaggcaggcagatcacttgagatcaggagttcaagaccagcctggccaacgtggtaaaaccctgtctctactaaaaatacaaattttagccagatgtggtggcacacacctgtaatcccagctacttgggaggctgaggcaggaaaattgcttgaacccgggaggtggnnaggttgtggtgacccgagattgcgccactgcacttcagcctgggagaaaaagcgagactccatcttaaaaaaacaaacaaacgaaaaagggctgggcacggtggctcacacctgtaatcccagcactttgggaggccgaggcaggtggatcacgaggtcaggagttcgagaccagcctagccaacatagtgaaaccccgtctctaataaaaatacaaaaaattagccgggcttggtggcgggcgcctgtaatcccagctacttgggaggctgaggcaggagaattgcttgaacccaggaggcggaggttgcagtgagccgagattgcgccgctgcactccagcctgggtgacaaagctagactccctctcaaaaaaaaaaaaaaaaaggaatgtaaatagaacanttgtttctcatttgtaaccttttagggttttttttatatatatattttgagttggatgttaaaatacttttgtggatttaaaaactcgcatactaatgaaaagaaatcagacatgcaggtgaatttatatttcctttcccttctccagagaaacatgttaatgggttgtgtatcattccagatctctctttatgtgcccacatgtatataaataattgacagttcgttaaacgtatccctgaaatattacttatgcagacgngaaagagcatagaaacattttctgcagataagcctattgactaaacacgatgatagttctgactttcttcaatcttggaacattttttacgttccaaccgcaattatgtatatggaattgatgaccctctttttccaccttgggaaaacatacgtagcatttaccattaaaccctttttaagtgtacagggcgttggcattagggacctttgaatggggggcgcaaaaatttaccatgggccgatgcaactcccaaaacttttttttttttttttagggagcgcctccgggaaaaattttctcttccacaaacccaaattaaaaggggggggtttgtctcggtgcccaacctgggggtgccgaggggggaaattttcctcaacaagaaaccctggcgttttggggtggaagccttttttttggcctaacccccccgaaaattgggttgaacccccctcaaaaccgcgcaaattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaatttagtatacaataaagattacattactaatcaccaggacaaaaatgtactttaaatgacactttaggacagctggaaaaacattaattagctccatatctcacaccatgtataagcataaacttcaggccaggtgtggtggctcacacctgtaatcccagcaagttgggaggccaatgtttgcaaatcacttgaggtcaggagttcgaggccaggctggccaacatggtgaaactccatctctactaaaaatacaaaaaaattagctgggtatggtgatgagtgcctgtagtcccagctactcaggatgctgaggcatgagaatcacttgaacctaggaggtggaggctgctgtgagccgagattgtgccactgcaatccggcctgggtgaaagggtgagactttgtctcaaaaaaaaaagtataaacttcaaaaatcagagatcttatgtaaaagagaaaccatattaagtgccaaacgagcccgtgcactgtggctcacgcctgtaatcccaacactttggaaagccgaggcgggtggatcacctgaagtcaggagtttgagaccagcctggccaacatgatgaaaccgcatctctactaaaaatacaaaaaattagctgggcgtgggggcaggtgcctgtaaccccgggctactcggaggctgaggcaagttctccttgaatctgggaggcagaggttgcagtgagccgagatcgcgccactgcactctagcctgggtggcagagtgagactccatctcaaaaaaaacaaaaaacaaaaaacaaaaaaacaaaaaaaaccatgaaaaaaaaacatagaaccagctcttctatccacctttcatacaatgagcactgcattttgctggtctgtcaataagaataacatgtcagttggatttttaaaaatcgatggaaattaagagagttcaaatttactattcttcttatctatgtacccatatgaatttgaaagtattagccaagctgaaattatctccagatttcaattaaggcttgccctggacactaatatattatatggcttctggtttctttaactgaaccacttctccacacagcccaccttccccatggtcaacagaacaaattacctttccagactctgagagaagcaaactctgaggggcgccacgttccacgagacgaaccctgcagaagaacggtatttactatatatagggcttttaagaggagaagtcgccatgttcctgcagctcggtgctgccttccgtcaacctcctaaatgtntgctgcgcagttaccgacagttgcgtncaaaaacngaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcctatagactaattgtttattgactcattaactaaggtggtgattcttattttgcttcaacagggtaagtattttattttagtcatggttgccactttctgctaacttcattggggatatttatcagaaattaactgcatcattgtattaaagaactcccagagtctgaaatgtgatgctttgataggattcttgttaaaattccaacagattttctatagattcactgaatttattttttatttttatttttatttttgagatggagtctcactctgtcatccaggctggagtgcagtggtgtgatcttggctcactgcaacctctggctcctgggttcaagtgattctcatgcctcagcctcccgagtaggtgggattataagcgcatgccaggctaattttgtattttttttttttagtagagacaggtttcactatgttggccaggctggtctcgaactcctgatttcaggtgatccgcccgccttggcctcccagagtgctgggattacagatgtgagccaccacacccatctcatgtcttcagggcagattcactggtggggagttggagctctggcccatagcagggtctcgggacctccagcctcagagtgctgaccagcttagcctggagcagccgatgagtgggactcgggatagagggccacccttgctccagccccagccccagagccacattccattggccattgtgacacccaaccaggaagcatcaggacggggcttctctcgggaagacagggaggcacacacccttcgctgttaagagtgtgggcacacgttctggtcagccaggggcagggatgggaagacgaggctttctgggagcagcaggcagtcactgggctgttgctccctgctggaagttgcaggaggtggggaggagacccatgctagtgcctgaacccctgctgggaagcctgttgtgagcacagcctctgcccccgccccaccagagcttgggtggcaccccacccgagcgctattgtatggccctgcctgtctctgatggaaatcagcctgatgaactagctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtttttgcattactgaaggaaaggaactagctcagaagtcagcctaacacccacagagattaaaacgtctcttccttcctctttgtttccacgtcccagtcttcaataaattctatctgacaacagcagcagagggacccactatcttgtggtttctgtcaagttcctgattttcatccgtagttgaagatgagcaagaactctgtaacagtgttaccttggagcctacaatgagaggtatttcaaaatgagtgaagcatgactctcacagatgaaggcctagacgcaggtaagaaaacagcttttccatgaaatgacttgcatgtatgtgaatggtgcatgggaacagaaaagatttctgagctgggcagcaacaaagctgaggaacactgaaccattgccactcacatttttctcagtaggttactttttgtttgacaactataattggtatattaatatatttccccatgctaatatggggatccaatactgaaatattatcatttatgatttaggatttccaatcgtggctgtcaaaatatatctgtgatgaagagatatcaaggaaaatgtttaaaaggtattcatccaggacaaacatttcaaaagctcgtaaatgtgtattaaaattgcttctcaaaactacaaaatcgattagcataatacttttttcagtatgtctttgtttgcaattgcatatgtgtacagatatatagttgcatttacttgtacatacacttatataggtaaaagtttttatctttgtcattattaggataagttaaccccattaacacctactaaaataaaatgcctttaaattgtaaatcacagaaatatctgtcctaggcatagcaaatatttgagttcatatgctacttatttatagtctatgactaatcagctaaattacttacaattccttaaaccttataaattaaattacctctcggagaattagcacagacccccaatgtccgcctatttcaccaagcccatgcaatccatcttggctacatatactctgttacccaggacaatccatcctaccggggaaatgaatcccagatcacactatttcaaaaatanttagtttggtattcatccttctaaacacttccacctggtattcaggtttagccctcnccaaaaccctaccctctaacttaaaagaaaacaatgcccccggaaaatccccaatggcctattttggatttgtaacctccctgaatttatttttcgggaaatttttgattcttttttttcccccggctcccattggggcccccctttaccccctgcgctttttggaggaccccttttggcttgccggggncacaaaaaccggccccccctggaggccaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaactctgttaaaagtaattgcaacctggtatattttttttgtttacaaggctaggttacgcctattgtatttattgtgggaatttttaaaccttttgcttctttggaatttttagtttctgttgttaaagacctgtaccatatcactgcatcatataatcagtgaaatgggtcatgagcatttgacttatgtggcagccatggacatgggcctctcatgtctcctactgtggggagcatgatggacaggtagctcctgctgtggatccaccaccacattcttgctgctgccacgcttcccgcggactgctccaggcctgtgattgagcatggcagggacaccaagacaaacctgtttttgtaagaggaggggtttctctgacaaaggactttggctggaggagtacttaccagtcttcaaaccttttctttgaactttcttcaaactgcactgttcctactcaatcttccttccttctttctcccacaagtggttggaaggctgtgccagccttctgcttgtccccattttccctggtagccattttccccagtaaatctcttggccatttaagcacattttatcatcattatttttggggaacctgaactaatggaattaatttatagattcaccttttggaggtaaggttagaaggaagatcatttctcaatttttacttccctgtaattaataatatttactatagttataattatgttttggaatggttttgttatagagataacaccatgaatttaagccctcactgccctgcacacaggcagnttagtgtctgttttggttcccttctttgaggagagaaaacaggaagttttgatgattaaaatccaaaaacagattcctaaattgctgcttgacatctaagtgcaggctcttcctaaatctttcccttttattccctaccatgaanggttntaaaaaactggtttccctgacctaactattctttacccagcttagaatttatatctgggacttcccctgtttgagacccatagtattacctagcctttacaggtaaaatggcctgattcagaagccctctattaaactgctgcccagttgaaaaattcccttgaccagaaaatttcaacccattttgaattaaaggaccgggggaaaacctgggcgggtttggcctcaaaaaaccaaacaagatcagggcggtgggaacctcttaaaagggggccttaacccagaaaaaaaaccggggggaattattcccccctaaaggattaacagacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaagngcatgcggtgnacaaaccnncttgaggnacttttaaaaacatctcgtttctttttagtcactgtttttcatgctttttttcccccatttgtttgtttatggtccatttcttatgaacttatgactaacacattatcttttttttttttttttttttgagacagagtcttgctctgtcacccaggctggagtgcagtggtgcaatctcagctcttttttttatccgtctcccaggttcacgccgttctcctgcctcagcctcccgagtagctgggactacaggcacccaccaccacgcccagctaaatttttgtatttttagtagagatggggtttcaccgtgttagccaggatggtttcgatctcctgacctcgtgatccacctgcctcggcctcccacagtgctgggattacagatgtgagccaccgtgcccggccatgactaacacattttcaaagcacagaacacattgttaaaactttttagttactttccaggagaatgttctttggagaacatctcccttttcctagccatgtgattttttttttttttttttaaaacaggggcgtcttacgttgtcccggctgtagggcaggggttattcagagggctaaatattagcttgcgtgcagccccaaactcctttggttaagcaatcctggtgcattagcctcctgaataactaggactacagggggccaaaatttggccccacccttggggaattttccttgggcccagtttttctggaaaatatttacccgcgaaatttttatatatattaccgggtggcctcccgcggctctttattctgtggaaaaattttaattcctttgtcncacggaacaggaagaggaatctttaaccacgcgtgttgggcggcgganaaccccgggggagaaaccgcggttttgtttggcccccaccttgttggggggggaaaaaaacactcttttaaaaaaaccaaaaggggactcctttgggggaacaaa

SEQ ID NO: 710 - DNA, 193608 bp, Homo sapiens
  misc_feature (1)...(193608): n = A,T,C or G
aaaacggcgctgggggtatacgaaaaaagtgggcactgcgtggccagggccttggagacggaagaatcccccttccaggttcatgatgccccagggagagaggaggggcagtcacaggggagcccatcagtatccctgaggatgagagggaactttgaagaaatggggcccccgtcccctcaggagaatggctgcggtttcttgttcttgtttctggttattgcagaatcatgcagttaggggtaggagagccccactactccttctcccatggataaacctttttccttcaactcctgggcctggcctcccatatttgagaagaccttcaggctgttgacctctgacccctgggaatcacagccatgcccgtgggcttccctgcagcaggtgccacgatgtcccctgggtgtgtgcctccatcttggcttcccctgaccctcatgggctctcctgcactgngcttgaggaactcaaggtggagactntggtgaactcacaccgactctgcccagagcccactccctatcgctgcctgtcaacacccagggcacctgggacgctgtgggcgaacaggggcctcccgggggcccgaggctgcccagtgctgcccatctctgctccaccaggtgggagctgaggtcacaggcatcttctgccagcagaaggggccttgtgggaggggtaggcactcatcagtcacctgccgagtatgtttggcaaaacaagttcctcaacaggcgggtgctgccagtgcattcccaccgcagcattctcggcaatggaaacaaacatctccacctgcagaccgacgggccaagagctactcccattaatcgcatagccgcggtgggtgaagggaactcagtttctaggccacattccccacgctaagtgtgtgacactccagtttccgcatgacattattagcaaattgtccatgaaatgatgtttctgctttcagataagtttggaaaaagctccattctctgcaccccttaaaagactttttggatgaatataaagccacttaagagttctgaggattctgcaggtaaaataaacccccctgttcagctatgttcaacttggcatctcttaaactctttggaggaggaagggaagagacccaatgacagcaatagagatgtggtttaagaagtgctgttttagaggaagtgagatgtttcagaaactaagaataaaaccaaatacaggacacactgacattatactggatatgcaatctttctaagacaactgaaaagtcttgtctctcacactgatctctgcctagagatggaagtaagggtcagttacaagagttttgggcctcagcagagggaatggttcttggaaacgaacgtccagctcttcagcagttaccaaactgaattcagttaaaaaccaatggaggccagacacagtggctcacgcctgtaatcactttgggaggccgaggcgggcagatcacctgaggcgaggagtttgagaccagtctggccaacatggtgaaatcccgtctctcctaaaaatacaaaaattagccagacatgatggcccacacctgtaatcccagctactcaggaggctgaggcaggagaatcacttgaacccgggaggtgaaggttgcagtgagccgaaatcgtgccacttgcactccagcctgggcgacagagccagactccatctcaaaaaaaaaaaaaaaaaaaaaaaaaagaaagaaagaaaaagaaaaaaaataaaagaaagaaaagaagaaaaatcagtggaaacactgctagtaaaggaaagaaagcagtggtgtccaaaagcctgcctggcccactgccctgggaagccccccaagagatgcaccccacacaggtctccaccccacaaagccctggctcctccccacccctgatcatctctgctctacccaagtcatctcatgtcccaccagagggatgcatatcactctcggacaccatagctgcatttcatggggcatcgtctctcccccagggacacgggaagccctgaggatgcattagggaagcttttcctacctcatctcgcagctctaagaacagcagtgagcagtactgggaacaatggtaaccagaggtatttgctgaaggcgtcaggggagaaagagccctcacatctacccatctgactctgccactgattcaacagacagatttcctaaatctacatcactgattaatatcttttaaattgagaaaataaagctttagctcatctatttgcaaatgcagtgaggttccagtgggctgacatgagagttcgctgcacactgggctgcagttggtcagccaactctctaaaacatcttaatctccgttcttggccacccattctactgggagtttctgacaaatgggagtctagccctagccccagacccacacctacccacttatgccttaagccttccaaccatattatcgatcaaccttatcgccaaccaaccatgccatcaaccaacccattatcaatcaacccaccatcaaccaacccatcatcaatcaaccttaccattaaccaagcctaccatcaaccaaccttacgttcaaacaatgcatcatcagctaatctgactataaaccaactccaccatcaaccaaccttaacatcaaccaacccatcatcaaccaactccaccatcaactgaccttaccaacaaccaacccatcatcaaccaacttcaccatcaaccaacctgaacatcaaccaaaccgaccatgaaccaaccttgccatcaaccaacccatcatcaaccaatctaccagccaattccaccatcagccaaacccaccatcaaccaaccttaccttcaagtaatccactatcaaccaactctaccatcaactgacgcatcatcaaccaaactcatcataaactcaccttcaaccaacccactaccaactaacctaaccattaaccaacccattaaccaaatgcatcataaaccaacctatcaatcaacctgattatcaatcaaacccatcatcaaccaacccatcatcaaccaactttatcttcagccaatcctaccctcaaccaacctactgtcaaccaaccctatcttcaaccaaacttaccaccagcaaacctcaccatcaaccaaccccaccatgaaccaaccccaccatcaatcaagtctctttatcatgtacttttatcaaacccacccaaagccagcatcatgccaggcacaatggggagtactaaaaagaaagacatatggctcttcccttgaactgagctaatagcctgaccaggcagccttgaaatgattgtaagaaacataaggccagacatattggagggtcacatggtacatggtgcttgagttataaggtgagcccataggtaaaaatgatagatgatcaaaatgacctttgaaaactcctgagatctcccataaactggagtctccatggcttctgcatgtaacgttatacattcttcttccacacaatggtctgaataatgaggccgacttcaggagggatcaagaagaaatggcatgcacacgtcagggtctgcaaacctcactgcttcaacacagctttcaagtccacagagtggactgaggcagaaggtgacaatctaggtgatcctgatagtggctcactgccttctctttactacagggactttctagttgtaacacacattcagccatggatttgtcattgtattacttaaccctgcaacctgtgttaaatgttgactccaccacgacctgcacacagccttaggaaactggaagggagggagggtgatctgaaggagggggagagaaatactgagtgggcgttaggagggagagggcttcacacaggcctcaatgcttgggcaggaacctgacagacaggacaggagacagccttctagaccagagtgatgtgagctctgacggtaagttccatgaagacaggtcgactgtcttgtttaattctgaatccccggggcccgacagaggatctggcaaactctaggcatcatggagaatcacagaagagtggttggaaatgacagaaacgaggcacctgctgcttgaaggcatcgactcctcagagcaagcctgtgagtggacagcatggtttccctttacagatgaggacactgaggcagccgcagtaaatgactgcccaccaccatgcagctggcgagaggcagggctggggctgacccgtgatggcccctgctacagcagcaagcatgtattcagcacctactgtgcaccatgcacggaagtctcattgcagtggggaagcgggtgatgaacaaagacgtggatgtgtaaacgtgaataaatacctaaggctgccagtgtcgtgttgatgaggctgtgatggaaacacacaggggcggtggcggaggtgactgcagagggaagagggatggtggccctcacacggccatgatctgagaaaggccctgacccaggcccttccctctcccttggagcacccacctccgagtcctgctggcttctcaccactggccatctgtcccaatcctctttctgatggatttctagagcctctgccttgatctcttcagcctcctgggcttccctggtctccccacagcaccagccccatcctctaccatgtccctcctggcttgggttccgctgtacactggagcctcgtccctcatggctcaccccctccatagcgcctgagtctcagactcaaacccccattcccccaccatggcttctgaggccccgcatgctccagccccagcccgtgcctctgacctgcctccatccaccctctcccttcatcatgggaaagcaagaccctccccgctcgggattggacttggggagctggttatgaaggtgagggaagccctgaaaaagcagagaaggcagtgaggcagcccagacagcagccactgcgggagaaggaagtgaggcccagacagcggccaccgcgggaggacagtgggagaggggacagcagcagagccaggccgggccaccagcagaaactggaaccagaccagcctgcccaggtgaggctggcgcgggggtgcaggggagggtctgcatgcaggcgctggagccacagggggacgcccatgccagcaggagcccaggcaggaggctggccccttcgcccaccccagcagcaccatctctccttggttggacttggcaggaagccaagcgtagggcagagagcagggtgagcagaggatgggctcccgggcacaagagcaggaactccgggctaggtccacactccacccccacaccagcccttgaaccaaccatctgctccccaacctttgacgcccaccctgtcccggccaggctggctcctgcctgtctctggtctctccgcggctggcatccaggctctcacggggcctgtctcccctcagggcagccctcagcccctggctgggctgcactcctgcccttggctcctggacagcacgagtgaccaggccctggcggatctgtgactccaggcatccctggtttggcggccatccctggccgtaggcagccgtagcatgtgccagcagcatgcagccagcctcccccgggctgggtccagttgctggcacatttcacgtccactgatggaaatgaaccgacagcccggggacaggtagaaatgagctgcttggccacttgaggggtgctgcaggacgggagaggactggccacaggcaggagatcttccccgaggacccagctgggctgctgtgtgtttgaacagatgctgggactggcctgcctcgggtcacagtgaccttgttgaaagtgtcagctggggggaccatcaccctcttgttttccagaccaggaaccctgggggctcctgctgtctcccctggccgcacagcttgtgcatcagtctggggccatctgggaaaacagaaaccactccagcctttcaaagagtggaacatttgactcagggaattgctaaccctcgggaggggagagaaagggggacctcataggggtagtgaggtggcccaggaatgagcctcgccacaaatccccccgtggaagccagatccatagactgtccagcagggctgcagccacagcagaggcgtggccactgcccaaaaagccacgtgtaggggcgagagaagagctgctgggcctcctcccctcccatcacctgccccaagtgacagacctgcaactcagcacagtggtcggccgtgggaggcagagccgggcagcaggaggcaggtggatctcagagcagaacccaggactcaacatgactgggaactcagggctgagtccccactgtgccccagacgatggctgctttaaacagttgtggcgatgtaaacctggactggcagtgccccacgggaacccatcctcacagatggaggcgggatataaaactggaccggcagtgccccacgggaacccatcctcacagatggaggcgggatgtaaacctggaccagcagtgccccacgggaacccatcctcacagatggaggcgggatgtgtgcataggatgctggttatttgctgcggccaaagaccaccatgacttcagtgtccacccgcgggagagctatgcagtggttaacacgggagatgtggctctgtgtaccctgagaaggagcaacctccaagatacgtgcatacattttttaaagtgtgctatcttgccaggcatggtggtgcacacctctagtctcagctgcttgggaggctgaggtaggaggatctctggagcccaggaggtcaaggctgcagtgagccaaggtggcgccactgactccagcctggaccacagcgtgcaaccttgtctctaacacaaataaattgtaaataaaaataaagggtgcagtctttatgcttcactaccctttgtttaaaggaaggtttgcatccattgaggtacagaaaattttaaaaacaaacaaaaaaagaacaaagagcaaagcggggccccaggctcagcaactgcgtctggaatgacagaaaagcaagcgcgtgtctaggccgctgctctgggcagggccgggaggcaggaatggtggccgtgaccctaagccgctgctctgggcagggctgggaggcgggaacggtggccgtgaccgtcagtttccacactctgccttctgtgttcttgcattttcccacatgcgtgtatcatctttacaaacaattcaacctacagaacccctctgtctcctgacaccccagcttcctgtatgtcccaaaaagaaccctcgagctcctgtcccactcctaacacgggggctggcggcttctcaaagacggcccacatccccactctaattcccaagattcaacacactcatgacaaaaaatacgtgttgaccagaaacctggcctgcttcagacgtcaagccctgaccacagccttgcagcccacagctgccccgcaaagcgacccgatccctcggccgggctatgcgtccatctgccctgggaacgtccagtctggcccctgaccatgttcccagtcctggtcacccggcccaccctcagccccacagagtaagaccccaattctgagggtagccccgaaagaagatcccccaagacaggaccaccccagaggctgctgcagctccctctgcagagcggctccagcccagcacactccagagcagacacttcttcaggagaattagggaataaatgaagcaacatatgcttctcctctaaaaggagcagcctgggtctggttggaggaggcaacggcaattgaatttgtcaagaggggcaggggtggaaccctcagaaccttgaagctacgtctccctgcccccaggactgcaaggtgcccaggcagggctggggctgagctgacagcaaagctgagtcccggcagcaactggctgctgctccacctcgaagtgcaggtttttacctcttaggcccatttcccaatgtcccaggtggccagcagcctgagagtcggggggactgaagggagagatgggggtggcaggtgtcagccctgttcccagggctcactcagctctccactcagagaggcacaggccacagggtacaggggagggccctgggggctgagagggggcgtctcgagggagactggaggggcatgggaaggggtgggtagggcaggagacgggagggggtggaaggacgcatgcccctgcgcctcccccgggtgagctcccagctcccatccccagcccagctctcagcagcccaggacagggctcaggaaaactcatctgtaaggcggggcgggaacagcgtgcacccgtgcacctggagggcttgctggtggaatggtaaggagcccatgcagaaggacccagcaggctttgcccaccaccctctccttctggaagaactgcacaggctgggaaatcagaagggatggtgacaattttctgggtctctaagaggatggtactgaggatgcatgccctccccactcagccagaagacactggtgaaccacagtattgcttggggagtcgggggggcgctgctgaacaaaccaacttccttgttactcctgggcaaggcaggaccctcttctgcctccaggattagaggggtccagggatgggtggaggggcctctccttggagcccctccagcctccacagttacccccacccccatcaacagggcaatagaccgtcctgccccggtgcccacagccacaggactgaaccttccttatgaagagtgaatggaaggagacttgtggccatgaacgggtcaatgctgggatggctgcagtcccaggtgcagtagccaggcctgctccaccccaccccactcccactccactctcaggggtcctcagggccaggacatccctagggacctcatactcatggctcactgtgacttcactctgtcaggcagtgtttggggctgggtgctgaggctgggtactgaggctgtgtactgagactgggtgctcagggctgggtaccgaggctgggtgctcagggctgggtgctgagactgggtgctcagggctgggtgccgaggctgggtgctgaggctggggactgaggctgggtgctgacgctgggtgctgaggctgggtgctcagggctgggtgctgaggctgggtgctcagggctgggtgctgaggctgggtgctgctgaggctgggtgcttgggcctgagctgtgcttacttctgcctcctcatcaccaccacagctccacaaggaaagggtcccacccatgtcacagcggggaaactgaggctcagagcaggcacctgcccaaggccacctggcacatcactgggagggacctgtgtgtccagctggctgggaggcagaggggccactactaaccccagctgcatgcaggaggtgttattgggaggtggtctggctaacattcacacagagaccccgtggagggagcctgtttctgacttgagctgtacatgctgcggctgccggcactgcagttggcacagtcccgcctgtgacacaccctcgggaccgcaaatacagctcagagtggttctcacagctcccagcaacaccgtgtaattcaggcccctgccactgcccgccctgtgcccttccctggagccagggcccatctgagaggctcaaggctgcacctggctgggtaaccgcggggcacggggcctagaaccatgggtctgggcggaggctgcactgccgttcctgcctcaggaaggcgtggtgtgcccccacggtgcccttcctttcccacccatagctagatttagaaatgcccagaaaagcctgcagttggtttcaggacacggactcctctgactcagaaactacaacctcaaatgcctcctgagaggcagggcatcagctcaggaggccagtgggggcctgcagacataaccaccaggtgggactgtgctgccaaaacaagcatcctccctcccacagttctaacccaagtccttctcagtgcatatgtcactttcccaccaagacaagagcaggaagcatttcactgtctcctaaaagcagaagagcgatgcgaacgtgatgaggaggggcagctgcttgtggtacggggaggccatggggaccggggggccctggggacctcgccctgagtgcaggggtggtagccactcgcctccagcatcgtttccagccagagggggaagcccagcgtggccacatcttcctcttcttgttttatttaaaaaaaaaaaaaaagaaatcccaaattttagataaaatgtctgtgttttggaatactgacaaccaatttttaaaaatttaagcctctgtgggctaggagaagcccagtcactggccagagtcagccttcagaccacggttcatgaccgtcctattgaaatgctttttccctgtgaccaccaggccccaggagcgggtgctcggggactggcattcccaggtgctcctgtactggcacagggctcctgcaccccccaggtcagagccaccccaaggcaggtgcccatgcctgggacgcttcccatgcctgaagcctgggaagtggccgcctgggaggaagtggccacctgcaggaagaaagagcgcaccgtggcgggccctgggactcctcccaacctcccacacgctcctcgaccactgcccttcccactgggtgcagccttggcaggactgtctatcaatatcgggggctctcccaccttagacaaccagaccacctccctggcctgcacaccctgagcggggaacacaagcgccaggagtaggtgcagctgaattttccctaaggccaggcccaaatgccttccacggcaccagtccccatgcccagcaccttcattgggtgtgtggcttcagcaagaaacgctgagtagtgcacgcctgagccctcctctcggtccctggctgagccagcccacacctgcatccacccctgtgttaacctcaggtcctcactccctcgcaccctgccagccagtccttagggaggacagaaagttgagctcccacctacctgcggcagtacagaccagttgtgccagcatgactgggatccaccgactaaaccagcacgcatgtggcattctggcctccaaggagaacacatctctttccctaagttcctctcctcttgtggaacagactcactcctccataccctcattcatacagcaaacacaggcatgggcgtgtctcagcacccggacatcaggaaggcgcagtgaacatgaaacaccacccctgggtagcaggcctcagaaacacctctgccagcaggctgactttactcatttgatcatatcacacaattccacacaaatacacacctgggtcagagcccacaggctggtgtttacagtcctttctctccccagctcctgccactgcctcacctctgtggccccctcctcgccccggcccactaacaaccttgaatgcactgcccgtgcctttctgataatcacataccaagatacaaatgttgcatatttaaacacatatacagaaacacacccacgcataggggattttggcgtggctttacaaaaatgggatatgtatcactctagtctacgtcttgtccttttcacacaatgttaccttggaaatccctgcaaacgcactggcatggtgacaaccccattctttcacagttacaccgcgtttcgtgacttcatcattcctcttttagtatagagatgaataatctcccttagcgtggatgtattagaatttacacaatcattagtgttatgtttattcatgcttctgttatttctactataaataatgtcaatattctgattttatacttttttatgtcatcttacttgctgattcttttaattctctgacatagattctcatgggtgtactgagaagttacagggtctgttctggatgaattctctatctgttccaatggcctacttttctaggataattttatccaattaaaagaaaaacttgccttctctgggttcttactggatctggggttgctaatttcaaaggggcagaaatcaggcctggggagtggagcagttggggtggtgaagggtgggtctggatgcagatctactggacagcccaggggttcgttcccctgcttgaactgcactcagcaggagaagttagaagcacccagagatgacgccatgtttctgtgactcacatgtaaagcaaagctacccattcttgaccctggctggaggagcaataaattggtacacggttcccagagtgcaatgcggcaatgtctttcaaaatcaaaatgcctgtgccctttgcccacagattcacctgccaggaatttattctaaagaagcatgtgcagggtcatgcactccggaaccactggaagtcgccagatgctggaagccatcgcagtgtccatcagcagatgccttgacatggctcctcagggcctgggccctaatcaccatgttgacagcagcatgcaaagacagagtgtcgttttggggtctccctcccctggacagcagccctggagcccaccccagctaggtccagttcactcaggtgaactctgttgtctgataggctttccacaaaaaggacactgcccacttaggaggaagagggcttcccgaaacaaccgccaaggaggaggctggatatggagaaaagccaggggaaaacctcggagagagaagggacacgatgaggatgtgagctcctgagcagaaagcctgcaccaggaacccaaagaccagcagtgcgagcccagggccccgtggaagacatgactccaggtcacagaaataaggtcactggtgctatttttattaattctctgagtatgctgcaaatttggtttctacttatgatatcagccttaactttttttaatgttgatgagaatgttcatttttagcacagataattttaaaccattttcaaatcaaccttttctggcaatgaatagatgcgatttgctcccacgaagacacccacagactgtcaaaatccagtgtcactgagagggaacggtgacggatcgagaccgtaagtcgtctctgtcccaggttttttactcgctggactgggcccttcccttccttcctctaccacaaacacacaacacacaaaaacacagttttcagctgaaagtgtaactccccctctctctggccatgccaagaaggaagtcacactgggctttagttctcagcctatagaggatccagaggaggaggctctgctcccaggcagctgatgctccagagcatgggcacaaccccaacattcgggatttggctcaaggctgggctctgccccctgatgtgacctcagggaatcacctatgactcttgtctgtgatggccacatgacagcacctcactcgtgtggtgtggactgaaggagagggcaggcctgaatgcaagccccaatgaggcagggagcatccacaggcagggagcccccataggcagggagcaccttccaggcaaggagcactcactggccgggagcacccatcaggtagggagcactcactggccaggagcactaccaggaagtgagcacccactggcagggagcacttgcaggcagggggtatccaacagttaagagcatctacaggcagggagcatctgaaatggtgcctgttactgtcttccccttactcccaggtggtcggctgtgtgaaggccacaatcaccagccagcattcaataaatggctcccggcagccagtggggccggtgcccactctgcagagctgtgcatgaaggaagacgttccccgttccctgaaggcaatgcctgtgtccagaagccccgcccactggcccttggttcgggctcctttttaacccatggtctatttcttttgtctctgaatcttccaggttctctcttcactcacttccaggctgaggacctgtctctccagttcccccctcagctcctgcgacaagggaagttcttcacatgccaacgagcacacatgtggggccggactatccatcctcagatttggtaacagttgctgcagccgggtcccatgacacgaacagaaatgcgagctgatgtttgcagactgggcgcctgtgcctggggctgctcagagggtggtctgggaccggtggggcctcactccacccgggccttgtcggaaatgaggatgccaggccccaccccagaccccctgaatgtggggtctgcatcttcacaagaccccaggcgtctggtcagcacacagatgacctctcacatatggctcagaagtaataactgacgacacctctaacagtcagaagatttcgtgggagaaacagatcgccagctttcttagtcgaagatggggcaaccctggtcatctgcagtgggactcgtgcccctccacccccgccacaccagcgggctgccgcttctcgagtcaccgcagcagcctccgccacctctcctgctccccgcctcctgcccctcacgacccctgggcctggagcccctgcctccgccctggcgtttccccgaggaccacccctggctgctccctccttgccctccgtccccaccctgtcctctgcccggactgtccttgctcagggccgggaggctccatcctctccaccctgagatgtaaaatccaccgccaccttctcaggcaggccctcctgggcttccgtctttcaaacagctccggcatcaccaggactgcgttttagagcctaattatccacaagtcatccgacatgatctcccgcgtggcccttacggggcaggacgtggcgtgcactgacttgctgtgtctctgtgcgtgccacagcatcctcactgccaggtccccatggcccgggtgctacctaaacagcccaggctctaccggtaattcaataacacgctgttgaacgacgggcgaccaccagcaagcgcccccctctctctggggctcagtttctctgctggtaagacgagcagccttggccacagcaccgtgcagtccgcccatctccaggaacgaacaggtgctctccatgggggcagctctgcgccttctcccctgggctgctccctacgacaccacgagggaagcccaaagggagccctgtgggccgggccctggcgggaggggagaggagaaacggagcccgtgggaggagagagaaggcgtcacggccgtccgcagaggacggtgctcctcaaactgaggcctggtccatggcaagaaatttaaacccaggaactgtttctacgttcaccgccctctggtgtggtttcatttactctgtttaattttctttaaattgccgccaatgatccaggtcatggccctccccagccgcgaagggcccacctccacatggaggctgtggggtctgcaggccaggagaagaggggccactgggaaggcatggggggggcgtggggactgggaaggggcagtcgctggcggggcagctgctctaggggaaacactccttaaggaacatcccctcgggattatctggcgggtcacagctgcctgcacaatatttaccactgaagggtgcgggcaacgggtgggcttgggtcccaccagcctcacaacagagccgccccttcggaacctctaaaaccccacggccctgagccggaaagccccggcacgcaagggcttggcagttccacttgcttcgtggccggcccttcttgggggaccctgcggcatggaagctactgaggaggctgccggtcccctgtcacctgacatttcatctcacgcagcgccaagggctcctgggtccaggctccaaagcacgtaggtctaggatgctgggtgtgtgtctgtgcacgagggacccgagggtgaatggtgccccctcctatccacttaagatatgtctcagagcctgggccacaaagtgaggccccatctctacagaaaattaatacatgcacataaaaaagctggtgcagtggctcacacctgtaatcccagcactttgtaggctaaggtgggaggattgcttgaagccaggagttcaagaccagcctgaggaacatggtgagaacccattgctacgaaaaaatttaaaattagccaggcgttgtggcatgtgcctgtagtcccagctacttgggaggctgaggtgggaggatagcctgagcccaggagttcaaggctgtagtgagccatgatcaaaccactgcactccagcctgggcaacagggtgagaccctgtctctaaaaattaatttatttaatttaataaaaataaaatatggcttggacatctctctgcagtctccataagtaattcacagtgtgacatcaagcatgcattttgtgaaaagaaagggccttctctttggaaacaggaatagctgtttccctctggcgtcttctgcagagtgaggctcatacgcgctcacgtgagcagctgcccgtcggccagtgaggccgggatcacactggctgcaggtgccacgtgcgtctttcgccctgtgaggggctgcagctcaggagcatctgccattttattttccatggaatttaaagatgaggttatctccatctgccccagcagcattacaagtcacttccaaaaaccagggccctgtctccattgatctgagagttaactgtggtccatcaggcctctgcacacagaaccccgtggcttaggtttgctggtggtttctgttagggagcgaggggcgcctgggctgagcgctggatccgtgactgtgtcgcagtggactcgtgtccttcccacagcacccctgggaggctgcattcctgggccctctttctggaataggaaaagtctcccaggatgggagaaggcgaagctaggattctgcctccgttacaccttgaagagttctgtctcctggtcaacaggacagtggaagcccaacccattcaacacccccaaaacccacacaaaaccacgcaggacacgcggggcagcatcaccctctggcccagtgcagacactgcggacgctggtggattcaggtagattctgcctgtccacagccttgataaatgtgaccacagaggcaggcagtgacccaggcagggacgggtgttcaagccctggtgacaaagtgcctgctgggaaccacctgagcttggtgccccctcccgggagctgctgtgatcagagacatcctgactcctcccaaagccaccctgaagagccctagactggggacgagcctccagaagtcagtggccacgatgagcacatgaggctctaaaagaccagggctccgcacggaagatgagtctcgtgacaaatctgtccgggagacgctggaggcgtcactgcttccctgcctgacttaccctccagcctggccctctctcaggccccaaaatgcccaacaccagccacaggttacagcccagcatccaacagatcgccgtttcccaacacatctgccaaacccagcctggctcggagcagccacatctatgctgtccaaaccagcccttctgtgagcgcaaccgacagacgtgagtgtgggtgtgcagtgtgcagtgtcagcagcaacacctccttccactcctggtttccacctacatgagcgtctacgtgccccaccccaaacccagggtagctcagaccaagctgctcccaggcacagctctccaaaggcttcgtatgcatctagaatgaaactcacgctcctccctgaggcctggatgctggagccgagcctgctcctccctgcctcccgcctccccagggccttggagctcagggtgctccatccacggccatgccaagccccttcctgccccttgtcctgtgcacttgctgtttcctggcctagaacattctgcccccaggccttcaagacatcagcttcctctggccattcagacgccacatcccggagacacctctcctcaccgctccgtgaagacgccccgctccccgctgtctcctcaccactccgtgaacacagcctcgttccctgaggtcatcttctactgggctgttctcttccactttcttcctccactgattcaaagtgactaatttatctgctggtttgtttattatctgtctttcccactagaacacaaactcctcaagagcaggactgtgttgtttttcttgtttacagcggagcccccagcgcccggctcccagcaggcgcccagtgagaatctgccagagggacagatggagggatgaggggtccctccttggatccccccaggtgcagtctgggcgttgctgtgcgaagcacaccacactggactcgatttacacaatcatgggctcctcggatatttgctggcacccaatacatgcaggaccctggactacagaagccaagagaatggattccgtctgtaaacacaggccccatggagtaatgtgcccagggcccgtgggcactggcgggcaaagcatcctcccgcccccacctgcagcctcatggtacgtcccccaggtcccgcgacccctgaggcctggctcttacctccagcgggaccacctgcatgaggatggcaaagttggtgaggtgagtgcagcggcagacggagtaggtgaggtttcctctcgtgagcgcacagccgtggttcgaccagaccccttctccggagctgaggacacaggagaaaggatcagaggaggtagcaccgcacccttggcaggcaggggactgagagcagcaccccccataacacatggccccgtgaactcatggcggcgcccacacctgccacgccaggaatgcacacccagaccgtggtgtgggggttgggaggagagattctggccatcaggctggcgagagctggagagtgtctgctgctggtcaggccacaggaagcaaggccctccctctgggacagggaagggggagctgcttcgcacaatcaccctgaaaagcacctggaccaagcccagcacaaaatgaaacgcacatggcccacagccctgcgcctagagaacgggcagcggcacacgccagggaccacattcaagcccagtcactgaatcatgagtgacggtaacataaatgcccatcgggggaaacgggtgagtgcagtgtgggagagagaaatatgataaaagacctcgcatcggttaaaaagaacatccttgaccaatgtgcactgataaggataaaataccaaaacacaacgtacagtgactaaccacgacgcaaggcccgtggagccaacagcaccacacacttcccacgaacacagctatgaccggcacagagactacagagaaaacgctcacacagaaactccccacggtgttaccgccagagacagggtggcgagatcaggatgagacgtaaaggtctaaggagacccttgcttttttatgttttactttttacgtgaataacgtgtggatatattacttgcgtaactttataaaatataaagccagacaaaaatgactggaagcaaacgtgctctcggttaactgtggttaaacctgttggtgtgaatattggtgaatatcattttcttctctacatttctctatattttcttttttgtttgtttgtttgctttgagacagggtctcaatctgtttcgcaggctggagtacagtggtgtgatcatagctcactgcagtcttgacctcctgcgctcacgtgatcctcccacctcagcctcccaagtagctgggactacaggtgcatgccactgtgcccaattaatacttttctttttatttttgtagagatatagtcttgctatgttgctctggctggtctcaaactcctgggctaaaacaaccttcctgcctcagcctcccaaagtactaggattataggcgtgagccactgtaccctgtcttctatattttcaaattaaaaaaaaaaaaagatttaaatggttcttccctgaagttggaacctcaagttatcagtaaagacaaatccttacttcagccaaaggcaatggcccttgggggaaagcattcataaaggcgaataaattaaaaggctctagtttgtatttgctttgaattcactttcaactgcggtgtcagcatggatgtggcagatgagaactgtggctgtccgatggcatgaccgatgaagaccccagcttgtacctctctggccaatgtctaccagatggaacacgcaccagcagcctcgggcaacggtaaccctgcgttagccctgggcgacgtggagcgcgagggaggggttgggacggtctttccgacatgacccaggggtggctctgagtttgaggatggagactcagacagcagttcagtggtgattttcatgattaatgatctgctcttctaggggagggagaaggcatttagcagagagcagaggacaaagcgagagccactcagacgtaccaactgagaggagcaaaaccccattaataacttcagaattgatgggacttaaagacagggtcatgtcctcctcctctccctccccaccccttttgatctaattttcccaggaccttggagggagtcagcaaaaaccagctgttgtgttatatattgcgcctttgtctgtcaattggctgcataagtaccatacttcaatttgaggggggggcctgaacattaacaggcattggattaggtgaacgtagccacgggtatgagctgccccttctgcttacacaaagggtaagctaaacaatatgaaagtcacatcgctcagatggagctgcaaaggtgtgacgatgacctagttagccagaggagtagagccttcagtggcatcaatgaagatctacttcccagggactcagcgaaaacaaagaggcaggcttgcagcttgtgcataaataaatctgctatggaagccagatgaagcagtatcaatagcattaaagatatgtacggccctatgacccaggaagtctgcatctaaacagaaaaatgttcagtcatgcatacataaaatgtaacatgcataaatacggtaaaaaacatgtgtgtccacacaggcaaaacacagaaacaaaaggtggaggaaggatggaagacacattgaattaagcaacaccatatatttcctatgattataaatataaattatatataaattattgaaaaaacacataaaaaaccctcccaccgtggttattactggggaaaggggtggagatcaggataagaggtaaagatcaaagggaacacttgcttttctataatgttttacttttgaacaaaataatatattgatatattacttgtataatttcttaaagtatcagtctagaaaaaaagtggcccagaattctaagcccaatgaaaatctttcaagactaaaagagaatactttttcaaatggtaactgaatctattgccagtggaccagaactgcaagaagagttaaaggagtatgatactagacaaaaatctacacaaagaaatagaacagctggaagtggaataagtgaaggtaaacaggcaattattattgtcttaattttaattgctctagaagataactcattatccgggggaaaaaatactagcaatgcattgcgtttatggtgtctgtacaaaggtgaaatgtactacaacaacagcacacagaacgggcaggaggaagtgtgaacctattgttacaatgtcttagaatatatttggaatgatatcatagtacttgaaggcaggcatgaatgaattagacatatatacactgtaagcttaggtcaaccactatcaaaaaagttaaaaggatgtatacattagaaatcatttatagtagagataaaatagcatcataaaagatatccaacaatccaaatgaagtcagaaaaagacaacattttaaaaagatagaaaagttagaagacatctagcaaaatggtagattttaatccagccacaccaatgattacatgaaatataaattgtctaaacatgtcaattaaaaacagaaattttaggactggattaaagaaaagacacgacccagctacatgcagtctaaaagaaactcactttaaatataaatatataaataagataaaagttaaattatgggaaaagatacagcactcaaacactaatcaacaaagctagagtagttttatctaaattaaactaagtagacttcaaagtaacgcatatttcccagggtaaagagggacattatgtaatgataaaagggctaatcttccaagaagacataacaatcctaaacatacatgcacctaataacagaacttcaaaattcattaaagaaaaattcataaaactaggccgggtgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaacggcgtgaacctgggaggcggagcttgcagtgagccgagaccatgccactgcactccagcctgggttacagagcgagactctgtctcaaaaaacataaaaaaaagaataaaactagaagtagacataggtaaatccaccactaaaattggagaattcacactcctctctctttaattgacagaacaagttgacagaaaagtagtagtaagaatatagaagacataatcttaactatcaatcgacttggtgtaattgacatttatagaacactccaccaagaatatactttttttcaagtgcacatgggactttcatcaaagactgaacatatatgggggtgtcataaaaacttttaacaaatttaaaagaactaaaattatacaaagaatattttctgatcataaaaaaactatttacaaatcaacagcagaaagctctctggaaaattcccaactatttggaattaaactacacacttcaaaataacacataggttgaagaggttgaagaggaagtcacaaggaaaattagaaaatattttaaatttaatcaaaataaaaacatatcaaaatgtgtgcaatgcagctagatcagtgctcacagaaaaaatatagcattaaatgtttatattagaaaataataaagcttcatagtaataacctaaacctacattttaagaacttttaaaatgaagagcaaattaaactcaaagaaagctgaaggaagtaaattaaagacaaagaggataagccaatgaaattgacaacagaaacacaagagagaaaaatcaatgaagccaaaagttatatctttggaaaaatatcaataaaattaataaacctatagtaagagtgactcagaaaaaagaagacacagattatagataaaaaagtgaaatgggaacatcaccacagacccttcaggcatgaaaaaggctaacaacggaataccacaaaaaactctgtgcctataaattaaacaactttgatgaaattgatgaatatttcaaaaaaacataaactgcttgaacttatttaaaaagaagtagacgacctacatagtcctgcatccataaaagaaactgaatgtgtagttgaaaacctgccaacattgaaaatgaaggctcaggtgacttcatggtgaattctactaaaatggaagaaataatatcaattctatacagactattccaaagtgcatcccaaaatgtaacttttataaaggtatcattacctcgatataaaaacaaagacattaccaaaaaaagaaaactgcagaccaatatccaacatgcacgtagacacaaaaattctcaacaactgtagccaattagatttagcagtatacaaaaagataatacatcatgaccaagtgtggtttaccccacaaaagcaaagctggtgaaacttccagctttaatcataatgatcccactctgaaaactacccaaatgttcctctactcgggagaagataaataaactacggtacatccatgtaacggaataccccctcagcagtgaaatgtgaaaacaagatgttgatatatccaacaatacatgtgtggtgacgctcaacacactatgcaaaattaaagaggctagactccaaaaggcttcctgcgccatgattccatctatgcacactctggcagaagcaaaactatataggaacagaagacaaatcggtgcttgcaggagccggacgtgagaggaagggatgactgcaaacagacacgggggcatcttggagggtgatggattgttctaatcctgattacggtggttgcacaactgtattcatttgtcaaaactcacagaactgtacaatcatctacaagtgtggatttttctgaatatcaattatataataataagtaataattgcacaatggacaggaaggatacagatactatattcatgatggtggctgcctctaggaattgagggaaaagaacagaaggaggtggagggttcgttaacatcatctgtgatgttttagttgtttcattcttaaaaatacaaaaatataaacatgctaataactataaatttggggcaatgggtacctgcatttgttatattattctccgtacttttctatgttcttaaaattccttcaaaaataagaatcaacatgccaatttagttcttaccaaatcccatcccgttttctagtcataatttttttctccaaacagtgccccggaattggaataactatttctaggagcacatgcttccaaattttcacaatttacaaataaaggaaaaagagctgcaacctgctgagcctgaccagggcaaaatcactgaaattacagagcatcaatccacattgcagaggcatgacgccaacggtcatagccagacgccgacggccatagccagagtgaggcatcccgggggtcaaaaatgtaagcagtgtttgctggaggtgacaggagctgggctgcactttcctcgctgttcacagaacagagataaagggagattatgccgacctgctgctgcacccccagctcagcgtcttgcaatctcctggccctctgggtgcagggagcagagacgctttctctgacggggaccataccagcagaggtggcacagcctgtgtggatcctgccctgaagcagcaggaggagggagctggggaagtgagtccaggcacaggaagatgcccaggtgttggggagccctgacaacatgcagggtgatgggccactaggcagggtgtgaactggatgtcccagatgtgttccagctgcctgtgcagtgttttaaacattgggacagttcatataataatctagccatagccaggcacagtgactcacacctgtagtcccaggactttgagaggcactttgagaggcggaaggattgcttgagcccaggagtttcagactacattgagctaagatcacaccactgcactccagcctgggtgacagagtgagaccctgtctcaaaaaaacaaaaacaaaaacaatatccagccatgaaaactgatgacctggcaacacaggacctgcaacctgcatcccacatggaacaagccccaggggccacagctgagcagcagctgaggatccggaggccccacccctccctccactccccggccctgcggggagctgagttttcaacaccgctgtgactgtgggagccattcacggtgggctcacgtctagaggagaattgtgatcacagcgatggtgggagatcccccagacattgggcaggtgagccgtggaggcgagctggggcaggggctaggagggcgggaggagactgcatgtgacaggtgtgacaagtggacatgggagatgctggggaggacgtcccagtcagggcccaagtggcagaggctgaggcctcagagttttaggcaggcctgatggtcagcctgctccagtggagccggcaaggtttcaaacaggaaaatgccaacgtggctagtcagaagccactcccccaacccccttcctcagctgctccaagaccctcgagggggacagccagggctgtagggcctgctccaacggacagcatcctccagctcccccgagcatctgctgcactggcttgaaagttgccctgggcattcagaggctttgtccagacacatcgtgcaacagcaggcccctcctcgcatggtctggaggggaggcctccacccagcactgccaccaggccctgcccacatctccagcatttccagcattttcgcataacgcaaccatgtcagctgcagaaatgggtgacccagatcctcccctgggctggcatggggcgggcctgggcttggacacctcatgcccacctgctctcccctgtgcagagggtacctgaagtccaggaaggcgcagtacacgaagactcggttgctgctgttggtggcctcactgtgctgcttacgtgtctgaaatgaaagaaagcaaacacgatgcatgacgctgctgaagaggcccctggttctcagcactgatgtgagagcgagacccttacagctgggcgacctcaggtagggacaggcatagccactgatgtctatctccatccattgtgggtgtggtcccacatcacctggcccaggtcatgctgccctctgctctgccctccccaacccacccaagggccctggcaggtgccgggccctccctctaggacactcctcctcctaggacgtgcctccccatagggtgctccccaccaggcagccacaggctccctccccactccccaccaggtagccacaggctcttccccactccctaccaggcctctgcaggaggagctcctcagagagaccttcccttccctacctgttctaaacagcaccggcaccctgcccactctagctccattccactcactgatgttttcatagtcttgatcaccatgtggcatattacatatccactgtccactgtgtgtgtttgctaccttcccctctacaatatccactacagaaaggatagagcttctgtctcattcacggctgcatccccaggacctagagggcatctggcatacagcaggtgcttactaaatatctgttcaatgaatgaacaaaagaatcagtgaacaggtccatgagaccaccttgttccggagactggcgttctctcctgggctgctcctgggtgccagctcggaggactctgcagctatgctctaccctaaatgaaaggcacagacaccttcaggagccatagttggaggctcaggaggccagcgactccaccaggacccagggctgctcagaggtggcatggctccgggataaatggtgtctgatggattcccagtcagtcaagtcaagcatctcttatttgtccgatgcctgctctgttctgtgacccattcctgagccatcattgctccaatgagacccttcccccatttcagggtgaccagccctcaggaaggcactgacttgtgcaggacagagccacgagggcagcccccctcatgagcgccatcctggcctcgaccaaaagcccctcctttcccaggaagcagcagctctggtgcccctgacaggcacctcggaccccactgcagaaccaaaggactcacagggctatcatcgcagcatctgtctgacagctcctccagcctcaacccaattatcctagtgctgtctactactaatgttttggcaaaatggaacgtttactctttttgctttgtcccccacccctgccgccccgtatcttagggttattttaatccatcacagggtctcttaaaaccgcctggaaaagacatcttctcctctgtcttcccaaagccacagcctgctgtgaactcttgcacagacaacagagggccctgtgtcctgcagccaccaggaccacagaggggcatcagcaggaaaactgcagcaccaacctcacataatagaaaagatgaacaaaaacctggtggccacagcctggttctcggaggggtgtaatgaggcttccttgggcccaggctacaccagggccaaagcctccagcagacagcgttatatgtaattttttaacaaggaggcgtatttgtgtgttacctgagtaatttaaaggaaatttaaaaaataagtcggtgacctggggaagccagcagccagacccatacacatcaacacgtggcaaggcttctcaggagtgaggcgacgcctcttcccatcaccccctcacccagtgccagcccccgcctctgccccacgtgtggaagcgcagtcccaagggagcagagaagaggctgctgtggcctctggaagtcctgacactctgacttcagatctaaatcactcttcaaaggaaatgtagaaaacagccaccaccgcaacaagccaagcatgtgtgtggtcggagggtggggaaggcagctagcttcctcttggatctggagccaagatcacgccctgaaacggggaaactccctcccctccatcgtcagaggttccatcacagcctccactcctgggatgagaaaagcaaattgactcttcatgtgtgtggagttccccactgactgggaacaaatgctctcagcaagtctccagaaaagggggcctcccgggctcccaggggtgtgacgtggggtgggtgtgtttttgatatgggagtgtggtggtgccagaatgtaagtcatctgcatacaggccccatctcatgcagaaatgtgggaggtgctcacagcccacgagcctccctgaggcctgggtgaggcacagaagccagttcagttcgtcaccaggtggctggggaatgggaatgaggcgctccctccctgtggagtcttcaacagtgttgggggacagccgcattcacctgagcgtcctcctgaaacctcaagccaggggctgctgagctctgctggacagaagtgaaggcctcctcacagggccggctccatggcaagtaacctaatttcccactagacacacttcacttgggtatgtctaatggggagtgcctgtgagccctcaggaatatctcccacaggatctgagatgtgctccaacaaccatcatgatctttccagtcagggagaagcaaacgggattaaccaactgcttgtttattgcctactgttcatgagcaaggtacaccaaagtgtctccttctaggagatacatgcagagagaagaaaaaaatttgatactcatgatagcctgttaatgccccttgtttagaaatgtgctggcttttatgtaagtattgctagggtttgactgtgtcccccaaaagctcatgtgttggaaccttaattcccaacgcagcagtgttgggagatggggcctttaagtggcaactgggtcatgagggctgagccctcaggaatggattaatgtcactgttatgggagtaagttagttcttgcaggagtgaatttgttctcatgaaattaggttgatacaaaaagcaagctcgactcgctcttgcagtctctttcactcacactggctttcctttcccttttccaccaagaggtgaagcagcacaaggtgttcaccagacacggctgcccgagcttggacttcacagcctccagaactgcgagccaaaataaacttctttcctttataaattacccagtctcagatattctattataacaacagaaaatggactaggtgtacagttttacctgtaaataatttggggagctacgtgtccaacattgtcccaagcaaaagagagatggcaccatggtccttaaatttgatggtaagtaaagcaatataaggagccgaaatactgaccccagagcagtgggtcaggtgcaggtggatctcagtggaacatctggggcagccctctgtgccaccctcttctccagcccatctcacaactaaacagggttcagggctttgaatgcttgaaatgtcccacctttagggaaatcaaggataacagaagtaatgggagagatacgacaaggaaaaaccttgaaccagcctctatctcttggtgctttctgaggtttcttgctttcaaagagtcataagacagtccagcatggatgaggcagccacagcctgatagaggctaagacaggactttcagaacctggttccagcacaggaagaaaaaggtgggaggtgggcaggaccctgaatgaggcatttcaggacaggttgatgagctgggccaccccagtgctgagaaggaaaggttaggccaggtgagaccctgggacagatggcccagtagagcaggggcacatggtggggatttactactctgccttcaccccactagtgccatctgcatgtgggcctgtctggttaagtcactctccccagtgctggctcctgggcagaggtgagcagtgccttggggcgccaaggatacccacagatgctgctcagacccttaggacatcccactcagcccaggctgcttcagaaaccagaggcatccttcttccaacatgtgatcaatccatctgaggacaacagcagaggccctggaacatgacacccccaagtcttccctctccaggcctcccaggcccatgagcctgcagagatctctttggcattaaggcagcttgaaggggtctgtcctttcaatggaataagtcctgaccacagaatgcaggcgccaccccccacacacatggtgctgacatgtgcacgtccttattttgagatcatggggccagatctcaatcctagagagcagcctccccaacctcacaacctactgcttccctcttcaaaggcaactgagcacagccaagaaacaccaggcagaggggtagacttgtgcagacaagcacagcccatggccacctgggacgcaccagggtcagagagacccaccgatgccccctacttcagaagaccccaggaaacatggtttttgccaaagaccaagaagcttcagtttgctgtctgttcatcgtcaaggtgggatgctggtctggtaagagacccaccatccagtgtgaactggactctaaactgtgtccctccctccaaggtccccaagtccctgtctcctctgcgaaacctcaggagtcccgtttgagaagaaaggggcccgcagacacctgattctcacgctcggtttgtgcacaggtgccagcctgcaagccggagaggcatgcagagaggaaactgcattgctgtttcaaaacccaaagaaaagaaagtactctgaattgcgtggggatctggagttagggcagcttgccccgaaactgaacagaaagtgttttcacatcaccccctcgccccaggtagcacccagtcacgcggctctcagtggaaagcgcggcacacgaagccaggccgggacccacagcccaggttctgcatttggcatttagcagctgcgatgtctccgagaaccctgcagagacggagcccacagaggagggtacagcgtggaccagaagccaccagaagccgggcgaggcggctgagttcagtgctgtcagccagaggctggggagggagcaccctggtgcccgcatccctggtgagccttgaacccggcatccgggtctccactctctccttcctcgggcctcctggacacataggacccgccagtgcgtgcacaagttgccctctgtggcccagcagcactggggtcacctgcactgtggccatggtatgtgtggagaggttccatccttgggaaagaggtcctgagtgtcctgggagccaggaggaagaatctccagagacaaaccagagaattaaccacagggaccccgcccccttaactccaccccactcacattacccttcccactcacatgacaccttcccactcacatggctcctcttctcccagtggcctcgccccactcacttagccccaccttccttgcacatggctccacctcctttcacttagccccacctccttgtacatggctccacctcctttcacttagccccacctccttgcacatggctccacctcctttcacttagccccacctccttgtacatggctccacctcctttcgcttagccccacctccttgcacatggctccacctcctttcgcttagccccaccctccttgcacatggctctacctcctttcacttagccccacctccttgcacatggctccacctcctttcacttagccccacctccttgtacatggctccacctcctttcacttagccccacctccttgcacatggctccacctcctttcacttagccccacctccttgtacatggccccaccctctatcaagtggctccagcctctcttacattcccctgatggtgcagcccacagccccttctcaggcccactctgaccccaggactcttctccaccatcctggatggcagactcacccgactctccaggacgtcccgtgcagacactccatgaccacatgggcagggcactagaggccagccaacctataaggacacagcctgaagtcacatgtactccacagtccaatcagctaaggctgtgggtggggccaggaaggttccgcccaggatagtgctgtgggtggagccttgcagtgatggacacgccctcatctccgtggcaaccagctttcctcccacctctgctcactgcgcacctggctctcctctcacctggatgacgcagcagcctccactcgtctcccgcaccgagtccccgcagagcagcaggtcaacttctaaagcgcgtctcagaccgcctctccctacagaagccccaggggctcccagcctccgagtacaacacaaactcctacccacctgcaaagccggcgcctcgttttcctcctgagctgcggtcacgagaccctcccacttcagaaaacaaaaacgctgtcgctgcccttcgtctctgtctgtataagcggactcagcaccagggggtatttgcgggggctgcggagctgcctggagacccccgcccagccacagaaggctctggaaggaggcggcctctgctgagggcctggttttgcggtcatcccctagaatgctggagtctcgcctcatacaggtcgcgagcccgtggtcaccccactcgggtgtgacaggtcccccaacgctaagcagagatgtggcccagaagggctccaaggacccaaggggtgcccagggaggctcttcccagagggagcattttctctctgggacaggatgttcatgctcaggacagacctgcacacggacaggcctttgcttgtggcttcatctccgtgggaataggaacctccacatcggatcgtcgtggatgagtgacactgaattttctcaggcccatgttattggaaagcaagggactttggcatttctatcgcaacaaggcgacctgtattctttcatacatgcaataataattaacacgttttaaataattttcactcattaggctactcaaaacgtttttatacagttgtctcattagggcttatttttggcctgccctttttgtgccgaatacaaaaatgatataataataccatataagatattttctaagaccttggattttgtcttgttttcatgacttcactctgatacattgtgctccccttatccttccaataaactacctttctgctcaggagaaccagagtcagcgtctgttgctggcatccagacatctctaacaccccctcacaggctgctagaagcctccactgagatcatgtgtgtgagccccttgatggttcctaatgatggcaatagttaaccttttccacggacctgccctgcgcctggtcctgctctgttttacatgagtgaagtcattcaattgctcagcccttgccagctgcgcacactcttgccccactttacaaatgaagccacgaagccacatggtggttggaggactcacggcaagtgacggagctgggaaggggccaattcaggactcaggtcaagacatcctggttccagagccccaccgtgacccaccatgttactcagcacaggtgagttacactgatctttatctgtcttttcatgccctggagatggaattttcctagaatagccactggctcccccgcctggtacatcatggactcgtagtgcatggccctgccctcagatgcctgtgacgtcagagatggaggatgggcctgctgggctctgtcagctccaggagcctcagggtcggggggacgatccacaggaatccacgagcctcccagaacatggaaggccatggccccagagcatccaaattccatctaatggcatctttcaggagtaaagaaagaggcagaacagaaaatccatatagctgctgtgctcggaatgaacacgtttacctgccgaagggcactactgcctaatctcagtgctgcagtcagtccagaaaagcaatacctataaacgtctataaaagtgttacagcttttcaatttggctcctgggccatggctacttgaaatctcagctagaatttaaaggttgtttctttttttcttccctttgttcttcttgtcatgaagttggccaaatggtttccatcaaaagatccaatccattcattatccttttatttattttgttatagctggcctctacccaagaagaattttggatgacttacagaaacaaggggaaagcattgctaatgccagagtgtctttaaactttcaggagaagcagatatgctgtggtttttcgcatgagaatagtcaggggttcatagaggcctgtatgtggaatcatgtcaaaatcagtgcggagtcaaacagcctcagccacctggaccctcctcacgttggaaaagtcatcatggtaccaaggcctggagtggccaagctcatcccactccacgccttccctccccgcccctctgtctggtggggaagatgaacattctttcattcctagtagaatatctgagattctggtctgtctaatgttgggccagaggcagagaaaaaaacccaaatgcccagagttgaccattccagcgccacccatgagacacaagcgtgcatcatcaaacccagcaacacgggtttccagaacagagcaggctgaggtgtgcagccactcagccccactcggccccagacctctgcctgtccgggattccaagtttccatggggttctggaaccagcccctggtccccatggtgaccgatctggtggcctcaggaaagtggctgaggtctttagagcttggtgggacttctctgaaatctccctccagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacagaaggtagagggcagcccctgctcagaagaaggatcaggggcacagcgatcagaaatacaggaggcagagggcagcccctgctcagaagaaggatcaggggcacagcgatcagacatataggaggcagagggcagcccctgctcagaagaaggatcaggggcacagcgatcagacatataggaggcagaagaaggatcaggggcacagcgatcagacatataggaggcagagggcagcccctgctcagaagaaggatcaggggcacagcgatcagacatataggaggcagagggcagcccctgctcagaagccaggtctggaggaggcccagagaggcctgacagagccaggcacacctcctccagggcctgggctgaccctgatgacgcctgaccagtattctttctccagttctttctcactaacagaagcagttttttgctcggggtggcaacgtgcccagctagacaactgcaaaatctgcatctccgtcctccattctagctccagctctaccaccaccaatgcagcttccccacctgggcgtccacaggcctcccaaacggagcatgtccaaacctccctcctgacctcactcccagccctggactgtcccagagtcatgcccttgtcagttagtggccactctgtccttcaactttttgagcccccaaatccttgaccctgtcagcaagccccccatagcagacctgaagctaacatcctccactcctatcctgagcctggcggcagccccgtctacctgctcaccctgccctgtacagggtttgtgaaagcccaagtccatcgcttcgtccctctgctcagaccctccgggggcacccaccttactcaggggaaagccgaggcccttaaagttgcccccgggcccggaaagatctgcccgtagcccctgacctgcctcctccagcccctcggcctcctggccgctcctcagacttgaaggtgtgcccccgccgccagccaggtgtgtgatgcctctcccccgatgccccacgatccccccatccacgtggccactcctcagggcagcctcctgccagcaggcctcccacgtgctgctccttgggatctgatcttgcatgtacctgtcactgcctgtctgtctgcctgcttgtcacctccccaggtccccagcactgggatgtgagagtcacagggcaggattcggtctgtctggctctgtcctctccctcacagcctgaacgggggcaggcatgcaggggcactccgtgaacttcggtgggatgaacccacacaaggtggcctgcggtagggagggtacagggggccgaggacaatggcccagccaggcatccctgctgggagtgaacggacagggccaccgccccacagcctggaaggtgctgacaggccacccgagccctaaacatcctgatggagtcacccctcggagtgagcagcaggtgcagatgcgtcggcgggaaaccctagggaaccaaagcctgcggtgcttgcagacgtgagatcacatcctccgccctccccgtggcagaggatgagcggccaggattattgttttctaaaaatattcaaatcttgtagcggtcacaatcctattgtggctcctatgactgctggagtcagggtttatttctttactgcctgctcatgagtctggagttgccccacaaatttgcttccagtttggctcaaatggactaagggcccctggcccggccctggggctctaaggtttaacctcagcctcacccctgccagagttcaccacagagacatcaggtgtccccagaaactccacagggactgggcagctcaaaaggtccccagcgttcctgagaggcccaaagaccagggctgagccaggtctcttcctccacccccggagagggccctaacctgggagatgggggcttccagccaggagcagaaattcagagtctgtggtaagcaagtcacaacaacttttatcctaccttatgtggggaagagagaggcaaacctctccctcatctactgataaaaataccccctctccttcatgcgcacaactaacaaccgaggaatcacacctttaaacacacctggcctctggcaggggccttccctgcactctgaccccctccctcccatcacagactccagcctggtctcaaaagggacccagagcctgggtgcctctcgcctgagatccgtacaagggaagctgcccaacccaggacagatccgtatcaggaaacacagacagtgacaggcaagggcctgtctctgacgcctcctcccacgggacaggggtgactccggttctgtctccagagggagtggggtcctggcactgcataccagccttggtcagcggctccagcagacagagccgagggtccacgctgctacagcagggcccgagcgttctcatgatggtttgcttttcagacaaggttcactcttgttcagaaatcaaacctggcaggagcaacaccaacaggtgtgttttcactctggtcaatcgcttcccaagccaccctgtcactccgttttctctcacctctactgagccactcacctggtacagaaaaaaatcaaccctgaacccccggcaccatttaagatttgcagagcagatgtttatggcatcagtgtggggaatgggatggccacgtggcttctacaaggaccaaggaaagatttattcgaaaaggacttctgagagtggagaagggagtagaaggtaaatacatacaaagagagaggagagggagaatctgatgaatgagggctgagataacagcctgcctagtgctgctcatcctgttcagtaggtctggctcactagctcaagagctgggcagtttgatggaattaatttacacatctatgcatctaggcaggaacgctcacccagaccagtgtacccaaaaggagcatctcagcacttgaggattcactgattcccaaagaaaactctcctttccctttgctttctaaaacaacatatgagagtggggaaaacattaaggtttctctgaattaagataaactcacttgagtagcgaaagggtcttttctatagaagatatgggatcctcaattgagtcatttcctccatttagaaaatgtgctccttaaagagaccaagtgccaacacttttccttacagtgtttcataaattatgtgcccatatattcacatggcccatgaagcaaaagatgatagtattctcctaatacacagaatgaagatttagaaagaaaatgcactatataaatatagccccagtcttcaattggaatgctgtggaatacaaggctgactcaatacttgaaaattagtgtaattcaccatattatcaggctaaagaagaaaaatcacatgatcatatcgaggcagaaaaaccaacaaaatccaatatctgttcatgattaggactctcaaaaaactaagaataaagggaaacttcctcaaataacggacacctataaaaaacctagagctaacttattagtcgaagacagaatggtttcttcctaagacagggaataagcaaagatgtctggtctcattactgttgttcaaatagtactgaggattccagccagcacagaaaggaagaaaaagcacacagatcaaaaggaagaagtgaaactgtccctatctgcagatggtatgagcatttatgtcaataatttcaaggaatccagaaagaaactcctacaattattaagtgagttcatagtcactcaaaaaatgtacatttaggtgtaaatttaacaaaacatgcataggacctgtatgccaaaaactacaaaatacagatgaagaaaaccaaagaagattttaaataaatggagagatacgccatgttaatggattggaagactcaacacaataaagatataaattctcccaaaattaatatacagtcttaatgtaattcctagtcatcccagcaagaatttttgtagacacagaaaatcttactctaaagttcatctttaaaggcaaaggaactagaaaagctaaaacaatttcgtaaaagaagaataacgtgatatgaatcatgtgctcaagctgatttcactctacctgatttcaagacctactacacagctacagtaatcaagactgtgtgggactggcacagggacaggcaattagatcaatgagacagagccgagaacctgggaacagccccacacaagtacagccaactgatttttggcaaagaaacaacagcaattcaatgaaggaaggagagtttttttccccctcaacaaatagtgctgaaacagcacctcatacaaaaaaattaattcaaaatggaccatagattaaatgtaaaaaataaaaccataacacttttagataaaaacaaaggagaaaatctttgggaccaagagtttgatgaaaagttcttagtgatgacaccaaaaatatgatccacagaattagaaaatcaataaattggactttacaaaatttagaagcttcagctttgtgaaaaactcttgttaaaaggataaaaagataagctgcagacaaggagaaaatatttacaaaccatgtagctgacacaggattcatatctataataatccagatccataactcatatctatctataatatctatagattctatctgtaattcatatctataaaatagaaagaattcttaaaattcaatgataaaacacaaaaagaatccaattagaaaatgggcaaaagatactaagagacattttattgacgagaatatccagatgacaagtaagcacaagaaaaaattttcaacatcactcatcattgggaaaattcaaattaagaccatgatgagaacaactaaaataaaaaatagtaactataccaaatgctgtcaaagaaactaaatcactcatacattgctcatggaaatgtaaaaaggtacagacactctggaaaatagtttggaagatttttttttaatattaaatatatttaccacgtgacccttgtattagttcattttcaccttgctaataaagacatatccgagactgcataatttataaaggaaagaggtttaatggactcacagttccacatggctagggtgacctaatgaggagcaaagtccggtcttacatggcggcaggtaagagagagctttcgcagggcaactcccctttataaaaccatcagatctcaagagacgtattcactaccatgagaacagtatgggggaaagtgctcccgtgatttaattatcaccatctggccccccctttgatatgtggggattagttcaaggtgagatttgggtgaggacacagtcaaaccatatcagccctgtaatagtactcctgggcatttgtctcacagaaacgtaaacttatgtccacacaaaatgccgtccacaattgttcacagcagctttattagtaatagtcagaagctggaaacaaccaaaacatccttcagtgggcaaatggtcaaacaaattgtggtttggtcaggcgcggtggctcacgcctataatcccagcactttgggaggccaaggcaagcggatcacaaggtcaggagttcaagaccagcctggccaacagtgaaaccccgtctctaccaaaaatacaaaaatgagccgggcttgggaggctgaggcaggagaatcgcttgaatctgggaggcggaggttgcagtgagctgaaattgcaccacctcactccagcctgggccacagagtgagactccatctcaaaaacaaaaaacaaaaaacaaacaaacaaaaaaatcaaactgtggttcctccattccatgaaataccacactaagcaatgaaaaagtataaacaactgacctatacaaccatgggcattatgctgagtggcaaagtccatctcaaaaggtcacttactgtatgattctatttacagaccactgtcataatgacaaaatcataaatacagagaacagaacactggttgccaggagttagggatggtagaaggaaggcaggatagcaacgaggagatctgctggctggtaaaacggcctgtatcttcatttcagtggtgattccatgaatttacacctgtgttaaactaacagaactatatacatacatagcactgatgttagtttcctggtttgacattgcgctgtatttctctcatttgtaatcactgggggaaactggatgaagggtgcacaggacttctttgtaattatttttgcaacttcctgtgaatctatcattattccaaaatagaagtttaaaaaaacagttaaatcaacatcagatcaactataaatgagtcaagatttctagctgggggaaacacaagcgtgggcaggcgagaagaggatcctactattaagccagaggcttgaatatttacgtctcattttgatttgctgagttctgcacaggaacagggaagtcagtggtaagcctgtgacggggacggcaggtgacagctggctactgatcccaagaggacccatgactaacgttctcacgaagccaggtcagatgggttgtggtccctcctcccctgccttcaaggcatactcccagcctgagtcactgggggtgggaacacagggacttttgggggccataggcatcaccttgagaggctgggcggggctcctgactgcaggtcctgatgttataagcctcattatacttataccgctgacctgcaggatttgttctgaggcctgcagtgggggctgggggagggagaatatgacgccctgcatgatcctgagctcattcacagggatgagtctcacgggtgtccaggtctgaacagtgttacgtaaaatgcaccccaggaggagggaccttcaggactctgtccactctgttctccatccaggtaacatgggcggggtggactgagcccctgggaggccagaattaccacagcccatgagcttggcccaagggtcaaggagaagaagggttgcctgagaatccaggcaatgggatctccaggcagtgagatcataagtgattttacattccgcatcccaaagtttttgatcaaaagaatccaggggtagctactgatacgtgagggaagatggaagacacagaaccatcaggtgtcacaggcaggggtaactgactctgatgttgttggacaaagagtaagaatcagaatccaactcctctggtttagtggtacggctgctgatgcccctggagaggctgctggtgtccgtaaggcccccttggccacggcctctgtcacccaggactgacttggccagtctctgcatggtgtgacccagccagcagttaacagccagcatcgctctgacacagcattgtccatgctgctgggtcttttgaacatgacccctgctgtcgctgcctgcgtggattatttgcctcctgagctatttgatctgatatgtccagtaaccacagaggaccaggaaaggggccacctagacaggcagtaattagctactccaaataccacgggagaaagtgtggccccacccagcctctatgagcaaaggctgagtgggtatcagggctgtggcggatgccccgagcatccccagggaggtggcactggagaagaccgagtgtgaagccatggggagaagcaatgcggggcatcagcagagccctgggggaacccagtagccatgcggcacccagccctcaccaggactccaagggacacagagcaggcactcggactttcacccccacgccgcagtactgcggcacatggcccttcccagtggtgggtatcagagaaggactgctaaaacagatttaaataagatccagagtgtcataacataataaccaaagtgtccaggatgcaactgaaaatcatttgtcataccgagaaccggaaaaatctcaacttgaatgagaaaagaaaaacaacagacatcaacaccaaatgatgcagacagtgaaattaactgacaaggatttttaaaacagccatcataaaaatgcttccatagttacagacactcttgaaacaaatgaaaaagagtctcagcaaagaattagaagtgcttccaattttggactttttcagattttgacatttctgcattatatgtacccggctgagcatgcctaagctgaaaatccaaaatctaaagtgctccagtgagcagttcctttgagcgtcatgtcagcgctcagcagatttggagttttgaagcatttcagatttcagattttcagattagggatcctcaacctgtataaaggaaaaccaaatggaaaatttagaagtgaaaaatagaataactgaaatcaaaatctcaatggatgggctgggcgtggtggctaacgtctgtaatcccagcaatttgggaggccgaggggggcagatcacttaaggtcaagagttcaagaccagcctggccaacatggtgaaaccccatctctactaaaaatacaaaaaaattagctgggcatggtgtctattagcacacctgtagtcccagctactcaggaggctgaggcacgagaatcacttgaacctggggggctggctgcagtgagccaggatggcgtcactatactccagcctgggtgacggagtgagactctgtctcaaaaaaagaaaacaaaacacctcaatggatggctcaacagcaaaaataaaaatagagaggacagaggaaagagtagtggacagaaggataatttgaagaaaaacaacataaattacccaatcagaacaacagagataaaatagattttaaacaattaacagagccttgaggacccgtgggacaacaacgaaagatataatatccgtgtcactgcagccccataaagagaagagaaagggagtggggttggaaaaacagtccaatggccaaaatttcttaaatttggcaaaacatataaacacacagattcaagcagctgagcaaactcaaaccggaaaacctgaacaaatcactgccagacacattatagtcagacttctgaaaaccaaagacaaagaaaacaaattgttgaaagcagggagagagaaaggacatctcacctacaaggccagacaattagaatagcgtggatttcccatcagaaactgctgaggatggaagggagcggcctctctcaagagctggaggaaatgaactgtgcaccctgagttctatgtccagcgaaaatacccttgagggatgaagaagaaacaagaacgttctcaaaggaaaacagagaatttgatgccaacaggccggacataaaaaatgtctaaagtacatttctggaaatggaaaggaaatgataaaagaaggaatcttgaaacatcaggtatgaagaaagatcagtggaaaataaaaatatggtcccagcctgcaaatgtgtacggtggtaccttgctcagcaactcaaacccagcacattccaaacagatcactgaaagggcatggaggtttctgttaggccaagcagccgacccgccctgggtcacatcctcttgaggagctccactgacccaggacgctcacgacgcttccctagaatccagcaagcaacagacacagctactgaaaatgtgttctgtaggatctggaatctgagccctctggagggatgctatgaaataaaaaacccagactctgccatcaaagaacttctagtctcatggggagggcaaggccagaatccatgaaaaaaatattgtcagaaatgaaaagcacaaaagagtaacctctgaaacccctcttgctctaaacttctggatctaggaagttgctgtctgcttctcttaatacttatttcccaataaagttacaaaggttaaaataacagaagctcattctccctggtgcatagacaaggaaaaacatgaacaagaaagaagcgagatgagcacgaagacggctgcggtcagtcctgcaggaaagcacatggggtccttgactagggaggtaccagtgaaggcagagacatgcagacccattttctgcctcatcccagctccacctgtgttgtgggttgaacggtttccccacaaaattcatgtctccccagaaccctcagaatgtgaccctatttggaaatggggtccttgcagatgtcattaatgtaacgttgaagatgagactgtgctagatggggacgagccctcagtcccatctgagtgtcctcgtacactgcgggaaaggacaatgacacacggaagaggaggccgtggggagacggggcagagactggagttggctgccgcaggccaggactactaggagacaggcaggggtggacgttcccgctgagcctccagaacgaactagctctgccaacgcctttgtctcagactcgtggactcaagagctgcaggagaacggctttctgctgtttaaagccactagccatttgtcacggtggccctaggaaacggccacagcagcgcagactcggctccgctgccatctggccccttttctccaccgttccccttccaagcattctctggtccgcggcgtgtctcaacacattaggaaccactgatgccatccaacccagcttcaggggtgaagcacagagcttctctcaaacaccagcaggcgctcgccaggcagcgttccgtgcagttcttcaaacctgtttatcacagcgggggtagcctgtgattatttcctgcaacaatttcctccacttcaaaaattacacccaagtcgttgccacaaaatcatctctctaaattttatcccgttactctaatcattgtggacaatgctaccataattagtaattatcctccccctccttcccagcatcctaaatctcatctatttgtcgaatgtcaacacacgtgagtccaagacccacggcacaatcaacgcctccacaactggctcctgggacatgggtgtcttcagttctccccagggacatggcttccttcgtcgtcctagggccctggaagctgtattaacacctgcttgcatccagaagcgtgtgctttgttttctctttccaacacaaggatctcttgtgtggtccacgctagaaccaggggaagtgattatccccacggggtcttccgccctgtgtcaggttccatggtccacccacatcaaaggtgctggctctgcctctaggtctctttccagactatttttcttctcagatgcctcttgctcatggaatattcatgttataaattatttttctccagacacttggttagaattttgccaagttctccacaacttcatgttaatgttatcggtgctgtgatatagcacagtatcagaggaagaaaagagaagcctagcttaaaatacagcctcagcaatgatgggctccatgtttcccagaggaaccctccaccttggcctcttgtccccgaattttgacagagtcagggccccagtgtggctagacctgagctttaggagaacattctttataaagatcaaaagaatgggcagtggtccttgcattgatcattctcactggttcctgtttccaatgccgcaacttgggattttcccctatagccggcaaactttcctcctggattgtaaactaaagtacaacctctaatgtgtgtctgaaaaagcgtttacgatcagaacaagttaacactgcctctatgcatatcagtgatcctcaaccaagaggaaaaaaataatattttcataacacaatctacaaaacaggactctcaatatattccttcagggtagaagatttcagatgatgggaaaatttccatcataggtttgcccccaggggaccatatcaggagctcccaggggtgtaatcctcactcctgtgaaaataatggtgtgggtttcaaagtttgtaaaattctgatctattttacagcctagctctgtggctgttaataataaccggtcatgtttgtggtcttgagccctctgatatgccacatcaaaaatgatgttattttccatgaaagatgagtggttttacttagaaaagaatgggggaatctgacagcccacagtttgcttctagaaccgtctaaggagagatatgctctgtgaagctctgtggctgtccccagagtctgtgctcgttcatatttctgttcgtctgctttgtctcacagtttcccttgtttgctatgctactttgtaagttcacaaatgaaacagtttaaaccaggttttcccaggcctggagcacacaaacgcacaagaactctgaagtcaacaacatagaaagccttccccttgaaattctcccccacatattaaaggataacttttaacaaggtaaatcgtgactctcatacagagataaaatgaacacacatcaaagatattatttaacgtgttaatgggcaagggaacctgtgagatgtgaccgtcacttcaaagggaaattcaaagaaccatatgtacatgagcccatcccgaacgctgaagtcagtgtgcttaatagacacaaaactggcagaacttgatgtccagggagaagaatcaactgaatcaaccagacgagacctacatgtcaatggccaaggatcacgtgaatccgtgggcaccctgtcactcacagggttgtgaggtggctcagggacatggtagggagcacagactcccgagaatcaggtaacccagataacacccacttcccatgaaacgcattcagcaatctttttggtctatttcaaaatcttccataatttttccctccacaaattaagcgtatttcttaaaatctaactttccaaactaaaaagatatggccaagttcaaaacttaaataaaatttccatgcaccagaaacaggatagaaacataaagtaacaagctcagtcgagacttgtgcccaagacagtgtaacaagaccggactcaccgcccgttggcaccaactgaaacctaaggtgagtttgtgaatttgtgcctttcacagcactggacatccatcaggcaatgaaggggaggggtgcatgagggacaggaaacagcgcagaagcgagctctataactgccccggagctcagccttgagacagttcccagacgctgcagcagcgaggggaacctaggcaagacccggcagagaccctggtgctcagatatccaagaccagtgaccggagaggagagagctgcatggagtggagggcccctcgagttctcagcgcagcagagactggcacatgcaggaaggaagcgcccagaacagggaaagaaccacccaatggattacagggaaccgaactggagctcacacagggccaggaatagcctgagtccacacctgccggcctggaaaccttggaacttctagggcactgggtggagcgcacagaagggtcttggctcgctagtccagtaagcaaaactggacttagcttgacactaatggcttagcaaaacaataatgctgagtggaaaacgccaggccagaaaagagtacatactatacaattccatcatacaaaagttctagaaaatgcagattaatctatggcgaaagaacaagtattagcggttgccttgggacaggggagggaggtgggaaggaacagggaggggacagggattacaaaggggacccagggaactttcggggtgacacacacgttcatcgtcttcaccatggtgatggttttatgggtaaatgctttgaacactttacacatgtgcatttatttttttgccagttacacctcagtaagtgtgtttttgttttttttattgtttgtaactgtgcaggtgaagcagctctaggcctggggactctgatacaggtttgggttcttgtggtgaggggttaaaacccaaggtgaggggaagcagaaactgggagggagacagtaaatgggacgggctataaccaggtgagagatgctcacactcacaggtaatcagggaaatgcaaattacatcttcagtgagatcctgtttcacaccagtgagggtggcaagactttacgtctactacactggtgggctatcggtgctgctctggacagaaatttggcaaaaatcagcaaaactgaagtgtttctcaccatgtgaccccattcccaagcacaccccctaagtaaacgacatgaataaccatcagtagagtaacggctgagtcagtggtggggttgtcgcagcacactaccgccctcccactttggatgtttgtctttgggtttactttcttgagatttatccatgttgattagcaccattctggttcattgactttgactgatgttatggaaagtctaaaattcttaaaaacagccctgtttatggggttactgtggggtgatggccgattacttctgaaatgatcacctgtcattctcaggccacaaaaatcatgtcaggtcctctctaaatcactatgtttgcttctacagaaaaccctttacttaaaagatacacattttcctgatttagcagagcacttcagcagaattaagcagccttgatcgaatgaagacgggtttccaagaaaataaaacattgacaacatgccacagcacatgcacgtgaagaaagcagggtgcaaatgttcacagcacaggaacggggcagggaagtggaagcagacagcagagggcccaggccatcaccagcctgcactccgtcatcacagtgactctgtgggcactgtcagagaaagagctaccagaaggactgtaaattatgctttagaaaccagcatgccaccaggagtgacttgggaggtcccagtgccccgatctgaccgagaaaggcccaggcctgtgcagaaaggatcatttggccccactgtatggcagagggagctcatgttttctggatcaggcagaaaaacagccatggacatattctgtgctataaactggggctgaggtgccttgggacccagctcttgaatgcacctggcagacagtgtcgtgttctccacaagcagagatgtgggactggctggccttcagcaggtctagtggcagatgctcccacctgccctctccagggtcctcacccctccagagctacctacggctcctcaggggctcatgaaaccacagcatcctcttggagtcaatgccatgaggccaacaggaagaaatggagtcctagaggtgggttgttttggctactcagaagctactcacacttctgtccatttaaccctaatttaatttcactctagtgagcctctcattcctcccccacaaagaccactccccattccctaggtctaagccaatccgtgcattttatgcccccccgactgctcctgaataaagcagaccgtgccagccctggcggaggcagatgcctggttgcagacctccaggagagccctggaagcaccttttaattcctcagtgaatgtgaagcaagagccctcaggaagaacagagctcttgccctgaatgttccagctatagaagaagagctcgctttggggactgagttcgggaacaggtgagaagacgagaagtgatggtgatgtgggcacaaggtcggagtgaaacagcaggaagccagcaggtgcccacccacgccagcctcaggacacggccctgaccagggtgggactcggtgcaggggttctcatctcagagaaaatgagccccgggagtggctcgcacagcccagtgttcccaggcagagcttttccaatttgtggagcagcagcagcctccccttagctcggctcctgcaagcccttctctccaggacaaccttcttggggtaataaaggagggtcccgtgcaggccccaggaggagctggaagttttcagatcagagctcaccatgcagggttatgaaagatgtgatttctgaagcaggaggaggagatctcaacataagccatttaattaagaaacacagagcagggagatgcgagtttggaaacatcctttgaagcaaacttgatcctctccatatgtatgtttcaattcatattcaattcaattcaattcaattctccaccactctggaaacagaatgttttctccttctttaaataattgcctactggtagagaaatgctaagaaagtgttaggaaaacagctatcgcctgggcgcggtagctcacacctgaaatcccagcactttgggaggccaaggcaggtggactgcctgaggtcaggagtttgagaccagcctggtcaacatggtaaaaccccgcctctactaaatatgcaaaaaaattcgcctggcgtggtggcgggcacctgtaatcccagctactcaggaggctgaaggacgagaatagcttgaacctgggagatggaggttgcagtgagccaagatatcgccactgccctccagcctgggcaacagagtgagactttggctccaaaaaaaaaaaaaagaaaagaaagaaagaaagaaaacagatatccactgctctctcaaggatcttctcctccagaacattatatgttgttcctgagattcccaatttgtttaaacaggaattttgatggaaaattaccatttgaatacaaacacccaagttctgtttcaaatcaaacagcagaaaagaaggaaaatgaagcaggccattggctattgttgatgtcaatcaaaagaaacaaggaatcgttcctggggcagcataatcctgaacttcccacaagcacgagcaccccgggacatgggcgagactttgtgcatcttcctcccccagctgggcaggacagtgcccgtctgaggcaggacgtggttcagatctgtgtccccaccaaatctcatgttgaactataatccccagtgttgcaggcggggcctgctgggaggtgactggatcatgcgggcggtgttctcatgaatggtttaacacaggggttcccaacacccgggccgtgaaccgggaccagcccgtggcctgttaggaaccgggcacacagcacacagagcggtgggcaagcaggcattcccacctgagctcccctcctatcagatcagccgggcgtttgattctcataggaatgcaaaccgaccgtgaactctgcttgtgaggtatctaggtttcaagctcctcatgagagtctagtgcctgatgatctgagggggaacagtttcatcccgaatccatcccccaccccatccgtgcaaaaattgtcttccacgaaaccagtccctggtgccaaaatgtctggggaccgctggcttaacaccatccctcttggcactgtccccacgatcatgcgttctcgtggatctggtcgcttaaaagtgtgtggcaccccccacctctcttgatctgcccatgtaagacgtgcctggttccctccaccttctgccatgactgtagctcccggaggccttcccagaagctgagcagaggtcagcaccatgcttcctgttccccctgcagaaccgtgaggcaattaaacctctttttttaaaataaattacccagcctcaggtatttcttatagcaatgaacagactaacacacagggcaacacacgagtggctcgtgatcttgggaaatttgggctagaaaaacacaagtcaaattttagttccagcaactccagagtacttggcctgcccaactaacagcacttcctggctatgaatagcaccggatgtcctgactgagaatctcattgatgatgatgatgatgatgacgatgacgatggtgatttcaacttgagacaggaaaatgtgttatgtaacaggccaccaagaggcgatgaggtttgtgctggcccaggaggacacactgaattcccagcttcctgcacgcattcctggacccccgtgtatccaatctatgtgccaagcactatgcaagagaagcattcgtgcccagtttcccaggtagagggccaagcccaggcagaggactcttcctggaccaccagggtgacatctgcaagccacaaacaactgtcctgcttgtccaggttttagatgctcggttcccatcttttcctgctgtgtctcccccgacgccctctccagccagagaccttgactgggagtggctccgagtcccccacggaccccactcacaggcacagctggtcctgctggacggctgggcccatgctctcccccgctccaggaaagccattcctaaaggcagccccactgcccggccccaaacctgccctcactctgcagcctacacggccgcccctgctcgcaccccagacggcagcacacacttgaaagcacatggttatgatcctgtggggcagccagggaggccggcaatcccattaaccagtgctcgccaggagacaagtcatgaggtcactgctgatctacaaggtcactctgggtggtgcacggatgagcactttatttcagtgacatgtgcattctaaggcatattaggaagtgacatagtcaacactctgtgtccagaatctctggctataatggcttagagtgagggaaaagtaggcatggagatcgaaaagacgtttctccacatcgagtggaggaagtgcatggggcatgagtgtgcaggaggcacacaggtggggcgggagtgagaggagcagaggacgggtatcagggccatgcctgacagcgcagggctcacaacctgccccccaaggccaggtcccaccatatgtgcggcatgcagcccttgtgccagccctgggctcagacagtatccaaggccccgcctgataaggcaggaagctgagaccagagaccccagggactcggtcacagtcacacagctaatccacaaaggagcaggcacctgagcctgagggtccagctccagagtgctcgtgacgtacagcatatgaagtatcatccgcttttccaaactcccttcctcggcctttggcctcgccctctctcccatcccttaaaacccattctcaccctctctctctctctcccatcccttaaaacccattctccttgtgcttcctttctttcttccttctcagacccctcctcttgccctgagtgtcaggaagctaagcaggcttcttccccaccagctggaggccctttccctgcacagtctcggagaggggagacagcaggccctgccgcccagcccttcaggagggacctggctcctggaatgtgggtgtagccccgtggtgcacaggagggccacgccagcatctgaaaattatccctgccctgcccacaaatgaagactggtttctcagaacacaagagtatttctgtgaactataaaaagctactggatcgacaacctattatcattgtggaagaaattactgatctgcacgtcagctgggagggtgcctggctgggccgtccgccccgcaaatccatggagccccggatcaccagagactccctcggtggccacgccccacatgcacacacccatctcagcgcttcccgtaggctgtgggctcaaacccgggaaagatgggcaggcccctctgcacatctgggccgccccacagctgtagcagcgggggtgcaggaagacacccgaggatgggcggctgcttccagctctccacgacagacataggtgcactcctggccagctgcaggatgtgtgaaaggaaacgtgctccctggggagtgcgagactcacagatggtgcggggctgcccacccaccgtgccgtccgctgctggattcacagtgtcagaagcactgctggccccggctgaccctgcgccctcagccttccactcagcacactgtgtgcataagccccagtgctggggcagggccagagagagctctgtgaccgacaagcatctgctctccctgtttcagggttgaagggcctttgaccaccagcaagtccagctggtgagaggtcaagagcacatgtgaagcccccaacccccttcaggggagccgacactctgcctctgccacccccatctcacccctgtgacatgggatgtggagatgactggcagagccccatcctgggcttggaggagaaggggctgaaagtgggggccaggtccacagggcctggttctgcaagtatcagatgttcatctcagacccttacttgagggagaagcaggccatcagcagggctgtcattctttgggggtggctgttggtgatgatgtctttacgctgagccaagcctcctcccactgacccacgtcttccaagaaatgctgaggtggggaatttatggcttcacccaacccccagagccacgcacagtcgtgacgtccctggcactgacaatggctggctaactcttgtctggaacggtcacagccatggaggagagtcccagccccagcccggcagaggaagtgtccccacgtgagctcacagggcggtgcaactgtcctcacattgcacattatgtcactgcctctatggctcctctcaccaggctgctgacctgactctgtatctgcccctctcctcccgacagggggctccctggatggctgcggaaggggtgcaaaagggggcccggggctgcctgctcctggaatgctcccacccatctgcccttcagagctgtccccccattgtccaggctccaggtgcggaggacaccggagcagtctccaaaccacaatgtctcctcgccgtggatcacctgactcccctcctccaggccagcacacaaggacagagactggccacacccagggctggagatcttcacaggactcgcccctgccctcaatgggctccgtcctccctgccttagagacaaaccagggaagacactgaccaggaaaggaacactgattaggggggacactgaccagggaggccactgactaaagagggagcagtgaccagggagggagcactgaccagggaggagcattgacgagggaggacactgaccagggaggacactgactagagagggagcactcaccagggaggacactgaccagggagggagcgctgaccagggagggagcattgaccagggaggacactgaccagggagggagcactcaccagggaggacactggccagggagggagcattgaccagggagggagcactgaccagggaggacactgaccagggaggacactgaccagggagggagcactcaccagggaggacactgcccagggaggacactgaccagggaggacactgaccagggagggagcactgaccagggaggacactgcccagggagggggcactgaccagggagggagcactcaccagggaggacactgcccagggagggggcactgaccagggaggacactgaccagggagggagcactgaccagggaggacactgcccagggagggggcactgaccagggaggacactgaccagggagggagcactcaccagggaggacactggccagggagggggcactgatcagggagggagcattgaccagggagggggcactgaccagggaggacactgaccagggagggagcgctgaccagggaggacactgaccagggagagaggacactgaccagggagggagcgctgaccagggaggaccctgaccagggaggacactgaccagggaggagcactgaccagggaggacactgaccagggagggagcactgaccagggaggacactgaccagggagggagcactgaccagggagggagcattgaccagggagggagcactgaccaggaggacactgaccagggaggagcactgaccagggaggacactgaccagggagggagcactgaccagggagggagcattgaccaggaaggacactgaccagggaggacaccgagcagagagggagcactgaccagggaggacactgacctgggagggagcattgaccagggaggacgctgaccgggaaggacactgacctgggagaagtgctgaccagggaggacactgaccagggaggacactcaccagggaggacactgagcaaggagggagcactccccagggaggacactgaccagggagggagcaccaaccagggcgggagcaccaccaggaaggatatggacaaggcagggagcactgaccaggaaggatatggacaaggcagggagcactgaccaggacgggcgctatcaccttggtcacatctcagcctgtgcccgccctgaggaccgcagggcagctccctcgctggccgcctggtgccggcagctgtggtgctttgtcccccaaggagaaagcatgatcttcggaatgagactcaactctaatcccaactccgctgtggatttgggcagcatggtgacttccctgagcctcagtttccccaactgtaaatccccacatccctctcagctgttgtaagaaggaacccggtgggcatgggcgtgatccaggtacagccgtgtgctgagcgaggctggcctgtgggccggatgtgcccgggcagggaggcgggggtgggggggggtccctgtacagcactgccctgccgcagctcccgggcgtgcgctgacagaggctgccccgctcttctcctcctggagccccttgtgaacagagtttcaggatcctcctgtcgccctccctgcctggggctgatgcccagagaccaacatgatggcaccaggtttcgggagaagacgagatccctgcctcccgaacactgtcccgcctacggcgtccacatgaagcagtgctggacggagggctcagcccacatgacggccgcgacctggagacccacaggtcctgcgggctgccctggggactgggggacgagggccaggctcatccacgctctcccggatttcggcatgcccaatgcgcccgcgggtggtgtgggaggcgtgtgcctgcctggaggccccctggacagcagccattcgcattcggatccgctcctggcgctgcaacaccactgcgtggcacacgccgcagaaacccaccggcacgcgcaccacggcctgcggagaaggcgctcccgagcaccacgcacgaggaacaagagggcgaagcctgaacatcggtaacagagcggccccgcagggaccagccacacgaaccgcggcgcagccacgcggtggaatacggcgcgaggcgggcgtgctcttcgggtttcggtttcatttttgtcctttaatgaagtagctctgtgtgctggaaggaagtctcccagagcgccgctgcggctcagaaccacactggcagcgtgatgccgtcgtgtgtgtgtaaaaagaaactcgcacacccagagctttccaatgggtgcaaatctaaacacgaggggaaatctggaaggacagccgtgggagggagggcagcggggttctcaggggaggggaagataaaccaggcctgggaatcgtggtgaaaaggacactgccagcatttggaatgtttcaggttcttaatggagatgtaattatgtttacagaattacaaataaatattttcagagggccacttttaaaagaaaaagggtgcagagccagtcctctgagaccaggagctgcgagtctcttgtgaccccacccaggaccggtcccctcagccccctgtgcttctgcctctcctgtcaaggggggaactcgtgggtggacgggttcctgggagccggacagcaacacgcgcggacccagctctgcagacacagcgtggcctcctcggccccgatgcttttgtgcacacaggacacaagggcacccatgtgaggacggccgcttcatccttctaacaagactcagcgatcattaaatggtcctaacaccacttcccacatagctaggacttcacagctgccagtgagaaagcgatgctttatcagaacctgttctaagtccccacagaggtgtgtagagattcagttcactctatggaaacccaattagaacctctatttcttgttgatggagttcctacacggtgtgaggcctgaagttaacacccagtcttccctgctgtcttgacgcctggtagaaccagggaacctctagtggcccggccaaatgcttccctcccaactctgctcctcagaataaggtccccaaaagacccccctcctcatggggaacaggtgcacttcccactcatcccagggtggtgggtttcagtcccacccacctgcagaattatccaagaagccactcacatcctcccgagggaaccagggcgccccgccctccagtcactatgccctccggtcactacgagcctgctccccagccgcacgagcccgttccccagccctgcgggtgcactctgccccacgtgcatccccgtgtggccctgtgtgcgtgcgcagggccctccatcccgggacccgagctttggcgtcttcctctgtccagtgctgggcaccccatggccctcaggcagcactgcctccctcaccaaagggtgtagagaaggagagccagcctcctgcccacacgcagcctgcaggggagaggcctgcatggtgtctgcaaggacaaagccgtgcgttccacacgcccacagccaagtcatgttttgccagggcagtgagcgtggctgctggaggagcccagagctggtatgcacccaaagggatggttttcacccctgtcagtccaggggcccaaagatgcggttcctactcccgtttccagtgcttagtggcaggtctggactcacaggacctccacaagtctcagtttcctcatctgcagaaaggtagtaaggcctctccccagctcttcaccagagctgtgggaggaagcaatgaacccggacaggaggccatctgagaaaatgcacggcatgctcagccccgggccgggctgctccagggtgcacaggaccctggcctgtctcgctcccaaccccaccctgcactttgctctttgctcagctttgggttgatgtacttgaggcctgcaggctcccagctgaaagcaggggcaacaactcacctgcccacaggggccaggctgggccctgcccaggagggcacaggttggcagggccgcagggcggggagggccgcagcctcgcatgggcagacactcagctgcggacaatccgacagttaccactggggaatgcgcccagctgtgcccgcaggccctagtgcagatttcatgtgaaatcaaccaattcgtaactgttgccagctaaatcaaattattctgctggcctaaagccatcaatttcaaactctggctcgaatgctgctcccacacgctcaggaggaacagcctttgtgttgcagacgccatgccggggttggaggtcggcgtccccctcctggctcacctgggctgcgacagacagagccgcagcgcctgtgaccccaccgggaccgaacacggagctgggagaagccagcagcaaggctgctacctggtgggagtttcctttagaaaccaaacatctgagctgggagagtgacgagtcctcaaggttttcaagtggaggacgtatagacatgaagtcaggagcggtgtctgctggattttctttaactcacatgtaatttcttatgtctacttcattcattcattcaacaaatatttactgtgtaccatgaggctgtttctggaacattcctcttggctcatcagtgtcggggcagcaagaacgcggctcagggggctgggggtagcgctgggcaggctccggaacctgaggctcactggggagtgggaggcttgtcgggatgatgccaaccaagggctctgggaggtccaggatgtggccccatggaagggctgggtttggcctgttcagcacttaagctgttttgaatcacttgctaacattttaaaaattgggacagttcataactttaccaaaaaaatctggatcatcagttctgtaaaaaaatatccctgtgggcaagtggcagctggggcgcagtggccccctttcctcacctgctgggcaactgccccgtgcaggggcctggggcgcagccgataataaaatgtccaaggacacatggtgccttctcctcggggactcggataacaaacccgactgcgaaggaaccctaggtcatcggcgccttctcctcgcagggggactcggataacaaacccgactgcaaaggaaccctaggtcatgtcaatgtcagcagtggcatctagaaaaataacccaggaaaggaggaccgtggggagggaatgtgacgtgggcaaagaccccagaagagggagaatgtgcttcccaggcgggtgcaggcagaggcgccaggcagggggaggctgcggcaacagcgtgcagtgtgttccccgggaactgctccctgattcatgcatgacatgtccactctggcacctggtgtccctgagtggatggccaagcccctgggtctctgcagagcctcattaagctgcacaccttcctctccagctataactggatgtttgctttcctgtttctttgattctgaatacatgctgtcctggccaccacagtctccgtctccctgcggaggtcacaaagtggtctcggtctcggtctccctgccaaggtcactagttataccctcaagggtggggtgggaggcaaaagccgcttcaggtggctgggtcagctccccatcgaggctttccactggacagggaaagggcggacctctgccctgtccacacctgctcttcttctccccagacaacttcctccttccagggctggtatcctctgcagctcctttgcacccacatcccccacccacaccctccggctccacaagatcatccaagaaccaggccctggaggatccttctgggtgcctccccacattctctgcgccagtggccagcaccaagacccccgattttctgtgctcagtgaagtccctgctaccctttcctggtaagagcatcgaaacattcaccccaggacaagtgagggcatcagagaaatggtggcatcatcaccacaggtcacaactcagatgtccccagggaccatccaggtggggatgatggcaaactccgggggggccaccattcagccccactgtcctgccacacagcaggtcagacctgcaccgcgagaagttcaggtttcaggaagaagctagcaattctgatgctaaggtaagaatcgtctgatgtaaatattggccactgtcttgaaactgaaacagtgtttgggtcacctgcaggctgagtggtgcaaagaccactgcccggcaggctccggtccaagagcgagcaagcctgccgtttcccaaatgactgtcgcatgcgatctggcagccagcagcccctgaggctggcacacacaaggttgttctatccctgtcttacagataacaaggcagctctggagggcgggtggtttaccccaaaatcacagttcacctaggtgtgcacctggggctgtttctgagctgcccggcccaggcctctattagttccctgccctggctcaaggggcaggctgcccacggtggtgctcacaggacgatcctaggtccctgcaagtatgagaagcgtgtgagtattttgtttaatagttaagtatataatgcatttttaaaagggtgtaccaaacacatgattttatggagattactgcttaagactttgcccttaagaaataatatacatttactttaatgtataaacatatgtaaccacacatcaaaaccatgattcaccctgtgttctttttaataagagaatgtcagctccttctgaataaggagaagaaggggaggatgaagagcaggagggagaggaggaagccactgacttctccgcaccagttgcacgtctggttgacaaaacacctcaaatccctgtcctgttaatgacaaaccccattcatctcctccagactcctgggaaaaagcatcagagatacaataaagcggcccctgggagcaggagccagttcatgggtctcaaactcaggctcctacaggggccgggaaggtcatgcctgagggtgccgctggtggggtggggctctggaaacagagcagccaggtccctctgtggcccttggtgtctgttttgttcataaaacagggacagaatgatcctatctgcgccggcctcagggaccgccggcagggccaccagcacagctggccggcagcaccttctcagatcctctatttgccaagggaacatagaactccaggtttttatgtggcatctcccagctttgaaatgtctgcaagtaattcattattttaaagcagaaagccctgtttgggcccagctgagtctgggccctttcccagcgtgagcctgggcttagcggcaggggcgtggaccagccaccctcctccagggagtgccaccccagccaaggcgccccagggttgggttcgggtgggtgcgccccatgtttgaaacggcaaagcactcagagaggaaagccttcaacaaacaagtgaccccctcagagtccacacagccagcctccaggaccagatgttcagagctgtcccttgtcagagctccctgcagggaacaggactcatttgtctttgaacaatctttccatctcaggcacggccatcgtgaactctgtgtgactttttcacaactttctgaataatgaccgaagatggtctagaccgggaaatctatttttatggaaaccctcctctcaggctgagctggcttttcccccatttccccggcgttgaaagggtcaccccgtgagggtcctggtgggactgggggctgagctggagcctgcaggggccaggagcacagggctctccgcaccgtcccggctcagcgggcagtggctggaggagcacagggctctccgcaccgtcccggctcagtgggcagtggctggaggagcacaggactctccgcaccgtcccggctcagcgggcagtggcctggaggagcacaggctccatgcgttcctgctccgcacacagctcggggccttcgacagaggactagactcagcagtttcctggcctctcccgcaggcagttccctctgagcttggcctggagaggctctggggagatgaccataggcttcctcctccctagggggacagccttgctccctcctccactcgaggccgtaaccaccctgctccatctgccccaggtgtcggcctgcgacctagtcttttcccttttatgttttgcaattatttaaaaatcagaagtttcaggcaaacagttcttctgggaaaatcagcaggttgggggacaggacgggtctaggggacccatcacatcaggtttgcttctgaccctgatgtcaaaggtcagcctacctgtcactgccgtccccctcacctgcaccccggctgtgctctcgtggcagagtcagaggcaggttgcccctccatcacctctgcctccagccatgaggaaacagcccgtgctgatgagtgtccacctaccccacactgtgggccactccagtggctgagccccaggggcatttccacttgccatgtctgccccccgactgtagtatcggcccctctgttgtctggccccagtcacagagaagaaagatgctctcagctggatgggcctgggtgggaataagcagggctcgttcccttgtgggaggagtgtcggctctgcgataccaaaccagagtggatgcctaacaacccggaggtggcaggcaggcgagatgcaggtttgaaggttgagaggaattctaacacatggctgccctgcgccatctgccacctgccctggctcagcgcacaggccctcccggcactgtggagacactgggctatgtggatgggggaagtccagggcttccagactgctgggtcatctgaacccctccacaggggcctggtgatggtccccacacgtctcaacagttagagcaaaaatcagcagaaaggggccaaacccccaaatgatgcagtgagtgagacccagtgtagtgagtaagacccagtgcagtgagaactggtgtagtgagtgagacccggtgcagtgagtgaggcctggtgtagtgagtgaggctccatgcagtgagtgagaccccagtgcagtgagtaagacccagtgcagtgagtggggcccggtgcagtgagtgaggccccatgcagtgagtaagatcctggtgcagtgagacccggtgtggtgagtgaggctcagtgcggtgagtaagatcctggtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgaggcccggtgcagtgagtgaggccccatgcagtgagtaagatcctggtgcagtgagacccagtgcagtgactgagacctggtgtagtgagtgagaccccagtgcagtgagtaagacccagtgcagtgagtgaggcccggtgcagtgagtgaggccccatgcagtgagtaagatcctggtgcagtgagtgagacccagtgcagtgactgagacctggtgtagtgagtgaggctcagtgcagtgagtgagacccagtgcagtgagtgagacctggtgtagtgagtgaggccccatgcagtaaggcctgggacagtgagtgaggcccggtgccgtgagtgaggcccggtgcagtgagtgaggcccggtgccgtgagtgaggcccagtgcagtgagtgagacccggtgcagtgagtgagacccggtgcagtgagtgaggccccatgcagtgagtaagatcctggtgcagtgagtgagacccggtgcagtgagtgaggctccatgcagtgagtaagattctgttgctgtgagtgagacccagtgcagtgactgagacctggtgtagtgagtgaggctcagtgcagtgagtaagacccagtgcagtgagtgaaacctggtgtagtgagtgaggccccatgcagtaaggcctggggcagtgagtgagacccggggcagtgagtgagacccagtgccgtgagtgaggcccggtgcagtgagtgaggcccggtgcagtgagtgaggccccatgcagtgagtgaggcccggtgcggtgagtgaggcccggtgcagtgagtgaggcccggtgtactgagtgaggccccgtgcagtgagtgaggccccgtgcagtgagtgaggcctggtgcggtgagtgaggcccggtgcagtgagtgagacctggtgtagtgagtgaggccccatgcagtgagtgaggcccagtgtagcaagtgaggcctggtgcagtgagtgaggcccggtgcagtgagtgagacctggtgtagtgagtgaggccccatgcagtgagtaaggcctggggcagtgagtgagacctggagcagtaagacctgatgcaataagaccctggtgcagtgagtaagacccagtgcagtgagtgaggccccatgcagtgagtaaggcctggggcagtgagtgagacctagtgcagtaagacccggtgcagtgagtgaggcccagtgcagtgagtgagacccagtgcagtgagtgagactcactgcagtgagtaaggcctgatgcagtaagacccggtgcagtggttaagaccccgcctcccgtgaatgagaccccctccagtgagtacaaccccctccagtgagtaagactcgctgcaaggctgaaccctgctgtccccatgcctctccaggggcctgatataaaggggccaggaacaggagcagcctcaccaaagttaatttctttttatttttaaacccaaataagctttgttgtttttaaagcaggtaaacaaaaaggagaccaggagaaccttagtagtggtataatgtgactcggttttggcttgggtgtgaatcaatctccaagcaatcatcttgccttttatagatatagtgaaaataattaactaggagaataacatttttatctacattataatttccacttataaaacgttcatgtctgtgtgcataaggcataacaggtctatatctaggaaaatggatccatttttctccttttgatttggctcctattaacattgttataatacagtttcttcgataaataataacaacatcatactatgtcagtgattgactgctgccctgtttctattttcaaacagacaaccagacatcatgtgtgggggcagctgctaacaccccatcatcagttaagcacagagaagctgtgtctcggctcagtggatttccttcttgaggcataaaatgcagaggcggtctgaaggtgcagactgcagtctcaatttattctacgtagaaaacagacgctactgaagtcgcacttgcagtcagaactccgggcccctcggggcgtgactgcccagctgtgtcacccggagcagctcatgctgcttctaagctcagcttccttgttggcaaagggccctactgtgtggcacacgccgtgcacgtcaggacaagcacaacgcatggcgcacaccacctgctgggagaggcaattgtgcactctacagccacagggacaggacacagcgcggtgagcccacccggtccaggagcgctgggaaagggccccaggagaggcagcagagctgagacaggacgacgaccaggagcgaccaggaaggggaggaggagagtgctctgggcagaggggacagcgtgtacaaaggcccggaggtgagggcacggacagaggaggagagaggttcaagatgaggctgggctgaccacacagggctgtgagtcacaggtcagggtctgtcttcactctgagtgacaggggcccagaagactccacagcagaggagggagtgaccagatttgcttctttaaaaggcactcgtcctgctgtggaggggagggctgaagggggcggaggagcagctgtaggcgtggggcaccagtgaggaggtcctgcaggccccaggcaagagcggccctgtgttcaggtggaggctaaggagcgggagccggtgcagtgacatttccaaggtgacgtgaccaggttggtgaaggagagagcctcaggtagagccaccttctccagagctgggggacacatggcaagcccaccctgcccagcgaggggccaccaccgtgtcctagcctcagtcattcaacaaacatgtttatggagaccctgtcatatgccaggttctgttctagactcaggaaatagcaataaacatgacagcctctctcttccccaactccctctctctcctgctcttctctctctctgtccctctctctgcctccctcccttccttcctccaccccatggagtttactttctagtgaaggagacaaagaagaaagaataagcaaacacacaagtaagacagtgccgccttccaggaaagaaaaggagccagctgatgtggcgagtggctggcgaggctgggctgggcagtggaggacagtcaggtcggcagtggcgactctgggaaggtgtcaaccatgcggggacccgggggaagagcattccattcaaaaggacaggcgtgcaaaggccctggggtgggaatgcacttgatgtggcgcagagcaaggcagacgcatggcgggagcggagtggaatgggcggggagtggcccagagtgcggcagggtgggcaggggaagaagggcgtgtagatcttacttgaaatgcagaggaagccccgagagggttcgagcacagggtgacaccacctgacggccacgtcgaatattactctggctgctgtgtgcagctgggggcggctgggaggctggcgctggcctccggggtagacagtgaaaccaggggcaaggctggtgatggtgacgatgggtaccggtggaaatcggacgtgagctgcaggtggagccggcatcccccggggaggactggcagagggtggagctctgtcctgccaggagtgccgtgaaaatgcacagacgctcacacctagatcctgcagataccacgtgtccccagccttcacccacgcggctcagggaagctgcttccccctagcagacgcagcagccgtggaaatgaccacagaggacacacggctgtgcagccctggttgggcacctgctccagggacctggcaaccaccacatcccgtgcccctgcaagcccctgtggccacccaggcccacggcctgcccctccagggccggctccagtccactccaccgggacccaggcctgtcagccaaggcaagagggacacacactcccgtcttcactgagaacctgcctggctgcctccgtcactgcacacctgcgcaacccagcccagcagaggacaagaattccctgcgttcagggggctccgaaaagacataaggaacccaaccctgcatgccacgctctgagcgggaaggaaggccgcatgtggacgcctgtcctgctcactgtgcctccagggctctgacggtgctgagcacagatgtggtgcttgggcagtgcttgtggggtgcatgatggaagggcaccctggccccagcaatgaccagctctagaaacccctccggcctggaagtccttccttcccaccccaccccagcccctgccacacaaaaacaagacaatcccatctggacacagctacaggggacccacccaacggccctgcccgcacaaaaaaagagctcgggcagggccagcctggtctgcacacggagggtgggcatgcaggagacccagggcactgcctggcacgagccatgaatgtcctggagggcagggcggggctcgtcgcgcgccatttagctcgggaggagaggaagctgcaaatgaagtggtctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataaacgtcatctctgtgatggggtggcgatttctctaataaatgtcatctctgtgacggggtggtgatttctctaataagcataatcgtcactgccccaccatagggagaggaagcagaggggccctggaggaagcacagtgagcaaccacgtggagctgcagagccctctccgctcactgctgtcctaagagggcagccgagagttcgtgtgcaggtgctggcacccgggcctgcagcaagaacactcggggaaaaggccacacagcggtgggggacgtgtcagcggaggcatcgcatgtacttccagggtaccaaagtgagttgtgaaacctcctactacgctgaattttcaaagcaggcgtcagaacccgtgagatgattcgtgctcgtggaggatctaggcggggtcgcgagtggcacaataagctgtggacctgtgagactgtctttgaatagagctgttttgtgagctctgcctccaccgccagggtggagagggaacgtctgccgcctactgaatgcctgtgtagcctaggagagggcttcagtagagcctgggggagccctgtgtgccccttgcgggggacagggttggagctggtgcctgacacttggagaaggacatttgggctgtgtctcagggctaagggctgcattttggaaagcaatgtcaccccctctatctgtggggcacagcggcaggaaccccagagccaagggtggaggctgcgataggagagaagtcaggctggttcatctgaaggcctcccttccggggcagcagttcaccaaacagacacaaatggctccccagcttcccacagggaaggcaggtaggcacctggcatgtgcggggacgaggcaatgacacctctcagggtttccgagtgttggcagaagtgacccggatgtttggtatgcagagctggcccctggggagaagccaagtcacttcctgaggttttggggagacaaggtgttgacacccaggcccaaccctgggggcacaagaatcaaagacacagagatccatggaggtggccctgggggtccagtacaatgggatggtggagaggggccccagaactcctgcagcctcaaggggaggggcaggtgggtgacctggtttaagaccaggcctgaaggaagggtgggggggccgtgtttgctaatcctggaaccttgggaaaaccaccgacaaacgcaaatctgagaagctgtgagcaatgggtgactcgtcgacagaaccgcatgggtgagggactgcatttatgtctcaagctgtgtaaatggtcatcccagcaacaggtcagaactcaccccattccagtcatgccccacagtctccccgaattctcctgcacctgggctcagacctgcaagaggctaagccaggcctaaagggatgaaggccaccgtccagtgtttgagccgcaccagggcagcacgcagtacccaaggctgccccagacgtgagtgggctccgctgtcagagcccccaacaaatgacatggcgcaggaagggagggtgggaggcagggagcagcttcgacaggaccccccaaggcagcagagcttccggcagtggagctcagagttgagaccgcccagcccctggctccccggggcccagtgtggtgagttgggatgaggtgttgcccttcctgcgttccgggctcccatgtggcctgttcagaaaccctggtgaaaagagcggccctcggtgggggccctggctgtgggcgagtgctcctctggaaggagactccgacacactgcacattgtgacagaggtggctgtaaccaaggcgaccccagaacaacaggctgcagatgcggctcagtgtctctcctacacaatagctgacctgtgctctgcacaccccggcgtattcaaagcgatgagccctcagccgcgggttaaagtactggtgtcttctgttctttacagtctcagtgtgccacattgaggtgtcacgcgccacactccatggcatccacgctacagatgccaaaggccacgggaaagcgagttcgccattctgctgaggtgggcaggctactattccccgggacgtggctgacacccctcacctgccccgatgtgcagctgaagagacccctcgtccggccttggcctcaggggagggacgatgtccagcaagcttctgtctgaccctgtgtctgccacatcaactggagcagagacaactggatacagaaaatcccattcaccaaggtgggtgccctcaggaggaagggcctgcgcacgctgcaacgttggggatgcattctgagatctagctgcattctcggagatagagccactgccccaacaatttcagcggcacagtctggaagggctccccacagattcttaatttaccctctgcagctgacaaaacacaatccccaccctccaccagaggggtccacaacctaaccccagagcctgggaatgtcacctacgacgggtccacaacctaaccccagagcctgggaatgtcacctacgacgggtccacaacctaaccccagagcctgggaatgtcaccatacgacgggtccacaacctaaccccagagcctgggaatgtcaccgtatgaagggtccacaacctaaccccagagcctgggaatgtcacctacgacgggtccacaacctaaccccagagcctggaaatgtcaccataagaggggtccacatcctaaccccagagcctgggaatgttaccataagaggggtccacaacctaaccccagagcctgggaatgtcactgaacgaggggtccacaacctaaccccagagcctgggaatgtcaccgaacgaggggtccacaacctaatcccagagcctgggaatgtcaccgaacgaggggtccgcaacctaatcccagagcctgggaatgtcaccgttaagaggggtccacaacctaaccccagagcctgggaatgtcaccgaacaaggggtccacaacctaaccccagagcctgggaatgtcaccgaacgaggggtccacaacctaatcccagagcctgggaatgtcaccatacgaggggtccataacctaaccccagagcctgggaatgtcacctacgacgggtccacaacctaaccccagagcctgggaatgtcaccacatgaggggtccacaacctaaccccagagcctgggaatgtcaccgaacgaggggtccacaacctaatcccagagcctgggaatgtcaccgtacgagagtcccacaacctaaccccagagcctgggaatgtcactttacatggcaaaagggacctttctgatgtgggtaaattaaacgtctggaggtgggaggtgatcctggattagccacatgtatccagtgtgatcccaaggatcttgacagagggaggcaggagcagaggagggggaggcacagaggctggggtcaggggaacggattcgcactgcaggttcaagtgttcatccgcactgactataatagtcaatataaaaataagcctggtagattacagcagcaggcaatgagttaacgttggaactacatcgagagctctcagaagtcactaacaaaacaaacactccactggagaaatcaggaaagaaggtggttacaacataaagaaaaatgcagatggccagttcacttaggaagcctcaccaataaccaaagctacgcagctatgaatgacaaccaggtgtgacttcctgtgcatcagagtctgcaatggcgtgggagaggcggcactgccgagccccacccatggctggataaatggttacgacctttctgaagggcagtttcacgacgcgcatcaaatttttaaatgcgtctcaccaaaaatagccgaggccgcctggaataacaagctggagggtttacacgagccggtctcaggccttggcataggacgtggcagttgcaatcgtaccggcatgcaaatgggatgacggacagagcagagtccagaaacagccacgtcgcccctcccgtgactgacggcaaaggcggcaccacagcactaggggagaggttggtcttcccacacgtggagctgggtaaattacatatccgtctggggacagtggtcagtctcaacccctactgcactgcagacacagaaacaagcagagaaggaccacaggcccaaacacgaaagtgaaaacaacaaatgttccaggtaacacaggaaactactttcatggcctcgggttaggcaggattcctccaccaagacataaaagcactgaatacagaagagcttgataaaccggactgcactgacgttgaaaactgctgtccaccagcagacaccatcgaagtcaaaagggaagaccccgtgtaagagatatttgcaatacgtatatcaaacaaatgactcatactcaaaatacacaaaaactccttaaaaaatcagtaagaaagaaaagcaaacagcacaacagaaaaatgagcagaagtcttgagtagatttttttaaaaggatattgatatccaataaacataaaaaggtcaccaacatcattcaagaaaagcaaataaaaaacagaatgagacaacattagccaccagaatggcggacctggaaaagacgggccacacccaatgctggacactgggcttctcacgctctgccaaggggagagtgaaccagtgcccgctctggagaaggcaccgggcaccagctgttcatgctgaacatgcccctcgacccagcgacgccatcctgggcagatcccacaaagaagggcacagtcaggttcaccagcagaaacgcgctcactagaacatccggcagctctgttctgctggcgtctggaaaaggcattccatggtgctggccgtgtgctgcttcttgacctgaggggtgatttcttgggtatgttcgctttgtaaaaactgtcataccatacacacatatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaaaaaatgtgtagacatttaacagagcaattctacctctgagaattcatcctacagagataacccagcaagaacacagaagattcattacagcattgtgagaatgcaaacccgaagccagacgcacaccagcaggatgacaaacgtagactattaagcagccgtgagaatgatgatacagtctgagctactggcacggaaatatagacatggtaaatttaaaaactgaagctgcgaaacggcacggatagcagaaccccatttatataaaattgtgtgcacacacacacacacctagagaagccccgaaagaagtcaccacaatgttgacactggtcatctctgagggatgggatttcaaacgatgtttggctatgtgtgtgtgcatgtgtgtgcgtgtgtgtgtgttatttaaacagcctgcagagtaggaatatcctggatctacagtgcaccaaggaatgaccatgggaagaaaatgaaccttgcttcattcacaatcaaccgtttttccctcattcacagcaaatcctagagaaataacagctgtgtgccacaatccctacgagaaagtacctgcctccaagagaagccacccgcctgctttcatctccctcaaatatggttctgaatctgagaagcacaggaaagtgactgtgtgtaatagtccgcaactggaaacagccaaattatggttacaaggacgagtcagcggtggcctattcatataatggaatatggaatagtgacgagtagcatccagccgtgaacactgcaatatcccctgggagactctcacctgggagtctcccgggtatattggcgatgcctagagacgtatctagttgtcaaacctggggaggggctgctggcatcaagtgggtagaggccagggatgctgctccacaccctccctgcaatgcccaggccagccccacagccacagtgccccaacaccaatgcatctcaacacagcagaaccagttcccttggaagattaagccccagaaacacaagccaacttcaaaaggccaaagtctggattccactctatgcctgggaacctcctctgttccggggtgacatggacgctggagctccacacggtcagaaagcgctccggagctcggctccacgcggtcaggaagtgctctggagctcactcccttccaatgccctgagagatcggacagacgattgctgacgtcagtggcaaagggctgacgtcagtggcaaaggactcccgcccccccgcagacattaaaatgagccctttgggagaataagggattccatccagctcagaagggcaggagtaatgaggccacccagccctctggagggcaccgggaaaggctggaagcagggtctgtgccctgagacacagtccactgagacacagtccatggcccagccacacccgcggctgccccgtttgtctgtagagtgcaggctccccagcaggggagaagcacagatgacacctcactgaccattcccacttgccctctgcagcctgagggcccagacacactgatggcactggcgcaattgacatgaaccgggcacagtgacacagtcacgtgtcccaggacctccgtgggcttccgtggtgcagccctggggcatgtggagtgcccagcctcacccccaggctttaccaggtgccccctcagagcctccaggatgggcctgcaactctgtccctcacaccctggggagcttgcaccccattctgtgccagcaaaagaaggtatctcaggccaggcacagtggcccacgcctgtaatcccagcactttgggagacggaggtggatggatcacttgaggccaggagttcgagaccagcctgaacaacacggtgaaaccctgtcactactaaaattacaaaaattagcagggagcatgcccgtaatcccagctactcaggaggctgaggcaggagaattgcttgaacccaggaggtagaagttgcagtgagccgagatcgtgccattgcactccagcccggatgacagagcaagactctgtatcaaaaaaaaaaaaaaagaaaagaaggcatctcagcctcgggcctcaagacctcagcccatgttgggagaaaattcctgcagcctccatgtcacggttccctgacaacgatgtgggggacaaatgtgtgactctcttctgagttcacctcctcctcacggcccgtgacagagtgccgccaggggaaatcttcccatcagacaaatcactttaacttagaagagcaggcccccgcaacatcctcagaaatataaaagcaaccttcaaaagaaaaaccccaaaaccctagagaacgcttggctaagacaagccttaattaccatcctctttcggtatgataaaaattcctctccacctctcttcaagacaggattccttattcaaacactttctttttttaaaaataactgcagtaaccaaccattaaaacggggactgcattttaatccacgctttctttttctctggttttcaaactggcacctttcatacttcacagaagacacaaacatggccttctacaaaacttccatccacggcatcaagccccacagggcctgtaattcactggagccgggaggtgagaagtgcctgcagagacggttcccccaggccaccatgccgtccctgccctcgggccacagccagcaggcctcaggaccagtgagaaaatggcccggagagccctgcccgagcttctcacacagacacgcctgctgcattgctcccttcccattgctcccttctcgtgtctgggaggcctgaatggtgcctcaaggaaaaggagtacagtcttgcatcacttaatgacaaggacacattgtgaaaatgcatcattaggcgatttcatcgtgctgtgaacatcacagaggggacttacacaaagctagacgacgcagtccaccacacacctggctgtatggagtagcctattgctcctaggctacaaactgtgcccactactgtactgaatgctgccagcggctgtaacacaatgggaaggatctgtgcattgaaatacatcaaaacatagatgaggtacagggaaaatctggtcttacagtctgatgggaccactgtggtatacgcaatctatcactgaccggaacatgactgaaatgtttccaaaacacacaggatgctcggttgggtctgctgcagcaccagccacactggaaaccctggtggctttagggaccactagaagccacgctcgacctcccctctgccaggaaagccagcacactgaggagctagccatcaggcaccagcaccaggctccagccctccatgtgggcctctctgaccctgacgtcacagagaaccccagtgacccggccagcggggctgcctgcacctgcttcctgcacaactccccccaggccgctctgccgggggcaggaaagcactgtccctcaggggtggctaattctaggctttgcctctcccaaaaccattactcggatcatccagatgctaaccccagatacatcattcatctctcagatccgttctgtcttcatctgtggtcgacagctcatcaggttgaatcttcagaaatgacttaaatccacacaccagggtcaggagcagaaggcggctagctggggaccattctgagttgtctatttgcagagactggtcattttctccctgctgtttgtcacttcattgcccctcaacactgcccgagggtcaacataaggggaagaagaaggtccatctgcaggtaaatagaaactttctgggtttccagaacagaggctggaccgcccactgcaggaatatgcaggttcacagggtcatttgctgcaacaagttatttatacaaaatatgggtaacaacttaaatgcccatgagtaggagatgagctgaataagccggcgatggttcagtaaacccacacagtggggctctgcgcagctgagaagctggaaggcctctgcggatgggtttggagtgacttccaggataaactgagtaccaaagagtttctatggtataccacccttcacaggagacagaaggggctatttaaaaagtacatgtatctgttcatttggcacaaaagagatacaaaacacacacacacacgaatgggaccggcttacctggggaagtgggtgggaacagggtgcagggaatggaggatggagacagagcgggggtgcgccgtggctcggaggaagccttcagaaccacacgatggttcacatacccctcaaatacatcaacactgaaaatcaaccaacctgtgggggacccagaagagagtaccagtgacagcagatgaacttgactgtgttctaagtgacactacaggaagggaggcagaagaaaggagccagctatggaacgcagagaaatggtatcttaactacatggtgtaaggctaaaagcagagagggtgggaacaaacactgtcccctcatcaggacatacgtttcccacaagggtgtgggttagcaattctgaacctgtgtgtgcagcacatttatacaaataaaattattgagaataatgagagacaggtttcctactttgggagaaagaagaacatacaaggaaaggctaaatgaatcccacagtcttagaccagaaacaggtatcagaatgcaatcctagtttgcaacacagacacacatacagacacacagaaaaatgcaggaagatgcaggtgcatgcgtgtgcttctgagagcacacacacacagatttcccggctctgtccaccgagagaggactgagaacagtgacgctccagcagaaatgagcacgcctgtccctaatcctgctttctaaacgccattctccaaccaaaggcaccagggctccttagggaaagagccgattccatgagcccagcatatctttaatgcctgaatgtaaggagggactcagaaaatgagggaggcatcaaaggaggcagaaaccaactggacagagctcccgacggtcacggccgcgacaacgggagcaacagaatccgtaatgatagagccggacagcgccctgtgggatgaaatagtacccctgagtcatagcaacaccagcaactgaataaataaatcacggtttgtacttatcacagaattccaattaataaatgcagaaggaatggtggaaatagaaagtcatcattaggcaaacattacagtcaaaatttttgcaggcaagagcaatcaaaatgtagaaattcatgaaggaagatgagctgaaggaaggttgtgtagtttcacggtatctccccaccaccaagatatttattctaggcaaaggggaaaaccatccctttacagtgggttcatctggcagacaccacctcactcatgccatccacgtgagcgttaccggcaacaatgagcattcacatcccatatttgctatgctggagccgaattgctccccactaaagtcacctgttgaagccctaacccccaagacctcagaatgtgacagtgtttggagtcagggtctttgaaggggtgattaagataaaatgaggtcattagagtaggccctaatccaacgtgaccagtatccttataagaagagatcagggccgagcgcggtggctcatacctgtaatcccagcactttgggaggctgaggcagaatcgcctgagcccaggagttcaagaccagcctaagcaacatagtgagatctcatctctacaaataactgaaaaatgagcagggcattgtgatgcatgtctgaggtcccagattctcaggaggctgacgcaggaggatggtttgagcccggcgatcagggctgcagtgagccgtgactgcacctctgcactccagcctgggcaagagagagagactctgtctcaaaaaaagaaaaaatggaagatcaggacacagacacgcacgagggacgaccatgtgaggacatagggagaagacactgtctgcaagccgaggagagaggccttgggagaaaccaaacctaccgacaccttgatcttggatttccaacccctagaacaacaagaaaataaatgtctctcgcttggtagcccacaggccgactcacacagcctgatgctgcgataagaaaggaccatttcacttccctggcgttcttgtcaaagacgcacagcatcggcctaatcaggaggaagcatcggacagtgaccagggatgctccacaaagcaccggccggccgccgcgaagtgtcaaagtcatgggagacaacgggaagctaagaacccgtacagactgcagttgcctaggagacgtgacaactaaacgctctgtgccagccgagatgagaccccgggactgaaaaaaagctgcaagtgaggaaactgacaccattcaaaaaacgtctgtcgttaatatcagtgtcaatttactggtttcaatcattgtacttaaaaataccaccatcagggaagacggatgaatgatctgtatgtctgtagacatacaggggcattctgtactattattgacattttttttctgtaactttaaaatcatttcagaataaaaagcttaaaacattgaggttgtaaactgttgacctcctggctgaatgcaacccacacatagggtttctttgacaacactggaaacaaatttgaattagctgccaacaagacacatccagggatataatttaaagcccaaattctgggctgctcttcgaaagtcacaagctgtggtgacggtgacaccccaaggaggccaaaacccagcccgaaggcaccctgtgtccagggctgctcctcacactggccatcccgggcctggcccctgagagccacacctagaggagggcctagtttgaggaggtgcccagtcctgaggacacaggtcccccgcactgcacaaggacagagcctgagggcttcttcacggtccaggggcctcggataaatgtccagggttcagccttacccagggcttcatgtgagggcatccacagctcgggcaactgcctcgttcagacctggcccatgtccaggtgggcatggccaacatttcagagcactcagcttacagacctccttttgccaacagtgcctccgtttccctcctcagatcaccagtgccccactgcgtgtgagcctggggaaccaaacctcttccctgacctcagccctggggtgctattaggcatgcatgaggggcagagccctgccctggccggagcttggggtcctggcctggaacatctccctgaagcaccctctgccctggccggagctcagggtcttgcccctggaacatctccctcgagcaccccctgccctggatggagcttggggtcctgcccctggaatatctccctcaagcaccccctgccctggatggagctcggggtcctgcccctggaatatctccctcgagcaccccctgccctggatggagctcgcggtcctgcccctggaatatctccctcgagcaccccctgccctggacggagctcagggtcctgcccctggaatatctctctcgagcaccccctgccctggacggagctcggggtccttccctggaacatctccctcgagcaccccctgccctggatggagctcagggtcctgcccctggaatatctctctcgagcaccccctgccctggacggagctcggggtccttccctggaacatctccctcgagcaccccctgcccttgatggagctcagggtcctgcccctggaatatctctctcgagcaccccctgccctggacggagctcggggtcctgcccctggaatatctccctggagcaccccctgccctggatggagctcggggtccttccctggagcatctccctggaacaccctcattacactcagtcccttccagaatttgtggtagcctgagcgatggcctggctttgggactgactgacattcaggtggagctgaggccgtctgatgagaaaatgtttgacaacagccatcaaactggcagcactgggctctttgcaatacgtatttttggtgcttattctaattctgaaatttcccaagactctgcttcgctcattccttgctcccttctaaggaaaaagctttcatcttcattgacctgggaaactgacatttcaatgttgaattaaaacttcagcttttggttgaacgcagtgagcaattttgactgaagagaacactgcagattctgaccgatcgtcgtgtcgaaaacccctggcgtcccagggtggtgtgtgggtagcatccctgtccagagcctcagtggaactgctggaaaggcctcctgcgtagccctgggtgaggcaccctggagacccgctctgcccaacagcatagcctgagctgccgaaggtctcagcccactgggtgcccctagagccgggtgggacagtggccagaggtcagggtgaccaaggaggagcagcaggagccggtccaccagaggccactgctgagtcggcccaaggtcagggtctgaatctggattatttgatagtttggggagcaaacaatgttaaaaagcaaaatcctgcagaggcgtctgtgcagggctctgaagtgtgcacacccgggcacaggctgggccaccacggctgttctgaaccggaggcctacgagtctgtgccccggccttgctgagacgctgcctgtcatgtcctcaggccccagctgggctcctgcccccacctgcaggacctcacagaaccagaacaacccgggagccaaaagcaaagtccctctcaaacacctcagtctgtcctgaaagaaaatgactgagcgtactgagaaagggtggtggaaatgaaacggctgtgctttgagaaagaagttccacgagaatgtcaacacctctgctaacagaaacgatccaggggtgccactaaacagcgttaagcaaaatacattgatttgccctttgtgtgtaaaaggcaaaaccctccatatcagggaggtgggctcttttctattttattttgcaccggtcataactgactcaagctggtttcctaagaaaatagaagagcgggattgtttaacatacgggtcctcgtggcctgaagtcagtgaatgatggggcagcacgagggaagcgctgcgtgaggcggccgacccgaggtggagcttccctcctgtctcactggtggaccctctcggtgggaaaccgcggggatgaaccgatctctaagactaaggttcaccaggcaccacagggggcgtcctccacagcaggggcaaggcgggatttaaccaaaacccgagccgatgcccctcatcccggcgtgaagggtcagacatgcagacacctgggagaatgcgggcctcagccctgcaatctaaccacgtggctgtgattcagtttactgccaccctgccttcctgggagctggaggagtgggagaggagggggctgcctgggcgggagagcggataggcgtgaggcccctgggtgaggcaccctggagacccgctctgtgcacgagagggagaagccataccagacaaaacaaatcactttccactttccaaattccagagctcctacctgccggccctgcaaggatgggatgtgggtgtgtgtgtcggtgtgtgtggtgtactgaggctgggtatgtgcacatatgtgcctatatgggtgctggatgcaggtacatgcactgggtgtgtactgagtgtgtgtctgtgctgggtgtgtgtgcactggttgtgtgtgtctgtgctggctgtgtgtatactaagtgtgtgtgcctgtgctgggtgtgtgtgcactgagtgtgtgtggactgggtgtgtgcacactgggtgtgtctgtgttgggtgtgtgtgtactgagtgtgtgagcactgggtatgtgtgcactgggtgtgtctgtgctgggtatgtgtactgggtgtgtgagcactgggtgtgtgtgcactgggtgtttgtgtctgtgttggtgtatctgtgttgggtgtgtctgtgctgggtgtgtgtgcactaggtgtttgtgtgctgggtgtgtctgtgctgggagtgtgtggactgagtgtgtgtggactgagtgtgtggagtgagtgtgtgtgcactgggtgtgtgtgtctgtgctgggtgggtgtagatggggtgtgtgtggactgattgtgtgtggactgggtgtgtgtgtgtctgtgctgggtgtatgtggactgggtgtgtggggactgggtatggactgtgtgtggactgagtgtatgtggactgggtgtgtgtggactgtgtgcactgggtgtgtgtggactgggtgtgtgtggactgtgtgcactgggtgtgtgtggactgggtgtgtgtggactgtgtgcactgggtgtgtgtggactgggtgtgtgtggactgagtgtatgtggactgggtgtgtgtggactgtgtgcatgtgcatgtgcatgtgtgtgtatgcgtgtgcatgtatgctgtgtaacctcactggctgtgtggctctcctgcagccctggcactcaagctgtgctctcatctcctgcctcccctctctgcccgtgccctcccctctccacttgcccccgcctcaccttctgggatgatccctgactcctgctcttcaaagtccctcaggccctgtggtcggctgtgcttcacagtgcccacctcactcacaaggacaacttcaacctcagagcacacagaggttccagagtccttcagaacaagcctcctgcctttacagacttttttttttttttgaggcagagtctcactctatcgcccaggctggaacgcactggcccgatctctgctcactgcaacctctgcctcccgggttcaagtgattctcctgcctcagtctcccaagtagctgggattacaggctcgggccaccatgcccggctgatttttgtatttttagtagagacgggaattcaccatgttggtcacgctggtctcaaactcctgacctcaggtgatccgcccaccttggcctcccgaagtgctgggattacaggctgagccactgcgcccagctacagactcttgactacaggcttgacacgccgcggggcagcactgccctaccctcaagcccagaagctccaagtgtctctgctgcatgtcgcagccacatttccaaacataggctgagcctgtggagtgcaccctcactgacatcacggcagaggggacagcctgtgcaggggaccaggattctctccacacaaagagaagacacaaatgtcaactgcacaactgcaagacagggcactgactccggcacagcactcactcagcaagcgtctcctgagcctccacgcagtgccaaggccactgcgggcaggggggaagggcagtgggctccatgctggatctggcagcctctgagaagctgcaggccatttaagggattactgattagcataaatgattatagcatacagagctgagactctgtgctaatacagcgcaaagaccgcgtggagggaggttcccttctgtgcaggccgcagagggcttggaggagagaaggctcctcctgagatgggtgaactcagacagcagatgggtgagacaggcccaccaggcacagggaacgacaccagcaatgacagcagctgtctgctgggcttggaaggagagccagaggtgcatggaaagccgggcgggaaagacctgctagacatctgccgacaggcccagagtgtaaattctcctgcagggaaccttgagtcccagaaggtctttgaataggtaagtagcaccacctgatctgtgtgtttgacaataagtctgtaaactgtggggagaatggagcagacagaacacgcggaggctgctggtccaggtgagaagtcactgggaaggagagggacaccgggaggggcggaggaagcaaggcaggggacacactgaaaacaggctcacggctggtcacatgcagagaggaagggcaaggaggctgaggtgaccagtctcatctccaatcccctctccatctccattcccatctccatctccaactccatctccatctccaactccatctccatctccaactccagtcccctctccatctccatctccattcccatctccatctccatctccaactccagtcccctctccatctccatttccatctctatctccatcatctccagtcccctctccatctccatttccatctctatctccaacatctccagtcccctctccatctccatctctatatccagtcccgtctccatctccatctccattcccatgtccatctcaatctccaattccagtcccctctgcatctccattcccatctccatccgcacctccatctccagtcccctctccatctccatcttccactccagtcccatctccgtctccagtaccatctcttgactgccccagctcacccagcagcacaagtgtgtgggcccctcccaggtggggcagaaacacagtcaccctggaaagaacagaagcacccacccaggtatgcgcacagagtcggccttggccatagagcagagtgaaacagaatgaaatagaaaatcctgccaggaaatgcctttagtgttaattctgaccaataacacagtgagttcttgaataaacactttgaaaaatctcactctttcagtgtcacatcaaacaccatacctcctgacatgaacctggcgtggggaacagcgcacgcgttttttaaagaacggcagcattatactctggtttctcctcagattgtatacatcttttgccttttactaaagaatggcagtgcatcggtatccccaatgtctctgtcagtcctactcactggcaaaaacaaacgacatgtggagaggagagcggttatgaagcatcaggaccaagagcttatcacgcaatgcctgaagcgtaaaaatggttttgcctgagctctgaagcatgtttctctctaacagaacacagtgctgcatcttgctgatggctaataacacacatggtaactgggatggccaaggtacccccctcctccagtaaggacacttgttataaatgaggaagatccgtgatcgctccacacgtctaggagagccacctcgacgcctcttccccaacatcgacaccgcgtggccagcccaggcactatgcgaggggcctcccactgcagctcagaaacaaaggcccaagagaaggagctccagggagaggaagattccagttcgggccggcaccaaggctgttggagattctttatgcaagcacacagacaacccagcattcctcagtgtgaaaccagatcaaaggcggcgacaagggtgaaggcaccgccactcaccaatctgtgcttgaggtggaccgtaatgagtggagagcccgacaggttctgagacagggtgggtggtggggacacctccagggaaatcaggtggctggtggcgaacagcaggcagtcctggtgatgcatggcctccgcgatccttgggaagagacggaaatcattacaaaatgggaaacgcaggggagcagcacacagctagaacctaggctgggagccagcgttccacccaaaactattgagacggaaatcttctttggatgaagctttgatttctttcattcagctcccgctgctctccttcaagatgtgaagctggtacctgcaggcgagttcaactattctgtgttttaactctgtcccttgaattcttatcttcaatacctgctctcgttaaggtgtgacgccaggaccaagaggtgagacagagccctcgacctcaaagagtttataagaaaagtaagatggcccaggaagcatggatgagcagaaatgctcaaaataacagggcatgaatctcaccgattccacttaatcagctgtgtgaccttgggcaggtaactcaccctgtctgagtgtcaatttccctgattataggatggtgcagtggccatctgctgttttgcccacccagtattcattcatcgttttcctgatcaaagcacctgccttcccctctaggtggccatccccttccccgctcacagcccacacagcctggagttgactctatcttggctcaggaggaagccctggtatctgggtctggatcagtcagtgcaccgcagccctcaggccatggggaccatttaggaatgacacccaatccagtcaaatctgaggagatgccagaaggcgaggtggggggagaatgagggctcaaagaccctcattctccctgccagacttctcctcatgccctgaggcacgaggccctgggagctgcttgcattcatgaggagggagactgattgagaagggaattgctgagagatggagcccagcaacagcaatgggatgctggatcgagctgctcctgaagccagccctctgcagagctctcggcttacgtgatccaataaactcccccttggcctaaaactgttaaagatgggttttccgccccttgcagcccaatctaaagaagcctaactgatgtctacagtggctgtctcgtggggttatgagcttgaaaagatattcagggccaggaggagggtgagggaagccaggtacctgaagggcaagattgaagaaggtgctcacactgggcacgaccccaaggatgaccagctcctttaattttgtgccctcagcccatttgcctgatttgatcccagccctgcctggcacacagcaggtcaccaagtatctgttccatgaatttgaatttggggtgactacacaaagatgcctgagacgtgctgtcaccgggccccccgcggtcacccagccgtctgcttctgtgtgggcctcacccgggtcctgtgcacctcccccgtccaccatccaaagcgctgactgactgaggaacctgcaggtccctgtttcgacacccactgaaccacctttgggacatcccacagggctctgggagctgggggcaccatatttttcctccctcaacttgtttttccttctaactagattcaaacaccgtgttcagtgaccctgcctgggatgggcggtggggctcatggagcaggagcacgtcccacctcacccccggcctctgcactgtctccttacacacatccctgagaaagagcaggcctccaagaagcacgcagaattattcctggaattgtaaatacaaagtgtttacaaagatggcgccatagagaatgaacaccctgtctgttcccgcagaagcgacttcctgcagatcatcaccagttcacagggtctggagcaaaccagggtcatcgattctcaggcctgtgagtaacaacagacgcgactgctcgacccggcaattcctctatgtgaccatgttattgatccaagcccaaagtccagatgacacacatggagtaaaacacaaacttaaaaaaaaaaaaaaatgaaaagaaagcatcaccctaggtccacgtgtctcaaccatttttttcattatagcccctctgaagaggctttttagacatttttttctaataaacttgcccagaaagttttagtcccacagagatacaagctgtacgtacagaacgtacataaacattccactctgcagagccgcagacccgggtagtatctcagatgtttccccggaagaacaacattcaccgtctgagaacattcaccactgggcatgcgtgggctcagtccccaccgcagaaagtgagggtgggctcgaggccgcagaaagttgggggggaccaaggcaaagccccgcggcgcccagcctgactcactcagcagaaccttgtccccgccccgcacgcgactccaaggccctaagacgtgtggtgtgttcgcttcagccaggagcctggttctcactctctgtgcccagtgccccgatgctcgtggccttttctgcagagctccatgaactcaacacgtgtgcaattccaccaaacgcgctggaaaaaccacgttgctagcaacacttagggctgtgccattagccagaacagaaagtcgcagctgtgggcttcaggccctaaacacgcagcatgatttgtcccttgactttccctccgtggacatttcctgatggtgcaaccggtggtcatcatctccctcccagaacagaaattcccctggggcccggatgctttcccgtttggttcactgctctccccagctcccggaaccacgcctgacacagtgggtgctcagcacacacgtgagtgagtgagcgagtggatgaatctactcacaggcaagcggcgatgacttagatccatttcttaggaaaaacataaggaaaacattaagtgagaaccttctatgaacacaaatgatatgagagcaaatctggagtggtttcctggattccgctccgggaacacgtggcctccaccaggcccagtttggtaatcagtgcgacgccagatgtcggccaagtcaagatgagaatggggccagacgcctccttaggagcattttcctccagtaaaggtggggacagaggtgaggtggggaagggtggggcaggggtgaggtggggcagggtggggaaggggtgaggtggggcagggtggggaaggggtgaggtggggcagggtggggcaggggtgaggtggggcagggtggggcagaggctgtgctggctcttcctctgccccttataccctgcctccacccgccccgtcctgtgcccatcagccaggctctgggctctctcccttcatgtgctcagcaaaagggaagccccagaaggtcagagggcatcggagcagatagtggggccaggattcttttccctcagcctaccagggcacagtcgctgccccgggggcccctccatctctgcccggggaaagccatctcttccagggcctgcctggctggccctggggaaagcagcgtgcccccattcttgttcctggcccgtgactgtgctgtcccccagagctctccactcctgattgcacctttgcaaatccgccttccttcaatgtgccccaagttactacctggccccacggagccccaccgatggtcaggctctgcgtccttcaccccacgcagcacatctgagccaaagccacgctgctgctccgccttccgttacacaaagaggggacttaaagttacatgaggcttcagaggagtgctgaaatctatgaggagacacagagacttcccagcctgtgcagaagaccggctcaggaactcaatccaaagaagtcagaccaagtggagtaagaaaaagggctgttattcggttatttggagaattatcaagtcctcacagttaccatgtcacattggggagtgaacaaacatcgcaaatgaaaatattccctggtaaaggaactccttgataactggctcctgctgacacatgcctgtgtgctcaaggaatcccctcacccatccgtcacacactgcttgtcaccttccctcagcgcgagaattcaacgccaccctgggaacacagtgtgaaggaaactccaaatcttgccaacaaggtggcacatggcagcatctctgagtgtgatcttgggtgatggtgaattcttgaaggagactgagcccctgactgacgcaaacagcagaaggagacagcatcgagggtaacaggcgacttcctcagcaccgatgctgcccaggtgacgttgttctctgtttcgagcagcactgcagccagggcctttcagaaaggacggcaacagccacaattcctgcccatgccaggagcccccgcagctttgcactgttaaaagtcaaaccagcaggaaatctgccagaaaacagtacaacgcataggcttcacctacactctcagctcttatcatttgccatgttcactttatctggcagtggtcacgctcacacttgacacacacataccacacatgtacacacacacacgcacatgtatgcacatacaacacacaaatgcacacacgcgcatttgcatgcccacagcacacacaaaacacacatgcacatatgtgcacacataacgcacatacaccacacaagcacatacatgcacctgtgtgcacacacacaacacacaaatacacgcacacatgcacatttcctttctgctgaagcactagcggtgtgttgcaggcatcacagcatactccatctctaccacgtgtctcctaaaaatggagactgcctcctatataaccatcaaacaatgatcacactcagaaatttaacgaggaccctacaagatgctctaatgcacagtccagagtcaactgcacacaccccccaccatcacacacgtcctccagaactccacttctctcaacccaggaatgtgcattagctcaggcacgaacctctttagtctcccccaatccggaactgcccaacttcttctcccttgcaatcgaaaccacagcagcacacaacatcgcttagttcaggtgtgtctgactgcttcctcgtgaggggcgtgaggccatgcatctgacaggagtatgccacaggaggcatggacgtctcccatgacgtgacagcaagagacacgggcccacaacgtgtcccacgttgataatgttgagtgtggccacctggctgcaggcgtgcggcagacatccccatcaccaggcaccctccgacctggtacagctaggactctgcaggtcggtgaggtcccccgccccgcaaccctgctcccgctggtgtgcacatccactgatagcttctgcctgggtcagttactgcactgagggctgcagaaccgtgacctactggttccatcggtgctccgtgtcactctatagtgactaaggacacacgctgagccgggtccacctccccactcatctttctcgagcacccgtgagtccctcacagcctggggagaggcccttccctctgtgggctgtggcttccatcttcacaggaggactgggagcaggccagtctcagccccgtccacctggaggaaccggctgtcccggtgctggctgagcctagcacgagcacccgtaaaagctgaacagtctccatcattgcggggccaggcagcgagtgagactcaaaggatcctaggggtacaagcagccgggcaagaagcagctaagcccccaccgggccgtgggtggtcagatatcatcccctccgtcatcacaggagccctggaatggtctgcctggggctggctgtggagacaaaagttccttccggcccaggccccaccctttgtgcactgagactcacgtactgacttagaccctcaccctcatccctggagaagaaattaaaggacactacggcaccaaagcatcctttcatcctcacaacacactgcggatgtatgaggatgacagcacacaatacaaagacaaagacggagggaagtcccctgcaggctggcaggaacccggcatatgtgcgcacataaacgtgctgcccgcacggcagctgcactaacctgcttctcatcgtgcccaggatttgataattacctcaaaggcaaaatggcacaaatgcccaatcagcttacaaaatcacaaaagcaggcacttgtatgtcatgtttaagaaaaccaagccctacttacaccattaactcattcagtcctcctggcaatcctcagaaatcagtgctattattactcctgttttaagaggagaacacaggcctccaggctcaagtcacttgcccagggtcacacagataaggagggcacctgtgaaccaaactctttgtcccctccacttccgtccacctcttctgctacaggtacaaggtacacaggtacaatgtaacaagtacagagactttactggatgagctgtttgcatgatttttttccaggtgaattttgatgacaaggcatctttgcactaagtgctgaagagagcttcacctgagctgaagatccaacttcactgcaaatgaaaaacatgttccatcgctgcacagccagttctgctttggcttcagcacgtaaatgtgctgctcatggaacatgttgtggggctggtgtcaatgctgacgaaccagggatgacttggctgtccaatttccaggccctcggtttgcagggggacgtcagagttagctgcattgttctgggacacagtggcctgcatcctggggctccagtgtcctgtctgcagacacctgggtccgtgaggacagcagagggagagtgaaggctgaggccctggggacaggcgagacagactgtcttccatctgcaaggctgtgggctccccagagcaggccccgccggcctctcctctgcccatccctgccagcgctgatctaatagagggtctggcaaagatctgcaaactgcagctcttgggctggccgcctggttttgtaaataaagctgtattggaaggcagccactcccccatttccccacgtagtgtctctggctgccttcaccctgtgagggcagagttctggaaagccaagccgatttacaagctggcccttcatgaaagagctggctgacacctggctggagtcagattctggtggtcacagtgaattgcccctgaaatgtgtgcaccctgcatctggaagcaatcctcccgcctttgtgacgttgtgggccgtggcacggatgccgctttcccacgcaggttctcactgtggccgcacaagacacagcgacacctcacaaatgcacgtctcatatatttcacagcaaggccagcttcctggtggaaacttcagcaggaggggccaaggaagggtcaccttttcattcactatcttggaaagatctccccaaataactgagatggcatctttttgaggaaaatagattgcatttttctttgaccattttcctgaagaattttggaaatcacacataaagagtggcaggccccccactttctttcattaggaggaaatcggtaagcatgcaggctttccccaagaaatctgacgcagaagacggtgtttcctccagatcacaaaatttaggactacattcctcaggaaagaggcatcccctcccctccctcctcatttccctcatcctccccagcctcgccgcccccctcatggtccccaccctccttgctctccttctgggttctcaggacccaaacccacatgaggcgatgctgcaggagccagctctgctcctatggaggggcctgtctggaggacagcagaggcagggggcagacagagcaggtctagacggcgtcctcggggtccccgggtccagccatgactgaggcccacctgctcctcccttttcagtcccctgagccctcagtttcctggccttccacttaagctgatgtgaaatggctttgcccatctgtgtgtttgcccatgactgacacagacaggtctgttgtcttccattacacagcagtggaaactgaggctcagagaggttaagtcccttgcccaaggtcacacagttctgtccaggcgggtgggtagggtcttctggcccgtgctcctgacctccactccaccagcctggccccagccttgcagttcccaagtggccttcaaaacgcttcacgtttccttgcccgagcagtgaagcgcccggtactcgtgtccagagttctcagtgttgtgcgtgtggggcgggcatccctgtggccagccacccagcaaacccacgcacacccacgcccctgagctgagcacccccgagactcacttggtgtgggcgggccagatgttgttcaggtagtagtgcatgctgtggtacagcagacccacgacggtgctccaggctgcagagagagcagaggggcaggcgctgtcagcgctccaggccacaggcaggaaaaacacaaagccccacgccccgccatgcatggtgctgcccctcactcctaagaaccctctggggagaaggaagtgaaggacactcgggcagaatttgcaaggacaaagactctgcagcaactcagcagcgtgacggtggatccctgctccatcccctgagccagctccagacatgtggaggctgaaaccccccagggagggccaggctcacccagggcatcacacggtctcagagcccctgcagggagagccaggctcacccagggcatcacacagtctcagagcccctgcagggagacagctcctgcaagtcaacagggggcagtgccagcctccagccttgccccacgagtgcatcccgtctgccctccacacgcagaggatttagggcaacactgagtgaggcagaatgcaggttttcaagggggcagcagccactgggaagtctgtatgccttcacctggtcacacctctattataaccagccatgaagcagggtcacatgtgcttttgctatttcactccatggctcggccacggctctgccaggattggaaatcagggcactcccagcagatcatgcggccaggagatgctggtagatgtcggcaccatccctgggccctccctgctgatgctggaggaaggtggcatcgtccctgggcccttcccttggcttctggggtagggacatccctgcctctgccctaggagcagggcacacctgacatcatgctagttgaggacagggcagagaaccagtcggggcacctttcccacagacaatcaagatggtggtgggtgcagagacaggctccccactgcagagagagatgtctgatgagggctgtcctggtccccatccctaaggcagaaccctgggaagggggcgtggcctctggccagggtggcaggggcaaaaatctgaggctctcccctgcttgcccgaggtccccagggagggaaggagaggaaggagatgtctgcagagtcatattcgcttttccaggaaccagagagggtgacggtcattgtagcaaaaaatagccagggccatctgggctcccaacagggctccctggtcagaggcagggggtcccctgagcctctcattttttattatgtgactcgactgaggcctgcacaggagtggaaccccaggttcctgaacagatgaacccctcacctggcccacagctacctgagcaggaaggggaggtggccccatctttttatcttcggctgaccaggtgtgtgccgatttaggaggatgtaggtaggatgacttcccagtgggccggattccccaggcgagcaggttgagatgctcccagaccccaccccaaattccagttcagtggcctggagtgggcacagcattagcatcactaaggaacctctcaagcgtgtccatgagggtggcctgaggacacgctttgagaacggctgcccacagtccctctcctgcaggacaggacaggcagtccgggggagcaccgcaggcggcccgggggagcaccgcagctccctggcgcggtgggcacccagcaaagcttggggactcttcagaaagacttgagggagccgccccggaagggagtccagcgcagccacactcaccgtgcctgtggaaggcctcgtgggggatctggatgaagctctgcccgtgggccgggaagcggtaatgggaggaattcacggtcttgggcaggattttggccacggaaaactctgcggtggaaggagcgagagagcggaagtcccgtcagagctcacaggctgcaggaaatcagactgcaaaaccccgtctgcttttcttttttgacaggacaagctccccacgggaagtataattacctttagaaagcatggcctcaaaaaaaaaaaaaaaaagggtaaagcaatgaagagcccaggcagtgactgccacggggaggctcagcattccggcccacgggcgcgcggctcctcacctggggcgccctccgccccagcacagcccccagctctcaaggccggtgcaaggatgggctgtgctcagcgatgcggtgacatcggctcctccccaagcgcagcaggcgagggcaacacggccaacaaactgcgactaaactaacccctgtagcttcagcccattttccccagctcggctcttgcagcgaagtatcagcaggataatgcactcctggtaaagacttttaaaatcgaaaggtcatcacctctgcctctacaattagacaactgtgacaattaccctggagcccagctgagagcaagctgacgccagaaacccgaggccaccccttttattccacagactcttgcaggcactgctgcttctgcctcctgctctgaaccgagaccatcatcccagggcaggagcttggctcccaagtcactgggaaaagcttatgggccccatctgcatatcatggccgaacacacctgccctcatctgaccacgggttttccttccaaatgtggtttgtgccaggcagagcagtcagggagacagagcatggctctctgctaagggtgtaaaaagacaggcagtgaaacgcagcctccagcccccgcccctgccatgtggctcacccttacaagcgacagctacctgccatggcagaggagccctccacggtgacctggggcgtgctgccgtgcaggttggaggatacatggcccatgacggtgtcaatagtgtcgatgagactcagtaccacggcgctgtcctgcagcaacacaagcaccaggagccatgaaaatccaccccactcagccagggcaccaggcaggtgcaccaggcacacaaaatcaagtttccccacgttggccacgagggaggaagaagtcacacaactgccccttcccatggatcaggaggggaccacacggaggccacacacccgactgagctcacggagcatggacacagcccaggtggacccatcaccccagccatcgccggctcctgcatttctacacttagacacggggactgaggggacccaactcctggtcctgcctcctccctgaactcacagagggaccctcagcacatcccagaccctccccctacctccctgtgcttcacgaggaggggctgatcgcccccaggtccactctgggatggggacaccagcagctctgtccccttctccatgaagggtggctgcttccgaggtgccggcacccagagctatctctggctgccttgacttcccaggagcttgccttctactccaagagccctctttcctttctgagttccagagcagaggatcctggtagacactgcccccaagaaagcagggggccctcatcctcagacacacatcaccaggggagaggcctctcttaagccctgctgagctgggccagtgagctctgccttcactgcttctcttcctgcctttctggggaagcacctgcctgctgctaagtcctcagcattctcccacaaacacgcacttcagaagagcctcatgagctggaaatagaatgctgaggccaattttagatatttgcttttaggcccatagcctgatttcagtcaccaggcccagttaagcacatggaagtctgtgtttctggcatgcagttctgtggggtagagaccgattcatgcattctctttaatgcatattggaccctgcctgagtctggacagtttcctggttattcatattttgtaacagatttgcatattttgcattcaaaagcagttaattaaaatcatgcacaaaatacgtctgcctggatacttccattggctgtcctctgggtgttcccagcctgcagctttggacacaaagtccccttgaaatcatgaaagaggtcaaaccttttaaaaaggaattgttttctaggtaagactgtatccatcttacattcttgagcctttttttctccctttgccactgttaaacctaatctcattccacttgaaattattcaaacaaaagtttatcaaatgtaaactctaacgcaatcttattaataatgagagaataaaatgccacttctgccctcaaactggcaaacattttcaaatattatcagggcttaggagaatgagcactttaatatcatggtggtgtggttgggacccttctgggccaaggcagttaagagtcctcctcacccttctctgcccctgcctggcaaccttggaaaccacatattgagaagccagcaccggaagacagatggagccaggatccctgagtatctgggtggagaagaggctcctctgactcactctggactttgcatggcagagaagtaaatttctactgtgctgagccactgagatgtagggatctatttgttactgcagtgcaccctggcctgtcctgactaatacagtgttgcaggtgaatacttagtatcattggaaagtgttattgacataattaaggaaaaacaaattaagtcaaatatacagtatatctgttgaatacatatataagtgaattgaaaactagactataaggaaatatacaagaatgttaataatctcagttttaggatttgaagtgatttttattttgttttttattatctgcattttctaacttctccacaactatttatttgttttctttttaaataagtacaatcaagttattttcagaaatataggaaaaattatttcattctcctttctagctattttgagtaaagagaacaagagaagctttttttctgcaccttaatcatgaagtacatattgtcatgtattctcctttttcttactaaatccagtgacttttaacataaaaagctttctattgtcattcaagaatgatgggatggtaaagaaaaaaaaaatacatattacatgaaatgaccaggatgaaccaagtacacatttctcatggggaaaaaaccatcatttccttcttccatgtttaggacagtaacacattactgacacacgtgcatttcttttgccttagaggacaaggcattctgaatcagttgcatgtctactcaaaatgagctcttatatcccagatgtcaggactgggagatacatcattctttttgtggatgtgactgggccatattatgccacttctaggaagacaaaatggttcccgaggcacatacgttttgaagatcaaaatgttcttttctctctctctcttttttttttttttttttgttttttgagacagagtctcactctgttgcccaggctggagtgcagtggcacaacctcggctcactgcaacctccgcctcccaggttccagcaattctcctgcctcagcctcctgagtagctgggactacaggtgcccgccaccacgcctggctaatttttgtatttttagtagagatggggttttgccacattggccaggctggtcttgactcctgacctcaagtgatccacccgccttggcctcccaaagtgctgggattataggtatgagccaccatgaccgaccatgttcttttctcttacctctgacagagcaatccaaccaggcagtagaaggatctctcccacggcttttaagaaggtctaaaggtggacaaaatgacactgctcagcacctgtccttaggcaacaaacttgaagaccttcagttttccccgcatcttccaatgggtctctatcaaccaccagttcagttttatgcacggcagtcaacaaaaatagctgagtcatggaccacatgatatgttacgaagcccttttatggacgttatcttatttgctcctgtggcagccctgtcgagtcagtgaccagcaccggaacgtcagaatgaacactgctcagtgacggcaggggccctagcacagcgcctgggggacacggcaggccctcagtgaaagcccgtggagtggagagacgtgtgggaaaatcatgacctgctggatgcgcttttcttggggcgagaaaccaaactgacgtggaagcactcgtgttcactgaaaatgacctctctagaaagcagaagctactcaggcccttggtcaggtcaccttaaaaccatgtttggttcggctcactattattctaaggaaacaatgaaattaatttctactgtttcctaatcaggagacttaaatgaaaacgtgaattttctacttcgttttaaaaaagcagactcttggacaccccttagcccacattcccataaaaccataattgaccacagctgagcggcaccggcttagtggatgtgtccccagcccactccagaccccgccatccccactgcctcatacgctcatgtccgtttcactcatctgcattattcacacacagtcttaactgtttgtctccaactatcagcatcagaattaaacttagaggctgaccgaactctcccatatttccaccaaaccgccatctccagaatactcacgttcttcctcacactctgagacactaaattcttagagcacatcatcaaaactcatcatgcatttgtttatctttatgagataaatgctttttgagaccttagagtgcaaggccttaagaattaatgaaatagggaataatcaccatcctgccttcactgagccggagcaggggcagcaaacttcttaaagtgtcacacaggaacgaggtcaggcctcatgggtcacgccctgtgtcacaaacactcaactctgccatggcagtgcaaaagcagccacagacaatatgcaaacaaatgggcatgcatgaataaaactttatttccaaaagcaagcaacgggccagatttgactcgagggccatagtttgccgactcttgatccagagcagtctatcacacagaaacataatatgggccacatctatcattttaaattttctagcagcaagcacatttttaagaagtagaataaaaaaggtgaaactaattttaataatgtatttttacttagctcaaaaacctaaaatattgtcatttcaacacagaatccatatgaaattactaattagatatttcccttttctttgcacaaagttttagaaatccagtgtgcatcttacactcacagcacatctctagttggacgagccacacgtagctaatcactgcctcacggtacagtacaggaaatgaccccttgccattttcccgtccagctgctagtggacaggtgagaagccaggacaccatggaaacttgtagaatggggccgggcgcagtggctcacacctgtcatcccagcactttgggaggctgagacgggtggatcatttgaggtcaggagttgaagaccagcctgggaaacatagtgagaccccatctctactaaaaatacaaaaattagtcaggtgtagtggtgcatgcctgtagtcccagctacttgggaggctgaggcaggagaatcgcttgaactcagaaggcagaggttgcagtgagccaagatcatgccactgcactccaacctgggtgacagagcgagactccatctcaaaaaaagaaaggaaaagaaaagaaaagaaaaaagaaagaaactaacttgtataatggatgccaaaaactttgacttctcatcaggtcagagatcactggggttttgggtaaatctgcatgactcatccccagggtccccagccagataccccaaaacaggtctacaccaggggtcccacagggatggcacacaggctgagcctgcctcgtagatgtcttgtatttggtctgcacataatttcatttaagatttctgctctccctctccctctccccctccccctccctctccccacggtctccctctccctctctttccacagtctccctctgatgccgagccgaagctggactgtactgctgccatctcggctcactgcaacctccctgcctgattctcctgcctcagcctgccatgcctgactggttttcgtttttttttggtggagacggggtttcgctgtgttggccaggctggtctccagctcctaaccgcgagtgatccgccagcctcagcctccggaggtgcggggattgcagacggtgtctggttcactcagtgctcaatggtgcccaggctggagtgcagtggcgtgatctgggctagctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccgtctaggaaatgaggagcgcctcttcccggccgccatcccatctaggaagcgaggagtgtctctgcccggccgcccatcgtctgagatgtggggagcgcctttgccccgccgccccgtctgggatgtgaggagcgcctctgctcggctgtgaccccatctgggaggtgaggagcgtctctgcccagccgccccgtctgagaagtgaggagaccctccgcctggcaaccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggtcagcccccgccaggccagctgccccgtccgggaggtgacgggcgcctctgcccagccgcccctactgggaagtgaggagcccctctgcccggccagctgccccgtccgggggggggggtcagccccccgcccggcaagccgccccgtccgggagggaggtgggggatcagccccccgcccggccagccgccccgtccaggaggtgaggggtgcctctgcccggccgcccctactgggaagtgaggagcccctctgcctggccagccgccccgtccgggagggaggtgggggggtcagccccccgcctggccagccgccccatccgggagggaggttggggggtcagccccccacccggccagccaccccgtccgggaggtgaggggctcctctgcccggccgcccctactgggaagtgaggagcccctctgcccggccagccaccccgtccgggagggaggtgggggggtcagccccccgcccggccagccgccccgtccgggaggtgaggggcgcctctgcccggccacccctactgggaagtgaggagcccctctgcccggccagccaccccgtccgggagggtggtgggggggtcagccccccgcccggccagccgccccgtctgggagggaggtgggggggtcagccccccgcccggccagccgcctcgtccgggaggtgaggggcgcctctgcccggccgcccctactgggaagtgaggagcccctctgcccggccagccgccccgtccgggagggaggtggagggtcagccccccgcccggccagccgccccgtccaggaggtgaggggcgcctctgcccggccgcccctactgggaagtgaggagcccctctacccggccagccgccccgtccgggagggaggtggggggtcagccccccgcccggccagccgccccgtccaggaggtgaggggcgcctctgcccggccgcccctactgggaagtgaggagcccctctgcccggccaccaccccgtctgggaggtgtacccaacagctcattgagaacgggccaggatgacaatcgcggctttgtggaatagaaagggggaaaggtggggaaaagattgagaaatcagatggttgccgtgtctgtgtagaaagaagtagacatgggagacttttcattttgttctgtactaagaaaaattcttctaccttgggatcctgttgatctatgaccttacccccaaacctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttctttgttcacttgtttatctgctgaccttccctccactattgtcctatgaccctgccaaatccccctctgcgagaaacacccaagaatgatcaataaaaaattaaaaaaaataaaataaaacaggttgaaaaaaaaaaaagatttcagttcactgcccatttcttaaaattgggagatgttccattttaaaaatccaggtctggggtttttcttgcaaaatcagaatcagtcaccctaacggttacagacaggtggccttgagttgctagcaactgctggctgcagaggaggcggtgcattcaggctgccactacctctctctactccccactgttgctctgtctggcccatgccatccatttcctttggcccctgaagccacatgagtttgcaacctctgactctcaggtatagctgagggagagaaggaagaaaagcagcaaggaaagtaaaagtgaccaagcttaaaaagaaagtgtttcctgtgtagacctgcattgccttgtgttgcaaaccagacagccaataaggatacggagctgccttggcctccacccacctcactgcgcatacgccatccccacccaacaaccccagcccccacacctgggctccgcagagggcagccctgcctggccttttctggggtgcgtgcctgtctggccttggccccaagttctgcttgtcctactttgtccctgtctcactcctgccagccccaccaccaactcttcccacagacctgccagcctggccacaccctatcacactcagttcagggacctgctgggtggtgtgggccacaatgacacggctaactgctgccactgcagtgtcaggtgcgagacagacccttctagcccgtgatgaagagatcacagagccaggcaggcggtgggccacagtggctccggcctgccctagggcaggacacacacttctagaaggttctgaggagtgacctttaggaccagcatcccacaggcagctttccagctaactggacatgcccctggccacaagccccacgagggcaggggcaatgcccggcacatccatcacacatccccagcaccaagcccagcatctggcagagagcggaggctgcacaatgtgcttaattaataaagtcatcagtgaacccactcatgagcatgcaactgtggctcattaagccatccattttataattaatgaagcaacccacccacaagtaggtgtttaatcaacattcgtctaattaatttatcctcactcggactccctccttccctagacacccggaaacacagagggagcctgctaagtgtctgctgcacattcctgaggatgctgcagggtacccatggctagtcagacgggagggcgcccgtgcccagagtgggtgtttattgagcgccgactgtgtaccacggctagaggggagggtgccagtgccaagtgggcatgaagccccgactgcataccttagctacaggcagggcactagtgcccggagtgtgagtgtttactaagtgctaactgcatagaaggcaccgcctgccacagtcaccccttgtagcccatctcaacaaaaacaagagtgttcgtattaataaagcacttactgcataccaagccctgtctcggggcctcacgcccggtcctgtgcatacatgcataaggaccttccagcttgtctatacccgctctttccacccaacaccccgcgggtccttcccttcggagcccggaagcgctcccacactgggcagccttggccccaccctagagctccttcatgattggctgagctggttgctaatcccactccccttggttagtgattggcccaggtgtggtcatgtggcccagctctggccactgagatgtgagggggtgtctcagcaaagggaaccatgggaaagatttccccctgacgaggagggagtctcccgacccgttctttccctcctggacgtgccagggtaaggcgagggtgctgggggcctgcagctgggcgagaaaagggccgagtgccgagagaattgtggcggtgcctatccagcccctgctgtgagtgaagactgagttagtgactcctaggattcccgcctctgggcctcttgttgcctgaagcgagtacatggcctgaagtctaagtccgctaagcagagggccctgtttctcacagccagaagtacctgagacacatgggcgatctcactgtccccatgtcacagtgggaagcaggtgtgctgaggttaaataaccttcccacggacacagagccgggagtggtggagctggggtcaaagccaggtctctgtgactccaggaccgctgagtcccgcagctccatgtagttccctttaaagcccctctcagactccatgacctgtcatcactccctcaaccctgagcctcttgaaagcagggagtattagcacttggtcatcctgcactcccagaatctagtatggtctatgaatgaatgaatgaatgaatgaatgaatgaatgaaatctgagaagtctaacttctcttacgtggacagaaaagctgagggcaacctccctccattccaagatgtctcaagtccctgaacacatggctctgcatgtgcttctttgggtgtgacttcagcaaggaaatcagtaagaattaagaacccttgaaaagtgctcaccacgtacccagcactgttctgtgcacataggaacccacttatccccgatgaagtgggcgctgttattatttcctccacatctcaggagccaagtgaggcagagatgttaggtcacttgaccaaggacacagagtaactgcagatcaaaggtcagtgcagccgtgggacttcatataccctgctcctaacccatatgctgtgctttcaaggtgagccaatctcaaaaccccttctgtcttcgcatccaccaagataagccctagccctaaaacagaagacagcaagtccacgagagcccacgatccaccctctgccttcacctggaaactatttggaggagcagaaagagaaaccatcttgattttaatgccataaatgttgcattctctaagtgtttagatagctttggggactcccactgtgcacaggctgtggcccacgccccacggctggatctgccagtgaggcctctccaccttttacctgttgccaggaggcagcagagtttatttagtctaggagttgccaaccacacgcccgcgggggccaggtggctgcacaggggggaccaggcaggttgggcattgggaaaccacagcaaagactcaagtgcccataaaggaagctccgctgagctgtacagagctggccaggagggccacaccagctggttgttcatgagaagcctgaaacccaaacgtttcagtaaaagttcctgctttttttaaactcgatctaggtcaaacagaaacatctatggtcccggtaagggtgccacgcccggtccaccagacacagacatcaaatagccttaccttggtgagattcaaggctgtctgctccgagagggacttactgggtaagctgagggatacattttggaggtaactcagtatcactccgggactttggaaggtttttctctcttctgtcaggttggttatgatgggatggtaggcatctgtgggcatctgaaagaaattggcaacatgagtttctactaagaactaaaaccaaaatattatacagaagtttaatgtgtcctactctgggtcgaatgctttttttaatttttttttttttttttgagactgagtcttgctctgttgcccaggctggagtgcagtggcgcaatctcggctcactgcagcctctgcctcccgggttcaagcgagtctcttgcctcagcctcccaagtagctgagactacaggcgtgcaccaccatgcctggctaatttttgtatttttagtagagacagggtttcactgtgttggccaggctggtctcgagctccggacctcaagtgatccttctgcctcgacctcccaaattgctgggattacaggcatgagcaactgtgcctggctgctcttttttttatttatagagatggggtttcactgtgtttcccaggctggactcgagcagtcctcctgtctcagctttctgagcagctgggactacaggtgcaaccaccacacccagctggtcaaatgtttttataccatgatagtaatatagctcctaccatgtatctgacacttttgtgaatattttgcttatattaacatttcatcctcacaacaaccttacaaaataagtccccatttgatggatgacactaagcgcagagaggcttactcaaaaataagtggtagaacttggatttgaacccaagcagatgggtcagagtctgtgcactcactattatattaacgttctcaagaaaggacagttctttaactacaaacactaattccagacaagaatttttctatatgaattgaacttttctctaacatcaaacgaaaagggcatagagagaagccaagcagggcagattcctcactccccactcacggcgcccacgtcccatgaatgagcccggtatttccttttgggcacctgaggttcctggtggcaggagttgagagttttcccttcagtcactcttagcaccaagaattagtactgcagttggcttcccctccatttgttatttcttcccagacaatgtactgccgataacagagagcccagacacctaatggaattttctctctcccagcaaacagcccaagcagaagaacatcagcaagggggaccaaggaagatgtgtctgctcaccacggggcttgctgtggatgtcatgaagaggcttggcagcgttgaagacaataaagcatgctttcctggaagaaacaatgctggattaaggactaaaacatggtcacttttttcaccacgaggaagacctgtccttgttaaaaatgtactggcttcagacacatggaagagagtctgagaatgttttgagtaggaatgttgctggagataaattatgggctaagaaatcagctgactgagtcgaccgtatagattttcccaggtcacattacttttccatttgtattctcaatcgcttttgaacacccttcatgcaagtcagcatatcaaaagatgattttatacaaggattaccgatttcaaataaataaagaaccaaaagaaatagatttcaattgcatccagactggttggagataaaatgaggagtgctacaactcgctgggccagcacagacaggagccctgggagcgctctcctctgagatcgatgaagtgagaataggccccagtaaagcagtggagaaaactgtcttcctgagccccctctagcccaaggattccagctattctttgcactcagcccccatggggttaatgatgaattattacaaacaatgaagacatttaaggctgaagactaagccatgatttgctgttctctgcctgttcacccccaactatttctaatcccactatttcctgatgagaacacacacttaaccagatattctacttcatttttggaaaatctcttgaagttgctttggatgagctgaggaaatgacatcatcaccccttgctggctgcaggagtgactgagcccttgggtttgggtggggttgggctgctggtgaacgcagaaggtgtggcgctgccgagagaactggaccccagaaccgctctgttctccaagtcagagtgacattcactcctcaggtgccaatgagttacagaggagtcatgtcaaactcacatttaactcgtgtgtgtccacaaagcagagtgagggatagtgaaaatcggtccagcgatcctgccaacgcttgcaagcgatgaccatggagactggggtgaaaatgagaatctgccaggtcctcagtcggtcccagttcccacgtgttgagtgtgtttccagtgcccaaaggtacatgctttccgattacacgtatctgaacataaccttcttcctcctctacagaaagagctgctgtccattccagtggtaagggagaggggacacctggccagggtgacagacggtcagcactgtgcctttgtatcaggaaaggccaccacacctggacggaccggtcagcaaatggtgccagctctggctcatgagattagaggaggtgtcacctctgcccaggtcactcagaaaaaagccccctctgggcacctacagccccagcacagcttcaaatgcagacaggtcttcatgtaaagaaagacttctacctacttgtgtggccatgtccccaccgaggcccggcctggctgggagcagactggatttcagttccagttgtcactctgcatggctgccctgaactcggctgtgtcagactcactgagcagtggtacacggggccccacacaggccttccagggacttcaagagccattctcctatacatgctttacgtcgtatgccttgtcttcagaccaggtcaccaggtgcaatgggattctggtcgatccagttctggttcagttctggttctggcgatgagggtttgctctgacaagaacaagaaccagaaacaagggcacctctttccagtgttactaaaacaagtaaactgtcaggagggcaggctttgtttgaagcttttcataacataaatacaagtgatatcttggtttcaaagtgacaactctaaaccctaggcaataaaatgcagtagattggtccatttttttcttctgaaggatgctatcatttgccctctgtcagtgctaggagagggaatgcattccgttttcctgggtggaagctggaagatgtaaatgtcgaaggctgtagtggacacaggctgttttgcctgcacagcatctgttccttctgagaccagcatacctgattgtcccctgggagtcccctctcctccacatgttctggacaaggctgacctcactgtcatttcaggggggctggggatgggggactatgacagagacctaagccagtcagcatattctgcactcccagacacagaaaatgactcatggaaggtgcatggataaatgtgagccaatgtgagtcctgcccagccccagcatgggaagtgataagagaaagaagctccctcttttccacagaggctgctgagggcagaggatgcaacactagaagcatgacagccaccttggcaccaggaggaggctaacaaaagagggcagggtcaaacgcagagattcccactgacatcatgtgagcacctggaccaaaccagttctgaagcagtttcccctagagcttccattgcaagagatgaaaaagaaacacatggctttcttggctaaagttatcttgaattgggttttctgtcatgcaatcaatagggtcctaacaactgagggactcaacgtcagaagcggaacgagggcaggcagcgtctggaactcaggcctttctctcctggtcctgacatccgctgtgctgggtcccaatgaagcagcagccacatgtttgtgagtgcctacatggggtctgtcattttttagcagattattttatgtggaaataaagaaacccattggggaaaaaatggtgcattcacttgtgggcagcatgaaaatggaattgtaggggaaagatgaatattaattttaaaaacagctaagaaccactggattcttgccatatgccaggcattgtgctaatggcctttattatcaacacctcccccagaaagggagtatttttatccatttaacagagcaaaaaaaaaatctgagagattaagacaaaaaggttatacgttacacatttccatttatgtggaatctccaaaataggtaaagacagaaagtagattcgtggttgccagagtctgggggaggggaaggcggggagtgactgtactcaccgggtgcggggtttccttttggggggatgaaaatgtttccaagccaggtagaggtggcagctgcataacaccgtgaatgtgccaagtgtactgacttgttcatttttaaatggttatgtttatgatatatgaatttgacctcagtttttaaaaatgacttcccaaagtctcacggctcattatggcacaatgaatatttgaaccccagtccacctacccacaggcccctgccccgaacaactgccctgtgctgaataggaagaggtatcttcggggctttccaagggcccatcccctgggaggcacacggctaacatttgttgatcaaaaacactaatggatctggaatacttgctctccaaagccttctataatcgtccatcacatataccttgaaaccccgtgatgatcaacagaacaatattcatctcaaagcatctctagtaaattattaactcctctatctcagggaacaggtgttctaacacacaactgtgtttataaggttcattaggacacatctcacgcctgcagtgctgatagctgcaacgggagagtggggagaaaggaggccgataccagggtgaccctgggaacagacagcggatctgccccagcccttcacactcactgaccaatggcagcagtgaagtacatggcgatctcatccggagtcagagcccgctcccagatgatgaactcatcgaaagcaccgttctcataacacttggcctggtcctgctcagaccctatcacgaggttgacgttggactctccatagtcacgagacacttttccactcggatcagaggtgctcagggtcccgttgacgtagactttcaggccctccttggatttccatgtaaataggacatgagtccaataggggcctggaaaagagtgaagatcgccattctgagtactgtgggaatgagctccccatgcacaggtttttcctgtttgtaggcacatccttctttcttaaggtgatcaatcactgttaactgtggtgcgtcctaatacaaggtataacacagacctgactttccccagtcctttggagcacaggaaggatgttatctttttgtccttatgccctaaattccagaagcagttcaaggagactccttgttattttaacatagtagttacaaattcaaatgcccacaagcaagtgtgattaaaatatttgaaaaatggcagggcacaagtgccaaccaatcagaccataagctcagttaagaaaaaatggtcaggagcgagacaaggatgtccccttttaccactcctttttaacattgtactgaaagtcctaactaatgcaataaggcaaaaaaggaaaaaaaaggaaataagaatataaatattgggaaggatgcaataaaactatatttattcacagatgatgtgattgtctatgtagaaaatccaaaagaatcaacaacaaagctgaaactaatgagtgagcatagcaagattacaggctacaaggttaatatacaagtcaattgctccccatctgccagcaacgaacaagtagaatttacaattaaaaaacacattaccattgtcattggtgccaaaaaaggaaaaagaaatacatatattataacaatacatttataagctatatataaagaaaactatataactctgatgaaagaaattaaacaagaactaaataaatggagagatattccatattcatggacagaaagactcaatgttgtgaagatgtcagttcttcccaaattgatctatatattcaacacaatcccaataaaaatctcatcaagttattttgtggatattgataaactatggagaaggaagagagccagaatagccaatacaatattgaaggagaaaaacaacattggaggaacaacactacccaatttccagacttactataaaaagttacagtagtcaagacagtgtggcattggaaaaaaacagatgaatagatctgtgggacagaataaacagcccagagatagaccaataaaaatacagtcaaccaatctttgacaaaggagaaaaggcagtacaatgaacaaacagaaccatttgttgcaacaaatggtgctgcaacaactgaatatccacgttccaaaaaataaaaagaatcttggccggacgcagtggctcacgcctgtaacctcagcactttgggaggccgaggcaggtggatcacctgaagtcaggagttcgagaccagcctagccaacatggcaaaaccccgtctccacaaaaatacaaaaaattagctgggcgtggtggcaggtgtctgtaatcccagctactcaggaggctgaggcaggaagaattgcttgaacccgggaggtggaggttgcagtgagccgagatcgccccattgcactccagcctggacaacaagagccaaactccatctcaaaaaaaacaaaaaaaaaatcttaaacctgtcataaaaattaattcaaaatggactataggtctaatataaaatgcaaaactataaaacccttagaagataatataggaaaaacatctagatgaccttgggtttagtgatgacttattagatccaacaccaaaggcacaatccatgaaagaaataattgacaagctggacttccttacaactaaaaatgtctgctctgtgaaagacactgtcaagagaatgagaagacaagtcacggatggggagaaaatatttggaaaagacatgataaaggactattatccaaaatacacccaaaaactcttaaaattcaacagtaagaaaacaaacgacccgcattttgggaggctgagatgggaggatcgcttgaagccaggagtttgagaccagcctgggcaaccaagtaagacctcacctgtaccaaaaaaaaaaaaaaactagtgagacatggtggcacatgccggtaatcccagctacttgggcaactgaggtaggaggatcacctgagccctggagttaaacgctgcagtaagctgtgattgcaccactgtactccagcctggatgacagatcctgtcagaaagaaaaagaaagaaagagagaaagagagaagagaggagagagagagtgagagagagagagaagagaagaaagaaggaaggaaagaaggaaaggaagggagcaagggaggatggaaggcaagaaggaaggaaggaagggagggaggaagggagggagggaaagaaggaaaagagagaggaggggaagaagaaagggaggaaggaaaaaagaaagaaaaacaatccaatttttaaaatgggcgaaagatcaacctcaccaacccatagaatgtacaacaccgagagcaaatgctaatgtgaactatggactttgggtgacaatgatgtgtcactgtaggttcatcacatgtaacaaatggatcattctggtgggggaatgtccatagtgggggaagctgtgcctgtgtagaggcggagggtaatgggaattctctgaactttgcactcaatttttctgtgaatctaaaactgttctaaaaaataaaatctattaaaatctaacagcaatacaggcactccatggcgcccaccaacccagtctgcagaggccagggagcgggtaagcacagtaacgagctttccctgaggacgtggcttctgtgctgactgcagtgcgtggaagggcggctgccccatcacgaggtggcccctactcacctcccccatcagtaacatgagagatgaagagcctgccttgccagtctttttatttccaaaagaaattggaaaatcttaattttaaaataaaatcataactaatgatcgtaaatcattccaaatatttttcttacaaacttggcctaggcaatcacaatataggaccataaaacccatctgaggacccaactcagcccacaggccattggcatcagcctgtgctctaagcgagggcgtataatgttaaccaacatgggagtgagttggtagagggaagaccaacctccctgctcattcaggaacctccatcaaccagcatttgtgttactcttctctctggcacaagaaccacgctcatcaacaagaatgttcatcagactttgactgttgattcccccacaaaggttccctttgttctgccagcatgtgtggtaagctgtcctcctgagcttgctgctggaaggaacagggcagcccttttaaaggacacacatcacctctagccagctatgcatcttagatcacccagaatgacatcagggcttcttgctcaagattgtgcaactttctgataattttgagtctctggagcacgcttggaccctaggttggtccaaagtattattgcccctgagtttgaaagtaagaataacaaacgccttcaatgcacaaaagagagcacattgccagccagaagtgtttctaattctcgccctttccctgggtggaaaagcagccagagttgagcatactttacctttgttcaaggtcaaagaacctaatggatgcctgaaaccacgttccaccagccccaaggagcagagagataagctgcttacaatcggactctgatagcaagtggaacaggaaggtcacggaaaaggttcagatggttctgtgtcaggggagggaggcagagattatttctgaccttagggatcacagagggcaaatttgaagtagatgtttgctgaactgccccactttacagaggtggaggtacaagctggtccgagcacaccgagcatccacagaagaaggcaaacaccttctgggcccactgtgccatcattccacgctttatgcctagcagcccacttagttctcacagtcaccctatgatgtgatactgctattactgccatattatgaatgaggaaactgaggcatagggcagttagggaaggtgcccaggttcacacaactaccaacgtccagaggcgggatttgatccagcctgtttgggtccagagttcacgctttttaataactgggccatgcagcctcccttaagaatgagccagaaaatggatttcccttaaatacatcaaagatgtttcctaccggaggagatcatcctaggcttttgtgctgccccctccacctctgcccttcccttgttgggctccagtcctgacttggcccccactccatgccaccctgagtccttctgtgtccccagccacctgttccccttctccagcttccacttcagaccttcgtcagcctctgcagcctactgccccacgtccatgtctcaacacccacctgcaaactcagccaatgtgcagggactcctgttctcttcccacacatccagggcccctccctcctccaagaccacgcacagtccagtgcttcatgcgctctcccctagccccttcctctgctccccgattcttcagcctctctctccaaaagcttcttctcgtcatgctttaaacaatttcaagtctataccactaagaagaaggaagaagaggagggggaggaagagaaagaggaagagacaaagactgtgagagaaaaaggaggcagatgaggaggaagagggaaaatgagaaggaaaagaaggagaaatgtaaccactgcttgcactttgcacaccatatcttcagcttaatgtcctggaaaccgtgaggtaagtactgtcaatatcatctgcacatcacaggtgtgatcactgaggtcagtgtggtcaggtaacctacagcaggcacacagtgcacgggcagacggagcccaggctctgcaccaaccaaaggcggcttaccaagggcacctccttgcctctccccatgcacctccccaacaacccttaaaggaaaggagctcgggtgccaggaggcagcagcatccctgggctccttgggctgcgttgggcttctcagcgtccattctcagagaagactccactcctccaggcagagcctcccgggaccgatgctgtcactcacctggggggctgaaggaggcctcccatgtcatggaattgtcccgcgtatacagctccacagagcctctgccaccgctggagcagactttgaacccattggagatgacctgtcccccatacgcagaagggattggtctagactgttctccttgtgtcttccagaaaaaagaaaacgtgacccctgaggaaagtcacaagatcagttattcacagagagcaggggacttgacttctcgcaagcacatggttctctttgctttttatttttcattcgaaaagcattttgtccccattctaaaggcagtgtatgttcagttcagaaaatccagacagtgatatttgctcatgtttattaagggctcacacagtgccaggcacttttctaggagtttgaaatgaattctcgccttttaaaaagtacaaaaatcctgcttcatccccactatacagatgaaggaactgaggctcattcactcaaggtcaccagtgactgatgaagatcgctgcagccccaggcagttccccgcccccactccccgggatcatgcaaatgtgaagacctacaccctccaggtttctctcctattcctccagaaatgtggttagggcggctccttcctaagcctcttctataaatagattttacaaagacacgaaccatctcaggcacactggtttataaacaacatttctataaagtttactccaccgtgaacttcctccgatgtccataaatacactgtcacgttgtcacttttatgtctgcacagcggcgcattctaaacaagcaccacagtcttttttttaaacagcaatcccctgttgctggatcttaaggttttcttccactttttgaagaaattttcaaacagaacttgaagcaaattcttttgcatatctcagactatatgcctttaggatacattcccaagagggcatttcttgccaaagggaagcacacttttaaggttgttgatatcttcaattgttcatttcccgcagttggatacagagggggcagcagctgaaacctttttcaagactctagtctgcacattcgtggtaagtcctgaccccaggcccacgctgcgggggaggagggattgcacctggactaaatggtctgagcgacgcatgttagcatgaatgagctggctcattagttcatgttgcctccgccaccagcagcagataggacatacctcaaatgtgttgtggcagtatattacagtaaattatgacaattagatattgtacctttgtgggtgcaaagtcctactgtgatcaatgtaaacatggaaaaacaatgtaatttttatgatcctcatgtgggatttctccatgtttttactataagaggaactgcaggccgggcgcggtggctcacgcctgtaatcccagcactttgggaggccgaggcaagtggatcacctgaggtcaggagtttgagaccagcctggccagcatagtgaaatgccgtctctactaaaaatataaaaattggccgggtgtggtggcatgcacctgtagtcccagctactcaggaggctgaggcaggagaattgtttgaaccacggaggcagaggttgcagtgagccgagaccacgccattgcactccagcctgggcaacagagcaagactctgtctcaaaaaaaagagggtccaggcatggtggctcacgcctgtaatcccagcacttagggaggccgaggcgggtggatcatgaggtcaggagatcgagaccatctttactaacatggtgaaaccccgtctctactaaaaatacaaaaaattagccaggcgtggtggcaggtgcctgtcgtcccagctgctcaggaggctgaggcaggagaatggcgtgaacccgggaggcagagcttgcagtgagccgagattgtgccactgcactccagcctgggcgacagagcgagactccgtctcaaaaaaaaaaaaagaggaaccgcaaaagcccagctcctgagcatgccccgcacccaccccgaccgctgttctgcactcacacccactggtctgggggccgggctctctgctgaaggggaagtcagggcagggcctggctggaggctctgtggagcttgggcctctctggcgttgcattttggagctctggttgtctctattccacttctctgcctccagtagcatctgcccacctggcccttctttgtgtgtaaactccagtgtgtgtgtgtgtgtgtgtgtgtgtgtgtgtgtgtgtgtgtgtgagacactagctgcctgtctggattctgcccctgacagctggaaatacatccagctgcctcacccccgccaagcctggcccaggcacatgggtaagagggttcagtggtgctgagagagaacacgtgcccagaactggtccaaagaggcccatgatgggacggtgggtgcaggggagaggcagaaggatatttgccctgggctttatttctataaatggtgccaaatttagactttagaccttaccttcacatgaggttatggacacagtcttagagagtcactgaattcaaagaagacatttgtcattcgtgtataaggcagtgtctcattgcccaccatgctttctgtgatgccttatgaattaacatatctgttagaagtccttcaaatgtcttgtgacaatatatcaagacaactatacctttgtgagttcaaagccctcgcaggattcaggaaaaacacagcatacattttataaccctggtatggaatttccccattttattttttaagagaagaagaacctcaaaaaaattggaagaggcctggacctttctggacctctgagaggctacggggtacaactccaagccctgcggcatctgtccttagggctcctgggaaagaaaacagccttcccgagtgcccagtaatgtgggttaccgcaaaagggtgcgactgtgggggttgcacagaggcctggggcagctgacgctggtgtccccagacctggctggcaccacccacacccacctcatgaacgggcttcctgcaacacctgccttgggcgctgaggggtacagaagccaggacaaccccccgagcctcccgccacttccctgccttgggcgctgaggggtacagaagccaggacaaacccccaagcctcccgccacttccctgcacactcagaaacaacccgtttcacaaggaagtcagcacagtgcgttgtgaaatttttgttatgaaacaaattcccagtaggattcatggaagttaattttttccaaaaactttgctgcattttaaaatttctttcactcaattcaaaatgagcctgtcttggccaaatgtctttctgttcaggaagaaaaataaaaataaaaaaattccatgtggtgttaggtaagggtagatcgaaggccatccatggtgccggtaaccaagcttttcatttagttaactcaacgcacaaaacaatgacttctacctgagcaacagcttatatttaagtatcaattcacgtcttcatagagtcataacaaattcacaatgtgccttccatattagccttttaaggaactttgcctcatggagttgggccatcaatacaacaaggaaaaatctgaaggaaaaagaaacaagcacaatattgacaaactaatttgataattttttcttgttataagcactgaatcctaaaacatccaaaaaataaaatgaggaaagatcttttttgacaagacaaaaaaaggaaaaataaaaatctaggagtcataagaaaagactaataaatttaagtgcataaatataatattctgcaaggcaaaaaaaattaccgtaacaaactcaaagacagacaaccatccagggaaagaatatttgtcacagatttactagatgagaagttaattcccttcatatgtagagaccacggcataagacaaaggatgatttctagcaggtgaggagaacttatatgggctgaggttaaatcctcccaacaacctgtgaactaggggtcattactgtccccatttcacaggggagaaaactgaagcacagggaggtgcggtaacttgcccaaggccacacagctggtctgggacgagtcaggatttgaacccaggcagcctggatctggagtctgcgtttgtaatcactgtgctgtggctcccgcccttcccttggagatcatgcatgcagctgcccttcccaggcccacagactcagcaccctgcaagagcatgatcaacacatgccaacaaagcagcggcccaggagggcgcgaggttatacaggcatgcgggcccgcctggcgtctgtacccacaccccagtcaccacagaccacacagctgaaggctgactcgggctgggcctatcagaatcaccaggactgacccaggcatgggcaggctcacctgacaaaaccagaacttggagcttctgagcggatgctgctcccacaccaggaaagcagccttgagaacagagctggagcaaggcagggacagggtctgatggccgttctggcacccggaccagcctgtggcccaccacgtttcccaaagagccacgaggatgcgcgtcccatacgctttcacgcaagactcagagcccgtttcccggctgcctcatgggccctgtgcctggtgtggccaggaggagacactcgtttgcatatcgagcctttaaaattctcactccacacccccaccccaaagccccactctaatcgcttcctgaaatgactggggctgtaggacacccactttccccatgggaataagaaattcttccctttcccctttccctgctcctctaacaaagccacacgcaggccatcctggggaatggccaccaccttcagtcacagcgacagacagcagagagtcctgcaggctgaggaaaactggaaaatgctggccctgccttaaggggcagtcactccttacccctgaccaactgctgccagtggggtgcaggggagcagttctcatattttaagagaagtcagaagtgtagatttttaaatgaaattttcccatatataaaggttgaatttttttgagacagtgtcttgccctgtggtccaggctggagtgcagtggtgcaatcatggctcactgcaggcttgacctcctgggcccaagtgatcctcccacctcagcctcctgagtagctaggatgacaggtacacaccacctcgccctgctaaattttttttttttttttcattgagacagggtcttcctgtggtgcccaggctggtctgaaactcttgggttcaaacaatcctcctgcctcggcctcctaaagtgttgggattacaggtgtgagccactgtgtcctgccagaattgaatgttaattttaaaagaaaaacactgaaagcaccgggagaaattccatttctggaaacctcgtgggctggggtatttggatccacccacctggcaggagacaatgtagaaagtctcactctaaaaacagaagatcaacacggcgcccaccaaaccaagcacgtatagtcagccgcggattccgggatgtggtatcacatgagttgcgagaatcacctggagagactggctaaaaatgccgattcccaggccttgtccactgagactcagaatcagcacgtcctggttggggcctgggaacctgcagttgctgccacccagggcctacgagctgtacttggagatacactgtgccacagcatcgtggcagctcaggctcatcttgcatcctctctgggcctcagtttccccatctgttcaaggagtgtgctgaatgaatgcttctctgaggatcatctgctccacaggcctccaagccccctgaccccagatcgcctgagtaagagagtagctagatccctgccaggcccgtgtcccccaggcccctctggaaatttctatcctaaaactccacctgcaagtatcttagcaaattgttgacagcgttttaaatttaggaaacaaatgcaaagggggaaaaagtcaactcaaagctgagaagagggaaatggccgtgcggagatgctccagctgctgcctcgggacctcagcagcctctctggggtttataagcagaagaagttcttaatgcatgtgaggaaaaagcaaaggaaacattcacagagggaggaaggtgaagctgaggggctaatcggggaggctgcctttcccaggagctgccaaagccattcacaggagagctggaactagaagcaatgggccgaagttactcgagacggaatttagcccaatatcagaaataacacactaaaagtcagaggagtccaatagcggaatgggcttctttttctgccgttgtctgtgtttttacttgttatatcaaataacatcatcttaaccgacacagcaataaatcagaggtagaaatgagagtaagcaaggaagaattacctaataatctgcaccttgatgctggaaatgaccttttttggattttatgcaatcagttccctttcatttaactttattatggtcacagacttcacatgagatctacctcctagcaacatgcttgagtgtccagtcagtattgactataggttcaatgtaggggaaatgatttctctaggagtcgtgaatggcccttgttcagtattcaagtgaaggtgcagcaaaccctggatggagatgcattcagtgtgcagtatctatggtgtgccaggcactgagaactcatcactggccaaggcagactcagtcctcgtcctcactgagctgaagaccaagtaagggagacggaagtgacaggccatcgtcggccgtgcaagttgtgggaagaaatgtagggggagcaataagggcatgagacagaggaactcacctggactggagctcatccccgtaaagtttacacttgagctgagccttcaaggtctccaggtaggtgaaagaaggtgccagaacattccagcaagtgccccttcctattttcagcttccccacctgtgtgctcactggtcaggggagttgaaagacagaatcctgagtattgagggaacagactgtgttttctaagcttaacattcaagaatggccagggatccaaacagcctttttctctccaatgtcctccaaagcttgccccattagcagcaagtgaccttaagaacatgtccccagaaggcaccatttgccaaaagacaggacccacagtagctcctagaatgaaggcaggcagacaagcagcagagaggctctggaagaagcaggggtggagggagggccgggagcgggggtccggagcagggccacagcagggacctctgccttctatgggcaccctcgggggacagccacatttctcagcatcaaccctgtcccctaaaacattatttgttaaaaaatcgctgaaaatatgaacagagaccacatcaggatttggaaatcagaaatataaaagcagtgggcctgttaggcaggggctggagagcatttctctatttaagcgttgtttttcgttataagaataacaggttataagtttgtgcccacaccaataagtgtggcggaggactcgctgaacacatctgaaaaggctaattcaatgcttcccacgttctaatcattcacaatttttatgagatctgaataacacctgaattatgattattagggaatattttcctttaaatctacccatttttaaagctcaatgctcactgaagtctcctcttaaataatatatgtgaaaactcgtttctgatgcgcccagtatattaaaataaaaacataaccattgatttttgttttagttgctccaggtgccccctgagaaggcctcctctgcctcctgctacagggactttaatttggaaaatgctgggcaggtcttccctgttcacggcttgttttcccgcacacagaagtacaagctcatcagggccccaggagaatccgcctgagccaaggatacagcagaggaaagcgggaaaggcatgccatggccctcgcacaggctcatggcccggtcaccttgtgaggctgaactcaagacccaggggggcacagtgagaaatgccccacctaccctctgcgtctgcatcaggcctcacgagagcagcctctcaccgagccagcgttgattgaaggtttcctgactttgtttcctttcttttctttttctttaagttagagacaagatctcactgtgttgccgaggctggtctcgaactcctgggctcatgcaatcatcctgcctctgcctcccaaaacactgggattacaggtgtgagccaccgcacccccggtttatatctggccatgctctaaagaaagtggccacatgaacagtatcttaaaagttctgcttaaccatgacacaaaagaaattgtcaacagcgggacatgaagcccgagttcatggctctttcttcacccatgttcttgtgtgtctcatgttgggggcatgaaatgagtgaatacatgtttgggattagaccaaggattggtgcagagtcggggctcaacaagggtatgcagctattatgatcagttcaaccacaacggcccgtctgtcagaagtcaccctccaagcaggcaaagtggtgttcttagaaaagataccctagtgatgaaggggaagtttggaatcatggacacatgagcgataaacccaaaaggcctcccgacagctggaccaaccacatgccaggaacatgctgtaatagttcttccagtcttcacagcaactgtatgggaaggtccttttattcactcactttacagatgaggcttttcaaagggaagcagtggttgcccaagatccccacaaacaggtcggaaccggaagtggaacccacgccttctggccccagagctcatgctgcggacaggctctgttcgacctgaagattattgaagagtcgagaagtctggtggggactgaggggaactggagacggaagtccagggccaccgcgacttagctccagccagccagagaagtcaggagagatttatcaagaaaaactggaaatctgtggaaatttcctatttttcagtgttgacagctaattttaaaattttaacccgatgcccgtccaaccgaacacagccacaggccagaatcagctcaaaggcctctcatgtgtgacctcggcgtgcagataaaacttgtccagtagctctgatttcccgctggtcccatcactgtctcctttcttgggttcattatctgtgatagtcccaggcattggaacccctggcacctgcaccatccttgtcctcaaatgagatcaattccagtgtggttgctggagctttctggatgcctctactccaaagagaagccgttctctagaaacccagaaaaagccaccacagatatgcccccgcccttcccgaatccaatgcaaggaaggagcacatattactctcccgtcctcctcgcccctgccaccgagctcacgccgagcccatggttgttttttactttgtaaaaataaataagcctgggatgtttatggagctgcttgaactcaggaacagcataaactatgagtttgtaaacctgaccgtggttttgggcctcataaccattgctcaaaattctggtttccacaaagcccaagatgtgtcctcccacatgtttttgccttgctaagctgttgtttatttttactggaacaaagtccattttgtcctacaatcatgtacaatgaactcatcacagaaggccatctgatgtccaaaatgccttagagcttcctacgaggactgcattaagctttgttcctccctagaaatcataactttcattttgcctaggagaaaggaacttgaaggctccaagctggtttggaaggcagagaacaatttcccagaaaatttgcaatgtgatccagacgtgcattgcctgaagcctagatacgagagagcaggttacacttcacacggtaaaagcaaacgaaagcaagtcgattgccagtttttcttttgcatctctgctctgtccatggcatgactttagccacaagcctgcgaccgcttgccgggacagttcgagccactgcccagcccctctcgatgaatgtaaaagaaccaaaaccaggcgcaagtgttcttgggtatgccctgcccgctcaccgtcaacatcccagagccagaaatcacactgcaggtgccatgccatcaatttccttcccacaaacgccacggccctgtccagtccccactgtgacatcgctgtgtctgttttttaggaaggttttttttcatcctttacaagattaagtattttgatctcacatctctgtaagaggatgttataacttccagccaccaggacaagtctctgcttagtaacctccttgcctgtattcctccctcccctgccctccgatccatcgttgacattctcacgcattctgcaattgatgagaacctcaggttcacatcttccagtcaccagaggagcaggtgctccctgagaatgaaatgcttgacaaagatgccgcagggatcagccactcaccttcagggccacactgctctggcttgctgatgcaggagctgttgtacctgccgtaatagagaagcgtgactcccttttcctctttcaggtaaatgcctttgttgaccttcccttccacaatatctaaggaagaaaaatgacaacatcatatgttaataaccttccgagattaaaagtctgaagatgtgtgtcagacctacaaataacttatgtgtaagtatgcattattatttatctaagtatatatttataacatcatatattattctatgataatattcatagcatcagtaatattattagtaattaaattgtaaattattaatgtgtatgtcagataaaaatttaatattaaatgatattaatgtatttgtatataatatgcatgtattatatacaaatgcatacagacctttgcatatggatttcatattgcatatcatatcgtatgatgatgtgataattgtgatatttgccaacagatgggttaccaagcgtggcgtggcgaccgcctcctgtcctggactttgtgccgacctgcttttcgagccctccccactcccgtcctcatgctgagtgttccaagtggaacgtttcagtgcaagtgtgaacgtgaagctacagctgaactccttctccttttgagttttaattgaaatcccctgaacctggacaggtagattcgggattttagcagaacccattttcaggcgccaggaggaaaaccccgagcaacattttgcatagtcccaggagagcctgtgggtgacaagcccagctggccgcaaatcccgaggggcactgccccgtccaatcatcttgtgtcccgttcccatggccagggtatctgatggtgagtgtgtggggtaaatcgtttacagaataaataagtgaagactgtaaaaatcaggagcgagtaggatttactgttaactggggtcataatcgctcagagatctttgctaccacatgggtcagggagaatgtctgagcccccggcagccgtcagcccagctgaagacacacgggagagctaacagggtctgtggacctgaccccaaccccagctcaggctttccagctatattgtcacatggataaccgactcaagggacctcagtgtttttccttactgcttttaaactcatttttaaattttatcccatttttgctgagggacacctatatattgcaaggttaaatggatcactagtggttgcgtaattgagctaggctgtataaacccctaagtcagactgcttgactggaaacattaattttggaagccaatcaccttacagttgaaagagcagtcagtttttgtgttgaaaaggatcacagggtaagattgacagggtcagaactggcttctatgctgatctaataaatgcctcagttgctactaccccttttgctttgagcttcatgttgagccatgtaggctctggaggttatcagataagacaataatttaactatgattcttgtgggtatatgtttcacaaacagcttttaatgatttttttaaagtccagctacagacgaaatgctgattttaatgtttataagaaatcaaatgtttgatgaggtatttttaaattaactttaattttccattaaaatggcatgcttttcctcccccaaagaagacaattcatttaaaaatccaaacaatctctatgtctagaaaaggtctcatcttgggtctgttttgttctgaaaacaagcagctggcttagacaatcctgggaacttgaaagaatatatataccttctagtgcagtggtccccagcatttttggcaccagggaccggtttcatggaagacaatttttccatggatgggttggagaggttggtttcgggatgattcaagtgcattacatttattgtgcactttatttctgttattattatattacaatatgtaatgaaataattgtacaactcaccatcacgtagaatcgggggagccctgagcttattttcctgcaactagacggtcccctctgggggtgatgggagacagtgacagatcatcgggcattagattctcataaggagcatgcaacctagatccctcacatgtgcagttcacagtagggtttgtgctcccaagagaatttaatgctgctgctgatctgacaggaggtggagctcgggcggtaatgtgagcgatagggagcagctgtaaatacaggtgaagcttcactcactcacccaccactcacttcctgctgtgcagcccagttcctaacaggctacggattgctgccagtctgtggcccagggactggggacccctgttctaatgtattgcaatcttcctttagacttaaccctagtggttattttttaacaccttggatctgctgtcttgactgggacatttgctcacttgctagccaagacatagtgaattcagatactaccaaacagaattggccttagaattcatcgtagatccaaacttgacagaacgaagaacaaaagtacataaatgctcacctacagttgcagagagatttgagtaggcagaatcattggaatacacaaaagtagcattacgggaaggaagcacagtgagcttgtgggttcgggacgctgggtgaaacaacaaaaagaaaaagcacagcaagtgagtgagacaaaagacaaatgggaccaacatatctctcaacctgcagcaggcaccaggaggggctctttcatccaagagcaccctggactttctcttcggacctcacatcccccagcctccaccacccttgtttactttggtcagcagctcggccactccagtggccccactcagttcccacaccagggcgtgatggctgctgaatttggccgcaagcgatagttctaattttctggctccaacacataggcagatacttagttgagagatatgaaattgaacttggccactcataacacaggctcaacaaaaggatgaatggttatgatgtcacaagaactgatgagacagacactctgcatgaaaatgactgcgtgagatgatgacaaatggacaaaacgacggagagttcggcaacaaacgacaaagccgcacatcctcaaaaggcttgccaaagctattcacctgttccccgcagcaaaatgtgctgatggggtctattcttttcttttctcccttaagaaggctgtaatcaattcaaatatgccagcatagcattacaacctagagaatgcatccagtagggaagtgcagagaaaccttccacattgcaatgttccaggactaacacggatatattagtgctttactggaagtcaatatattcagggagcaaaattcagccacagtgtgtaactgtatctgtgtgaatatatcaccttaggagaagaatttttcataggtaaaggtttcaaagcaccaagagttactgatttaagccaccacaatgagttcaggtataggggtgaagagagaaagacactgacagttattcaagcttttgtttgaaaaaactcctagcattttagttgctgggtcctggaacagtgagctgtttcaagaaggcatttccacttggtgaaatgaccccctttccatggctttaaaataaaggccttgaaaaaagaaaactggatgccaacaagggaacgtggttcgtttgaacccgagccagtggtgaaacaaacttgcacaagggctttctcagccctgccaggccgaccctttggaaaagacatctggctgtagggtggtttccaaatgtggccatgttgctgccctacaggcaggcggatgagagcgatgctgggcagggagcgcgtggcacccacgcaggtgcccttcacggagcgcgtgctcctcaacggcgccccagtctgagaacaccagcaacagaggcagcaccgatgggtctcagtttgcaaattttaaggaaacatttcagaagcttcagcggtgatgtccagcaacacattaaatcacaggagtaaggaaaatgccagtgtgtcaatgtggaaatcacagtcaccagcaatacatggttttaaaaataaaacgcctcccacggaacagggacgaccgaagcacgtgctaggattgctgtacggtaaaccctcgccgcccatgtcagccatctgacatgatcaagagcaatcagtaaataaaaataaaaatggaaaactgtcatacaaagcttacggtttttaaaaagtccttattagaaaggggaaaaaaatacccagaaagatgtgaggtttctcctaccagcaaatgtctgaatgaactcaaacagactatttggaattgggcctcactggaaacgtcttaggcgatgcttaatcttttcaaatggagctgatgtgtggggaagctgactggtagatggggatgcgtttgctgaatgaaacgggggcccttcaaacatgtgagttggtcttagttggcatgacctttgacatctgcttcatcaataggcccctgctgtggtcagtgtgcagatgacgctagtccattcaacgtagaaaacagacgcctgacttgcacatagaggcatcctcaggccagcttctgtttcaagattgttggggaaaatgcacattttaatcatattttgaatcagaaattctcccattcaatacgcaatagctctctctataaaaattctagtaaaatgcttcgtggcctggcacagtggctcacgcctgtaattccagcactttgggaggccaaggccagaggattgctgaggccaggagcttgagaccagcctggcaacatagcaagaccccatctctacaaaaaaaaaagctttgaaataactattacgggaagttacacaagtatttgttcatctctatcaccgtggcttcaaagcagattgtgtccacatctgctccccgatggccctgggattccccggcccacagtcactctcagcacccacgtcccccaatggccctgggatttcaaggccagccactctcagcacccacgcctcctgatggccctgggattcccgcgcccacagccgctctcagcacccgcgtctctacctccagttgtatcctgaagttcatggatcccatccacattctccagtggccagtaatgggaagcagacgccaacacctgaaatccttggggaaaaaagaataaaaattttaaatcatcattagagaggaaagaaccagagggtaagaaccgcttagcacacacattatgggggaagagtaaaaggatcccatgtctgtgggagatactgaaagcatatttaataaaattcaacacacactcttggttagaaaaagaaactcttaaattagaagttggtaaatagttccttaactggacaaaacagggtaaataggaatagatgcctcttgttgcatgaaaacagaagccactgcatttactggtgacacactagaagcttgcccattcatgtcaggaaaagataagaatgttccatatcccgctgttatttaccattattttagagttaatatcaatgcaatcacactatagaaacaaataagggtaaaatcattttaaaagaggagaaaactaacatgaatggtatgccagacactgaggtccttaacaagcacttcctcacttcatgctaacaataatctataagaaaattgaattcttagcctatttgtaaagacaggaaatgaaagtcttgcacaaaatcacactgccagctcattgtagacgcaatactcactttctcaatttaatcctggtcattctattttccctctatgcttcctccacactaagcattactcagtttgaaatttccttcgtgatccttatactttgagtaaacataactttatgcaggtatgttattttctattctgctcttctcattgaatgctatatgaattatttctttgtttctatctaaccctcataattgagtttgggtaacagtctcttgagtggctgccccataacatgttatgccattcttctgttaatgaacaatcaatagcttccatccttattcgtacaggtggcgctgacatgagtggctttatgcatacaattttagtcttctcggggattagtcctctgggattcattcacagaagtggaaataatggttcagatgactaaacaataatcaactgccccaagcgactgctagatcatagaaaaggacagactaatagtctctatgttagtccttgtttttttaaaaaaaatactttttaaagaggagataataagatcattattttcaaatgatgtatgcctgataaccaaagtggaaaacgattacaaataagaaaagaatttcgtcagtgaaacactattacaaacaacaaaagaatttagcaaggaggcttgtacaaatttaatatacaaatgtcaattgcttttctgtattccaacaataatgctacaaaaaaagaagagttctcctaagtgcagccaacaaaaagaaaatatttatgaaaacaagaataagaattgtacaagattttcatgaagaaaataaaaaataataattctgagggatgtgaaagcaccctcgaatgcatgaaggattcaacctattcttggaaaagccgactcaatgtcgtaaactatactttaatctatgagtattagaaaatttgttgtaaaaatgctgagagaattttgtgggggacatatctgattatggagtttatataaaaaataagaaagaaaatctggagaagaaacagaagaggataaagagaggagattcacactcaatgataaggcacagcatgaaactacaataaagatggctgattgttacacgcggatagacagttcagcgggagaaaaatccacaaagatgcctaagtacatatggaaattcagtttgtgataaagagggtcttttattttttatttacttatttattttttgagatagagcttcgctgttgttgcccaggctggagtgcaatggcgcgatctcggctcactgcaacctccgcctcctgggttcaagcaattctcctgcctcagcctcccaagtagctgggattacaggcaccgaccaccatgcccggcaatttttgtatttttagtagagacggggtttcaccatgttggccgggctagtctcgaactcctgacctcaggtgatccacctgcctcagcctcccaaaatgctgggattacaggcgtgagccaacgcgcctggccccaaagctggtcttttaaattagaggagaaatattattcaacaaagacattggaaccagttcaccacatggaaaaaattaagatcccaacctcactctttataccagaacaatttccagatagatcaaaatttacatgtaataaaataaaacaaaacacaatcagaaaacaaagttttctgtgcatattatataatatgtattatataatacatattacagaagggtactgatttctttttagaggtattaaacgtattatattagtacaactcctactattaaaaagaaccaaccgaatattgaggcaaaggagataatcaaatagttcaatgaaaaagaaataaaaattacgtataaatatatcaagtgatgcccaaccttgctcataagtttaaaaagtatattaaacaacaatgagcctatcagagttcacccatcagactggcaagcaaaaagttagctatactaagctggcaacttccaccacatttctgatgggagttcaaatcagtacaccccttctgaagggtaatttggcagtatctatcccaattttaagtgtacattccctttgatctagtaattccacctctaggaatttattctagagatacactcatacatatgatcaaagacctctgtgcaaggcttgtttgttgtagaattttttaatagtatcagaaacctgagaacagcctaaatgctcatctacagagcgctggctaaataaatatggcacatctacactctggactggaatacagctgggacgaatactaaggttcataaatgaacttagatggcatattctttcattgatattgtctaatttttaaaaagatgataaaaatgtgtacactatgagctatttgtgtaaaatatagttggttcagggcagggatggagagagaagaagagagagagatgtctggagagatactgcagaaaccaatactgctgttttgggagtgaagaaatcgaaaagctgagtgcgagatgtaagaagaagatttacattgcattatctttctgttctatttgaatttgaatttttctttctttttttttttttttttttttttgagacggagtctggctctgtcgcccaggctggagtgcagtggcgcgatctcggctcactgcaagctccgcctcccgggttcacgccattctcctgcctcagcttcccaagtagctgggactacaggcgcccgccaccacgcctggctaattttttgtatttgtagtagagatggggtttcactgtgttagccagcatggtttcgatctcctgacttcgtgatccgcccgcctcggcctcccaaagtgctgggattacaggcgtgagccaccgcgccaggcctctatttgaatttttcaatctgtattcctttagaaatattttaaggcttgctttcacaattgaagtgccataggtagttatgaacataccatcattttcagataactgacgcaccccatgtaatatctgaatttttgttcacagggcgcccaacatccacacgtgtcctgttccttggttccacttttcaatttgcatctgtccctccagttttatgtacacaagctcaaaatgtaagccaggaacaaagttaactctgtaatatgagctaaagagaagtatctaaacaataacttaagtgtcttgttactctctaaataaaatagccctatctagataaagtagcacattagaaagtaaggcctgacttcagttgatttccagtggggatagttctactattgtaatgcaatatgaagaatctgaaatgcaaaaatcaaaaagattcattttcattcccactgtgctttttttccccctaaagtctaggatattcattttgaagaggacaaaacctcattgacttgttattcaagtcatctgggaaaaaaaattgtaaaaggaaataacatctgttatacaaagaacagatgtgtcttcagaatcctcatctttataaaataaaccctgtggacgataaagcccttcccattctttccatttacaaatggccacaatcagtcctggcagaaaggctgacagagtaaagtgatggtgtctcgttcaccccaaagccagccagagttcataggtggccagtgatgagaagagcagggttgaggccagaacactgccttctctccacaccactgcacttcagacaagtgtaaaacacctcagttgccacagatgttttgcaactagcaacactgactggaaacaagcaatgaaggggctgcaagctgtgacacccgcaggggacggcgagtcctgagaagtgactggacagagtccagggatggcatccaaggtagttaacaagctggaaggcacaggccagactcatcagagcagatgctggaaaccatcagctggcaccactgcagtcgtagggcaggagaggcggaggcgacgtggaaaactgtgccctgtctaaattaagtagtgcctcctgatgccgaacgaagcattgcggctctgcaggaagctttgcccaggattgtcaggtcttcattttttaaagcagagtcagaaattcagatttttttttaaagcaaaatctatcaaaattttaatgttagcaattttttaaaataaaacattgtgtggtgctaatgggatgggctgaattcagcccacaggttccttttccaactcaaggagtaaaataactcatagtcctacaagtttcatcagagcaagaaagtctcattctttcgggaaaaaggcactctgtggcatttttcccattgagaaggtggcatgagaccacctaactctgcaaccaccttgattttcaccaaactcttctaaagactaaacgtcttcttaggcaggtcagccagccaagcaaaaccatggcccatttgaggactccaaaacaaccccagcctgcaaaacaagtagcaggggacagagccagagagaaaatggaggaggggtggggaggaagagaaagaacgagagagagagagaggaaagggcagagagaaaaaggggtattttcagcccacatcaccacagttcttcagaaataatttatcatccatatgtaatgttttattaagtttggtgtgtgcgtgtgtcagagacagacataggagagagatgaaagacagagtattaatactcaaaacaacttaataaaacctttaatttttccttttccatttttcttccagatttccctattcttcttccttccctgttacttactccttgtgtgcgttcagggaaacctttatcccttggtttcctgcagggaaataatcttcagtgttgcactgacttggtccagctggaatctatatcacacagaggaatgccggcccctgccgatggtcgggctggcttcgtggctccatcctccttggcctccaacacatggagctcatttttcctgcataactttgcctgctgttcccactgcctggaatgctgatccccacgttttgtgtagctcatcctgattcaggtctcagttcacaggacccctcccctcatgccaccccttcgtcgccaccaccatccactctttctttcaggtccttatttggttttctcatggcatttactattgtttgggatttttttgttagtatatttgtgtgttgtctcctatatcagactctgttccttgaatgttctatttacattgtatcctccatgtctaagacaaggggcccaggaggtgtgtgtgtatgtgtgtgtgtgtgtgagagagagatttttgcatttgaaatctcccaaatttttaatgttagcaatttaaaaactaactatacaggtagaatgaatgataaaatgcaaaaataaataaataaatcaataaacatagaatataattatctgtataattctagtatttagaaaatctctatttgccaaatttccatttcttcaatcggatataaacattgtttttttaaaattctattataaatactatgaagatgaagaatccagtttctgccatggcctagcagttctgacagttctttagaaactctaaggcatgatggagatctaaggaatgataattactgtaattatctgcttggcctcccagacccctaaatagagcgggtgaagtgagccgccccaaacttctggaaacggctggagccagctgtgccatgtgccccaggaccaggaaactgctgggtaatgacatgctttgggtttgttttaagttctcttttcctcattacaaatgtcatgtataaaatggcatgcttataaactttttaagaatggcctgcaatttattggccagtgccatttatggattcagattaatcaaccatcacagcttcataaggctgtcccctggggagcagaggcaagaaattgggccgcctgaggccctggaaaagcttccagatgtggggaggggcccggactctgccgaccctggatttccctctccaaacctacctcctggcttccctgtaaagtgagaagtggctcaatagtccccacggtccctcaactacgacattctataatgcctccagaatgaccatctatggtcacagataagcacagagtatgcaaaggcttaaaatgatttcaagttgtttggcaattacttacaaaatgaaacacctctctacatggtaaagatctggcaaatatctggctacctctgccagtgtagacaggcaaaccaggtaatacaagccaaaacagccacctgtgagccgaatgcatgctggttggctagctttattgacgcggtttaccagatgactagcaaatcttcagtgactgtgcacagacaagtcaataaatatatagatattttttgagacagggtctcactctgtcaccaaggctggagtgcagtggtgtgatcacggttcactgcagccttaaacttctggactcaagtgatcctcccacctcagcctcccaagtagctgggactagaggcatgcaccaccatgctcagctgaatgtttattttttataaaggtggggtctcactatgttgcccaggctggtcttgaattcctgggctcaagtgatcctcctggctcaggctcccaaagtgctgggattccaggaatgagccactgcgccagcccaacaaatatttattgcgtgtctcctatgcataaggcacagtgctgagtgccagaatcagaaaacaagaaatgcttaatagttctgagaacctttaacaaaatactacagtttggtgtggccgtggtggaaagtaggctggcgtttggaagatcaggctctcgctctatactggagactcctccttaaggctcccccagcacctgagcgaacctatgtcccggtactgaccactcggctgctgttttccaagaatctctgtctgtgtctgtctcccctaattcccctcacgctgtgagcttcttgggcttaatattgtgtcctctgagccctgtgaccttgagcaaatcgcttggtctgtctgaaagacacgcttctccacccgcggtgcgagggcgtgacaccaccgcagggctctcgcaaggatgatgtaaaatcattgaaaggcccaacgtgcagacaaactggccgcttttcatagctgtttagcactctttagaatgaaatgctacgtgttaaggagctgttctcttgcgatggaaacaggttgtttctgttggtgtgtttgtgacgcccgtgcccgtcatgagcgctcctgaggagacgcgccagggccaggcttcctctgccagagctgcccgggggcaggcgagcctcaaggatggaagctggagcatgaaggaggcccctagattctgcttcacacagacagccagggatgcggcttttcagcaggaaacgaggtgagcagagcctgagatgtcggaagagaagacaaaaaggaaggactggggctgggtgcggtggctcacacctgtaatcccagcactttgggaggccgaggcaggcggatcacctgaggtcaggagtttgagaccagcctggtcaacatggtgaaaccccgtctctactaaaaatacaaaaattagccagccttggtcacgggcgcctgtagtcccagctgctcgggtgactgaggcaggagagtcactagaacccagggggcagaggttgcagggagctgagatcacgccattgcactccagcctgggcgacagagaaagagtctgtctcaaaaaaaaaagaaaggattggataggatggagggaggggggagggagggaaggaaatgagggagggaaatggaaaaaagaaaatgagacaggaaacaaagtgagagagaaggcaggagaaggggagaaggggaggaggggaacagtgaggaggaagggaaggaaggcaggcagcaggatgtgttgttcatggagggcacctaaatattcagcaaatgtgtccaccttcaccattattctaaaaaggaaggaaggaggaaggaagagaaaaaaggaaaagttcaaaaacaatttgcagtgagaggaggacgaggaaggacgaggagaaaaagagggactgctagaacctggaaagctgaggagagagaaaccttgcggtttcaagagctcaggaggcatggccgccttcactgtgcttttccacacagactaggggtcaccacacccttccgtccctttctactgtcatcagcatggccgtcgtttctctaagacagtgccttgatcaggaaatgttgatttctaccctaaatccagacttggaagaacaaagcttctatatggaacaaagactgagttcaaactgctccttcaagtttagatacaaaaatgcaagtgcacatgtgcatgtgtgtgtacatatgtgtacgtgtgtggatatgtgagctgtgtaaataggtgtacatgtgtgtggatgtgggatgtgtgtgaatgtgtgagggtgtgtgtgcatgtgtgtgcacacatgtgagtatgtgaagatgtgtgtggacacgtgcatgcatatgagtgtgtgtggacgtgtgtggggtgtacgtgtgtgagcatgtgtgtatgtatgtgcatgtgtgtagagatgtgcgagcatgtgcagatgtgtgtagacacgtggacttttgtgaatgtgtgtacgtgtatgcatgtgtgtagaaatgtatggatgtgtgtggatgcatgtggatgtgtgtagtctgtgactgtgtggtcatgtgtgtagacacgtggatatgtgtggacatgtgtgaacatgtgtaaatacatgtatgttgatgcacgtagacatgtgttggcacatgtgggtgtgggtgtgtgcatggatgtgtatatatgtgcatgtgtgtctacacatgtgaattgtgtggacacatgtgtggatgcatgtggacacatgttgatgcatgcaggtgtgtgcatatgtgtggatgcttttgcatgtgtatgcatgtgtgtcaacatgtctgatgtgtatggatgtgagtggtgtgtggacatgtgatgtgtgttggcacatgtggccatatgttgacacatgtagacatctggtgtgtgtgtgtatgcatatgtgtcaccatgtgtggatgtgtgtgatttgtgttggtgcatgtgggcatatgttgacacatgtagacatgtagcatgggggggcatgtggacacatgtgcatgtgtgagaatgcgtgtgggctctgtatcataagcagaagtccggggagaacccgcacagcttttctccaacactgagcagcagtgagggccatgctggggcctcgggggccacctgcctgctgcaggagccgggtgcacagctctgcctgaccgccctgcagttcgaggggctacccctctcctcctctcagtcctctcccctactggagcccagcccaagccatgaggcctgcattcacgagaagcaaggtgtccaaggtggacacgtcctctctttaacgcagcgctgggcatgtttattcgttcccaagccacaggagcccttgtttcattcagcgatttggctgaggagaggggaatgtgtggaaactcacagcttccacacctttttaaaaggagctccctatgcatgtggacgaaacagaagtggcagcgtccccacccccgagttggtgaatggaggtggtggcgaggcgacgatgcctggaacatcctggcatggggctgccgggcagccggaaaggagacagaggctgagggcacagcccctggccctagaccccagcaggctcctggtgctccatccaggaaaggggctctccctggaggcctgggtatcgccctgggatctgcccacagtgctggcctgagtccatttgtggttgatcattaaaggctggttcccagccaggcccagtggctcacatctgtaatcccaacactttgggaggccgaggtggttggatcacccgaggtcaggagatcgagaccagcctggccaacatggcaaaaccttgtgtctactaaaaatacaaaaattagccaggcgtggtggcatgggcctgtaatcccagctgcttggaaggctgaggcacaagaatcgcttgaacccgggaggcagaggtagcagagagccgagactgagatctcaccactcaactccagcctgggtgacagagtgagactttgtctcaaaaaataaaaacaaaaataatttttttaaaaaggctgatttcccatcagagacaggcagggccatacaatagcgctcgggggggtgcccagccaagctctggtggggcgggggcagaggctgtgctcacaacaggcttcccagcaggggttcaggcactagcagggtctcctccccacctcctgcaacttccagcagggagcaacagcccagtgactgcctgctgctcccagaaagcctcgtcttcccatccctgcccctggctgaccagaacgtgtgcccacactcttaacagcgaagggtgtgtgcctccctgtcttcccgagagaagccccgtcctgatgcttcctggttgggtgtcacaatggccaatggaatgtggctctggggctggagcaagggtggccctctatcccgagtcccactcatcggctgctccaggctaagctggtcagcactctgaggctggaggtcccgagaccctgctatgggccagagctccaactccccaccagtgaatctgccctgaagacatgagatgggtgtggtggctcacatctgtaatcccagcactctgggaggccaaggcgggcggatcacctgaaatcaggagttcgagaccagcctggccaacatagtgaaaccctgtctctactaaaaatacaaaaaaaaaaaaagctgggtgtagtggtgcacacctgtgatcccagctactcaggtggctgaggcaggagaattgcttgaacccgggaggcagaggttgcggccactgcactccagcctgggcaacagagcaagactccatctcaaaaagaaaaaaaggaagaaaggaagaaagagagaaagagagaaagaaagaggcagaaggcattcaaatgaagatcatatttccttaatcacaatgtttcatatgacccagctcaaggggcccagaaccacttctccatccaccgctcagccggtgaggggtagcagagctgcccagggtcacagtgtgtggtgaggcagtgaggtcggggaccaggagcccaacaagggccattcgctgatgcctcagagatgaacaagtgggctgttcctgagatacctgcactaggcagggggagagcggtgctcagagtgagaaggaaacactcttacctggatggtcctgcgatctggagtagacgccacgcacctgcgcacaaaagaccacagtgtgagacacactcagggaaagcctccggagaaaccaagcctgtcgccatcctggccacttggggacattacctgaaagttgtaataaaatagcagcagccaggagtaccagcagcacagccgcagcagcttttccatggctctctcggaggtcaaagctcggagccaagtgaaattcctgagggtctgtgagaacgggacctcttaaccttcacttccttggaaaagggacattttcacaggttccaggggagaaaatttctgtctccttaaagtttgtgaaacacagctgtcttggagacctaatgggtgtttcttcctcgtctcaaaacttgagattcttcagtgatcaataaacacgttgcgatgaccagagcagctgtggaatgcagggaggagaaacccaaacccgactcgcagtcctgggaaagcaatcccaggtcaccactgtgaccgcgacctgcgcccggggacgggaggctgtttgtcctgcggtattttctttttatttcaagagcctccgtttgtctcagtcaggtttggagcttcccttttctctgaagaaggttttgtgcgtggttttcccctggagcgcccgcctgctcctcgggcttgtcctgcggccgctctcgagctccttctggtctggctcaagttcacacctccgtcctgctctctgggtggagggggagtgagtgatgtaagtctctctcctcaaactttgttctgttctccttttctatttatatccccactgctgtgtccttcctgggtcctaactccagcctcttaacaacagctgaaatatttccaggatctcaggctcagaatcaaaccaaacagacatggtgtgtggtgtgtgtgcgtgtgcgtgtgtgtgttactgatgccttctggtcagcaccttcaaagtcggcataaatattaataaatacaaaatgcaaaacaaaccataaactctgtttagatctgagtcttgtttgcccccaaaagagaatgaagttgacagagggatggaaaagagaaagcagcacacccactgtgccctccatattaagcgctgaccacatttttctctctaatcctttcggacgtcagtgaaagctacggaattaattacaaggtacgctgcgcaattacaccatcccacatatacccccaccccagcaccaggaggatgttctcaatgggatagaaaagagtcagccccttcgccagacatgcctcagtttacccaagaccaaagtttatccgatctactccaaatacacgtggacacacagagacacacaccctagaattgcagtcacagctatatttgctatgtgatttaagtaatatttaccgcttcatactttctccaacattcaccagctgtgctcctaggcaaattacttgatctctcttagttttcgaattcctcatccacaaaatgggggttaatagttcctcctcctcagggctgtaacaataaattagaggacagatccaaggctcttcaggcagtacttggaaaatatgtggcactcagtaaatgctgctattttctattaagaaaaattatcactcagtaaatgttagctatgattattattagcaagtataacataacacccagtaaatgttagctgatacagttatctcaattgtcctgactttaaatgggaattaagaatcctgaatccaacatacttcctaaagaggataagaaaatgacttccaatctctgtgggacagaaaaaaagaaagtgctgtcaaaacgttaggtgattatttttaacttgtgcctgcagcctacaaccgctcagatcctctgatagcctgagcctctctgtggagctggagaagggttccagagagttccatctcctagcaatggagaaactgtgaactccaaaggccgggggctgtctgtaataacgacctttatcctgttgctcaggctggtcggcttcagggaaaactaatttacaacctttatctctgccatttcatcagctctccagtcccccactgcctctcgctggaagaggtgaagggagggacaggcagctgcaggtttttctcagctccagttttaacctggaagaattcaacagattgctgaatatgcggacctttcccatctccatgaccgaacaaagccagcatggtttcttttcatcataaaattgtcatcagataatgggagacaccccgattcaatgactgtaataaaaactagatagcaaagcaattcagcagagcttgccctgcaggcatctgcactcatcctcagactcactctgactctccatcccggactacagtctcgtgcctcatgctatttgcctgcgtcctgtctcaggccttgttcagaggcccagatgaagagcccgcctccatgtaaagcagcgtgtcctgaagcctggagatttgagacagggccttgagtggtccatgggcctggaaccaagcaactctgatgtctctgagcatctcattccatcacccaaacgtcggggtgttcggcacccaaacatcaccttgacagcaggtctccctccccctaaagccctcccctgctgtattttctcgatcccactaaccacgatccaatgtacttcatatcttagacgtttatttcatttattgtcagtctctccccaccgaggcgtaggccccatgagagcagagaccttctttctgcctgttcgctctgcaccccagccccgagaacagggcttggtacttggtgagcactcagcgtttgtcaccaaacccagcctggctctgccctcccgcagcaaagccaaacatggacgtcgggattgcagtgagaggaagtgaggcatttagagcagggcaccaggcgagcagaacctggcagctcacacttcagacctgaactccccgatggctgatgggggagggtttttcaaggtggagaggcagaggttacaggctaagtcccacatgaataatacctggaggctgcacattggtttgacctaaaaagctaggacatcttgaactgggggcccacaggtcatataggtagtagattcagaggttttctgatttgtgattggttaagaaggcaaggctttgtcaaaaaatttgagatcagcaaaaaagaatgttagctctggcctgtgggcatgacctcctccaggcccctcaggaagaaatttagaacaaagaacagtggtgggcccggaggggtggatcccaacactttgggaggctgaggcaggtggatcacctgaggtcaggggttcgagaccagcctggccaacatggcgaaaccccgtctctactaaaaatacaaaaattagccgggtgtggtggtgcatacctgtactcaggaggatacttgggaggctgaggcaagagaatcgcttgaacccaggaggcggaggttgcagtgagctgagattgagccactgcactccagcctgggcaacagagtgagactctgtctcaaaaaacaaagaacaaagaacggtggtggagttcagctctccgctcccccatatcagaggtctgtaagtcaacagatccatttggtgggggtccaggttctgaaaaacaactccgggtcgtttgttacgatgttgtctttagtttctacagggaagcaatgaattcctgactctaactctcttgactattgtttctcgccactattaacttcttgcttcccaagttgctcatgtatttctcagggctagctaggtggctggaattccccttcaaggaacccaagattttattgtatttatttatttattttgagatggagtctcattctgttgcccaggctagagggcagtggcacgatctcagcccaccacaacctcactgagctcccaggttcaagcaattctcctgcctcagcctcctgagtagccaggattacaggcacccgccaccacacccggctaatttttttgtatttttagtagaggcggagtttcaccatgttggccaggctggtctcgaactcctgacctcgtgatccgcccacctcagcctcccaaagtgctgggattacaggtgtgagccaccgcgcccggcccgattttcttttttctatgcttgggtggggagtgcccggcaggcagcctcacattcaacattcaagtcatagttttgggccacatgcatgtgtactttacttaaagaatgaaaaacattgttacgctttggtaaaatatttcagactttactgggaggatgctaattaaacattaaaaatgagaccttacattgtgattaggctccactcaaaattttacaaggacataaagtgtgacgccagctaccaatgggaacgtaactggattatttgcaaagctgatgccctgcgcacaacagagcatgtttcctggtgctgagcagctcagatgtcccaggaggacagatcgggcctgaacaaagaattctgtggagtggcccaaatgctgagggagagctggacaagctgtgagcacaggagttcctgatgcctgattcacaccaatccaaggtgcgcctccctccagctcagaccctcccatacgccggcatatttgtgagaggcagcaagagttgtgtgtccatcacgtttactcctgtgtagataagcaaggcggagcagcagttcgtaagcagtgtgctaggaggggtgtgcagcacacaacgtacatggaaatgaacggtgttagaagcctgggggcgaattcactgtgaaagtcacacgaaggagttcaagaattctttctctgagtggttaagggatgggacattctggaaagaagctatggaatgggctaaagctccgatgcagcatgccatggaccatgggcgtgtgttgtttctaccagcccagcctcccctccggctcctgtcggctttccttttgaaggacgtttcttccaccgacccgtgagctcagacgggactgtcagaagctgcaggtgttgcgggggagttgtgacccagtgggaacacttgcagctcctccataccacaggcactgtgaatggcccaaaggtgtacatgtgacccactcagaaccaatcagtgtcttccccgggatcaatagattgaccatgggagagaaaagactccctccgccactgcagttgctaatccagaatggtcttcaatcaaggctggtgatgcccatttttcccacaacaaagaaaagaattacacagagctgaagataacaagcaaacatagagactctagccgcctagccttggagagggtcaagagaaaacctgatgctgtcagctgagcccttggatcctacaagacctaaagccagcattccctgacaggcaccgagaaatttatgttaggctcaagcaagtttgagcttggtttctgtccctggtcattaagagtcctggtcagtgacacagatttgagaaaccacaattaattatatattcaatgaagagtaggcacaagtagggaaagtggcaggggctgaggctggagagagtcaacaacataatcaagagggcctgtgtacggggcccctttcattcacctctttaaatcttctctgccctacttcttatccacctaccagtaggatgatcagcttcacactggcttccaccagcgttgctcctgatggcgatgccctcagaagccagagcatgctccaccctggggtctctgactcagcagatgggaggcccgggaaagccctgcagcctcaggcataagcacccagaaacgtgaggtactcgagcccatgaagtgcaggatccagtggacaaacccgcttttctccctccaaccatcatggttgcaacacggtagcatttccctgcattgccgcttccccacttctgtgtctgttgcccccgtcccccactttggccccctggactcacactctaaagcactgctcacacgtgagtgttggcactgggctctgctctcagagaaccaagaacgagacactcgcgtaagttagtcccaatgaagcagcatcgtttgtctggggaaatccccggggtttgttgtctcctgctaaggaaatcaaagacatggacacacaaggagtaggtttaagagcagaaagtttaataggcgaaagaaagaagagcgctgccttgtgtaaagggagggggacccagcgggtttctgggtttggggtgagatgtgtttgatttcatagatgagcttgaggaggcggtgtcgatttacatagggtgtagtggattggttggaccagatatgccatttacatagcccggaagaggctggctatcccactctaatcttttattatgcaaatggagtctttacttggctggcaccatgacgcccgcacacgtggcgacaaagaaaagggaagagggaacctccatgttgaacatacctggcttccaggtttcccttttctattggcacagctgccagcattcccctatgcaggcttccagcttacttatctacactggcagcttgatttttcaggctgctttttgttagaaaagaaatgacttggaggctgctttcttattaaaaggaaaccttaccaaggactcccgtaccttcactaaccacctaaatcatttctttttagctcctgtatcaccaaggatcccaaaggcattcacggatagacttcagggatcaggaaatgctctggatcacatatactttttttttttttttttttttttggtgacggagtctcactttgtcacccaggctggagtgcagtggcatgatctccactcactgcaacctccacctccagggctcaagcgattctcctgcctcaacctcccaagtagctgggattacaggcacctaccaccacgcctggctaattttttgtatttttagtagaggtgggttttcaccgtattcgccaggctggtctcgaactcctgatgtcaggtgatctgcccgcctcagccttccaaagtgctaggattacaggcgtgagccaccatgcccggcccacgtgcacattttgaatgtgcatatgtgaattttggggggagaaggtccatagcttttatccagttttcaaggacaatgagagcaaggatgaaagtgtaacaaactgcttagttggtaaggagtgttttcagcaagaatatgcacagaggacattgctaattgcctactcaaatctgttctcttctttctctgtatgcagaattgcaaatatatttgggtgccaatatgcacaagtaaaaaggttacttccctttcagctaggggtggccatgtgacctacaggcaatgagagacaggcagaagtctcttgaatgggcttctgagaagacattttgaaaaggcaaactccttttgacctttgttcttcctgaaggcttctgaccttgacctttctggctggaatgtggaaatgctaagctgaggtggagcagctgtcctcaaccatgagaatgaaaaccacaagcttttcctcctgggatgtaaaaagctggaaagaacatcactcccatcacgagaaaaagccaggtaatctacaaaatcttaacttttcttgaacccatcagagagctgaggttcaaggaaatcaccctgcccgaaatctaggggaagataggtctaaggagaaatgggacatgagcgtcatctcgcaggtggcagagcgtgagctcaacaggtaagaagcattcagcaaaagcttttgatggatttctaaaggctggtgtaggctggagagagagcatagactgctggcagctgcacaccaaggaagtttgttcccatctcggcctcttctccctggatgcccagcaggtacagaagaaggactgggggcaggcaggaggctggagagaaccactctgcacagctggagaagtgagtggccatcactgtgcaagggcacaaagccctgcctggacctttctccccaaggaacaaagcacaagcagtccttgtgctgctgggggaaggacagccagccctgccagccgcagggcacagggaagaacctctgggatgcagtggggagaaactaccctctattcccagggcagaggcagaaactctcctgggtccagatcatcaaagatctccttcaaatgggagaggggcagggccaccaagaaaatccatctcaagacacagagacacaaagtccacctaagactgaggccgggcctcagaaccttctctattccccatgcccaggcttgcaagatccagcgttctaggactgagagggtaggagccagaggagagccgctctgacattctggcacacaagaaacacttaaaactgaaagtagagcagaaacactgagaaaaaccttctgccaaaccaaaccccacccaaagcgcaagattctgccagaggaatgtgaagctaccagtggactgaaggcaaccatagcaacagaacccaaacccagctcaactcgcctgattgacttaacacacatatcacacacacatgcacatatacacaccaacacacataccttacacacatgcacataaacacaccaacacacataccttacacacatgcacataaacacacacatctgcacacacccacacatgcaaggacacacatgcattaatgacctagcagagaagacttttccccatttcctggcataaatactacttatcttagtctccactgtcctatgtgtgatgtccagcactcattctaaaattatgacacacacaaaagagaaagaaaaacaacccactgccaagaaacgaagcaatcaaactagaagatagaccagtttaaacaactatgattaatatgttaaatgttttactggaaaaatgatgacaacgctgatgaataaatggagaatttctgcagagagatggaagttatatgaaggagtcaaatggaaatgctatcactaaaaaagagcagataacagatgaaacattccttctctgggttcatcagtacactccacacaggcaaggaaatggaaatgctatcactaaaaaaaggtagattacagataaaacattccttctctgtgttcatcagtacactccacacaggcaaggaaagaatccattaacattgtgataggtcaattaaaattatccaaactgaaacacaaagtgaaaaagaaaatatatatattttttaaatcagagcatgaaagagcaatgtcacaatagcaaataatctaacatatgtgtaattggaattgtagatgtagacgtgagaaaataagacagaaaaaagtttgaagacataaagtctaagaatttaaaaagaaagaaagaaagatattcaattacagacccaagaagctcagacaatcccaagcaagataaatatcaaacacacatacccctagaaacatttagacacattatcatcacactgccaaaaatcaaatataaaagcaaaatcatgaaggcagcaaaaggaaaaatatacactatgtacagagaagaaaaaatcagaattacagtagacttcttatcaataactatgtaagccaaaggatgatgtcatgaagtatctaaagtgctgtggggtcaggaggatgaggagggccctgtcaacccagaattctatatccagtaagaatatctttcagaaatgaatgacaagtctgggaatgggggaaggggggagtgactgccactggatacaagcttcctttgggggttgatgaaaatgttctgaaattaaatagtgatgatggttgcacaaccttgtgaatatactcaaaaccactgaattttacacttaaaaatgaactttattgtctgtaaattatatctcaaaaaaagaaagagatataagctatttttcaaacagaaagtgacagaatttattatcagaaaccagaactacaagaaatgtgaaagaagctctttagacagagcactatgacaccacacagaaacttggatctacacaaagaaatgaagacactcagaaatgattaaatttgaagtaagtataaaaggagtttttcttattttcagttgccatggaaagaaaacattgactgtctaatgacaaaagagtagaaggtgctgtgggttgatagcatttgtaaaagtaaaatttacgactaaatgtaataaaatgtgggagggaggaagtaggagtaccctgtcctgaggtgctcacacgatacatggagtggcataatattattggaaggtaatttgaagagatagattttatgacaaccacagggggtgggaaaaaagcatttggtaagccttaggacaacccctgggagaaaatgttatagagggataaataataagccaataatatacatgaaaaggaatcatacattctgaattaatccaaaagaagatggagaaagaaggaaggagagaacaaaggacagatggaacaaatagaaaataactggcaaagatgtccaattttattccaatcatatcaatcattgcactgacctttaatgatctgaatacaccaaagagaagatagagattccctggataaaacaaaaagacccaactattttctatctacaagaaacacattttaaatataaatacttagtgaggttaaaagtacaagcagagtgaaaagacataccatggaacaccaaatagaagaaaactggagtggctgtctggagtggaaaaagtagacttcagaacaagagaggccattagggataaagagggtcattacataaggataaaggggtgaattcaccaacaacacatagcaatcctcggtaggtatcgctctaacaaaagaaccacaaatacatgtcaaaagccactacagctgaaaggagaaacggacaaatccagttatatttagagactcctctctcagtaatcaataaaataagtagacagaaaatcagtaaggatacagaagactgactaacattatcaacttacttggcttaatgacatttgtagaacgctccgtcccacaacagagaaattacatcctttttcagtgcacataaaatatacaccgattagaccatactctgggccataaaataaacctcagcaaatatgaaattttgaaattctataaagtatgtcctcttaatggtaatggaattgaactagaagtcaaaatgaaagaacgataactatttgggtgataaaatgttctaaaattagattatgatggtttttacatgactgtcaacacactaagaaacattgaactgtgcactttaaaggagtgaactttataataaataaattactagaactaataagtgagtttagcaaggtcacagaaacaggttcaacataaaaaaattaatttgctttgatacaatagcaatggatgattgggaatttaaatttttaaatgctattttaaatatcattttacatatgatattaaatatctaaaacattaccatgtataataacaccaccaaaaaattaaatatttcccttcttagggaaattttttgcagtgttggacaaattttgtgtcttgtaatggtagtggttacatgactatgtgtttgtcgaaactcatggagctgtactctagaaagagtgattattttcgtatatgagttacacctaaatacacctgcctgaaatatcccataagctaagaatgacagagccacaggctagaaggtgctcgagtccctggtgacattgcagaactgccatattgcccctctacttgcctaagccactggaatcttgtgtttattacatgtacttgaaaaataatcttggccaggtgcggtggctcacgcctgtaatcccagcactttgggaagttgaggcaggcagatcacgaggtctggagttcgagaccagcctggccaacatggtgaaaccccatctctactaaaaatacaaaaaattagctgggcatggtggcgcatacctgtagtcccagctactcaggaggctgaggcagaagaatcgcttgaacccggtaggcggggttgcagtgagccgagattgtgccaccgtactccagcctgggtgacagagtgagactccatctcaaaaaggaaagaaaaaataaaagaaaaagaatctctaactgacacagtatgacaagtggattggggcctcatcttgattactcaggtggtttctcagtccagagtggctttttcactttgcctctgaactcagccaaagtcatgggatacctaccaatgagtccatttttattttcacccacctgtaactgaggaataaacaactctagatattaaaaggtggaatcctattagacagtgaggcactacattatcatctgtcatcaccaccaccatcatcacatgaccaattaacagaccgtccagcaaacagtatgatttgtcatttggaagcaaaatcaactgcaggggaaaagacaatcaattaccttgcaccttttagaaagtcatgctgaaccactgcagcaaaactagccattaattaatacctcaactcactgtctcagtgaataacaatgtcaagctcgaaaaaacctccaaaaagagaattgcatgtcaagggacgtattctggggaaatcctataccaacaagtgttccaatacttaattttgtgaaggccctagaaagaattaaactaaaaatcaaaaaagatatctggtttgaaaatcagttgaattgtaccacaattttgtgatgtatgaggtactgtaacttcacccataacaataaaaggaatttaccataatgtccttcctcaaaaccttcttcaggacaatatcaatcagggtgctctctgttgcaagaaacagaaaatacaacagacttaaccaaaaaggaggaaagtatgtatttacactcaagctattaaaatcccagaggatggtatggccatcttcagggcctagtcaatggcattgggaattttttttctatttctcagtctccacttacttcctgttggctccattctctatcagcctcatgcctcactgtcacaaaacggctgctgaaacatctttctacaccctagcatctgcagaaaaatgtccactgcatttcactgggtcgtgtgcccatgcctaaaccaatccctgtgatcaagggaatgtgttgagctgactgaagcagcattgagtcaggcgttcaatccctgggtcctggggaagacccacattcaggctgtaaggattgataggaaatagagcagtcattgatgctgttcaacaaatgtctgtagttctacttctaggcacgtgcaaggatttcatttcctgctcatttgaagttagtgtgactatatgccttgctgtgcctcacagcaggtgagtggaagtgatacatgtcacttccatatggaagaccatactcaagttttcactgcctcattgactgcagaaacttgtgagtgagtggatgaaaccttcaactgagtgactccaatgagctgaccccaatgagctgaccccctccagcagtccaagttttatacataatgtgagcaaaattaagatgaaattttgttgtcttaagccactaagatgttggaactgttgttgctatagcatatacctacaacctatactgactgatatagtgggtaaggaatagaatgaaaatcagaatctggaactcaaagaagggtgaatgaatgttgaacaagcaatcagtcaatttccactccacagtgctaaactgctggttaagctttcattcctagccagtggtacctctattcctcatgtccctgggctcaaaatatcagaattatcttccccaccctactcttctttgctggaaaacttccagctggtcacgaaggcagagccctcatgtgtggaattattccccttacaagaagagacatgagggagattatctgtctctgccatatgaggacaaaacaagaaggcatctgtctgtaaaccagaaagagagccttcaccagaacctgagtatgctggcacctgatcttggacttcccaccctccagatgatgagatataaatttctgttgtttaaaccccagtctatggtactttgttatgaaagcccaagctaagctgccatgctccagaaacactgccctttattctctacctcatcttggtcattccctcctggaggactttgcccatcttgtttcccctgcctgggatcctctgtctttattattattactcaggctttagttcagttaccacttcttcagagagaacttttcatgaccaataataagatggtatagacgttgaaattatccgacagaatgtaaagcagctattatgaaaatgctcaaatgagtaatcacaaacactgttgaaacaaaagttaaaatagaaagtagaaaaggtctctaggattaacatcgaatctgcttttagtctcatttgcttttgcaacaacatcaactgtacctgtaccataacaaatgtctctcatagaaaaagttaaattgtgtttacaatacgatttgatagaattggaaacacacacacacacacaagtggaaaaaaataaaaatataaagaaaaaacaaatggaagttttagaactagaaaatacaataacaaataaaaaaagatgttgaacttgaagctagatcaataaagattaagcagtctgaacaatagagaaaaattattaaaagaaaaacagtagaatatcagggacctctgggacaataaacacagcctaacatttatgtcttcgatattctggtagaagaggagagagtgtggggctaagacaatctttttaagtaataataaccgtaaactttgcaagttcaataaaaaacataaacctacgtactcaaaagctgagcaaatcccaaacaaaaatccatgcccagagacatcataatcaaactgctgaaaactaaaggcaaaggaaaagtagcaaaagtaggcagagaaaaagagcacattacctataggcagacactatttaaaataactgaagatttctcatcagaaaccatggaggcaagaaaaaaaacatttttcaaaaactaaaataaaataactatcaacccagaagtctacatccagcaaaaatattcctcaggaagaccagacacggcagctcacacctgtaatcccagcactttgggaggccaaggcgggcagatcacaaggtccaggagatagagaccatcctggctaacatggtgaaaccccgtctctactgaaaatacaaaaaaattagccgggtgtggtggcgggtgcctgtagtcccagctactcgggaggctgaggcaggagaatggcgtaaacctggaaggcggagcttgcagtgagtggagatcatgccactgcactccagcctgggcaacagaccaagactctgtctcaaaaaaaaaaaaaaaaaaaaaaaaaaaaaaatatatatatatatatatatatatgttcttcaggaagatgataaaatgaaaacattgtgagataaagaagagctaagaaaatttatatccagcagacatgctctaaaaatatactaaaagggccaggtacagtggctcatgactgtgaccccagcactttgggaggcaggagggtaacttgaggccaataatttgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctaacatggtgaaaccccgtctctactgaaaatacaaaaaaattagccgggtgtggtggcgggtgcctgtagtcccagctactcgggaggctgaggcaggagaatggcgtaaacctggaaggcggagcttgcagtgagtggagatcatgccactgcactccagcctgggcaacagaccaagactctgtctcaaaaaaaaaaaaaaaaaaaaaaaaaaaaatatatatatatatatatatatatgttcttcaggaagatgataaaatgaaaacattgtgagataaagaagagctaagaaaatttatatccagcagacatgctctaaaaatatactaaaagggccaggtacagtggctcatgactgtgaccccagcactttgggaggcaggagggtaacttgaggccaataatttgagaccagcctggacaataaagcaagatcccatctctacaaaaaatttaaaaattagaagggtgcggtggcacacacctctagtcccagctactcgggaggctgaggtgggaggatcacttgattctagaagttcaaggctgcagagagctatgactgcaccactgcactccagcctgggcaacagagcaagaccttgtatctttaaaaaaaaaatagatatggtaaagaaagctcttccgataccagaaggaaaaaaaatggaacatcaggaatagagaaagagtaacagaagtggtagatatctgggtaaatacaatagattattcttcccttccagaattttaaaaaatatgtttgacagttgaaaggaaaaaatataacatcatctagtggagtttttaatatatgtaaatgtaatatgtaaggcaactattgcataaagacaagaggacaaaggaactttagagtgacaagatttctacattcaaattgaagtagtaaaaccaggcatggaggcacaggcctgtaatgccagctgcttgggaggctgaaggggaaggatagtttgagcccaggagtgcaagaccagcagcctgggcagtatagcaagaccttgtatctaaaacaaacagaaaaaacaaattgaagttataaaatattgattctatataaactgtgaaaaattaagactgtattttgtaataccaagattaaccactaaaaaatatataccaaaaaatactcaaaatcaaaacaagtttaaatgacctgctaaaatatgctttgataaacctaaataagttagaaaaggggaaacagaagaaccaaaaaaaatccaataaagagacaacaaatattaaaatgatagacctaaatccaaacttaccaataattaaatttaatacaatgccaattaaaagatacaaattgtcagattaaattttatataatgatgtaagtataagctgtttacaagaaactcacttcaaacacaacaatagtggtaagttaaaagtgagagaatggaaaatgtatatatatatatcacacaaacactaactttatttattttttttattattatactttaagttctagggtgcatgtgcacaacgtgcaggtttgttacataggcatacatgtgccatgttggtttgctgcacccattaactcgtcatttacattacgtatatgctatccctcccctagccccccacctcatgacaggccccagtgtgtgatgttccccgccctgtgtccaagtgttctccatgttcatttcccacctataagtgagaacatgtggtgtttggttttctgtccttgtgatagtttgctcataatgatggtttccagcttcatccatgtccctgcaaaggacatgaactcatccttttttatggctgcatagtattccatggtgtatgtgtgccacattttcttaatccagtctaccattgatggatatttgggttggttctgagtctttgctattgataaacactaattttaaaaatcggactggttatattaatatcagacaggatagacttcagaacacataaaattataaaagataaagaaagataatttataagccaattcatcaagaatataaaacaataccaaatgtgtatgcgcctaactacagagcttcaaaacacataaacaattgacaaaattgaaaggcttaatggacaaatccacagttaaaatcagagacttcagcatttctccctcagtaactatgatggttaattttatgtgtcaacttgacagggcaaagagatgcagagatagctggtaaaacattctttctgggtgtgtcagtgaggatgttttgggaagagattagcatttgaatcagtagacggaataaagaatatccaccctcatcaatgtaggtagccaagatccaatacattgaggaaggaagaatttgctctcttcctgagttgaaatatccatcttctctgctctcagacatgggagcttttggatcttgggccttcagactcctggacttataccagtgccccactacgttcttagggctttgtacttaaactgggagttacaccattgtctctcctggttctcaggctttcagacaaaaacacaccacctgctttcctatttctccaacttgcagagagcagatagtggaacttctcagttttcatcatcacataagccaatttccatatcaatctctcttatttacagagaggtaggtagataggtagacagatagatagaaacatatcctattggtttcgtttctccaaagagctgtgactatagactaatagaccaaactatgaggcagaaaatcagcaaaggacttagaagaaatgaacagcatgatcaaccatctggatctaattgacgtttatggaacactccacccaacaacagcagaatacacattcttctcaagtgcacatgagaagcattcaccaagataaaacagaccttaatcaatttaaaagaagtaaaaccacacaaaatatgctctctggacataatgaaattgagctagaaatcagtaacagaaaaaatagcaggcaaatctcaaatcactttttgattaacaaacatactcccaactaatccataggtcaagtatgaactctcagcagaaattagaaactatttggaactaagtgaaaatgaaaatacaacatatcacaatttgtggggtatagctaaggcagtgcttagagggaaatttatagcaccaaatccatatattagaaaaaaaaagcctcaaatcaataatctaataacttgccacattaagaaactggggaaaatagagcaaaatatattagaaaagaaaaaagagcctcaagtcaataatctagtaagttgccatgttacgcaactggggaagatagagcataataaacctaaatcaagcagaagggaaaaaataagttttattacattattatatgttgcaaatgatttctggggaagataattgttagagaaactaagccatctcaacatctttcctgcttagagatcttcggtaacatataatcattcaccaaaaagagaatggttactaatgttcttccccattatgatcccacataacttcccaatattatcatcttctccttcccattttctcaagtaaactgagtatttcagctactgccaaccatgctttcttgctcctcatgcttcttttgtttacatggttccatttggaagttccttgcccacctttatcttacatttaaattctattcaaccttaagataaaatgcctctatccttagtgctacaaattgaatatttagcagtaagatgctgttttatttatatcttatgcgcatcattttatctaatatttctgataattctaagaggtgggtactgatagtttctatatctttagaaagtaaggaaaccgaggcacagaactattaaataacttagcaaagagtacacaagtagtaaaaagagaaacagaaaattgaacccggacaggcctcctcctgcattaatgccctaatcacttcagggccctgcttcccttctctgaacttccaaagtatcacgtctacacctatcatggcacttaccaagctctgcctgaagtttcagtctttgcgtccttatctcaactcccttaatagactcttagtctccagagcacaaagaccagaccatatcaactttttattgaattaaattaaggatttatacatatttgtgggatggaggagggagggaaggccaccaaagccttcaggtggtgtcctaagtgctttaagaggacaagtgaggctgacccttatccaatggagaaaattctctgaacttgcacaaaattttagagatctgatatcatgagattgttctcagtgtcagcctttcttctcaccatcaccacctccctccctgaaacaaagcatgttttaatagcatctgtgttctaaagaagcttcagctatcactgggtaacaacagatcagcaaagagttacacatcacctgtctgcttatcaatttagtccctttaaattttaaaacttgtaaaaagcaatcaacctacaaaacaaaagaaggaaggaaggaaggaaagaaagagagaaaggaaggaaggagagaaagagagagagaggtggagagaaggaaaggacaggaaaggaaaggaaaggaactgaaaggaaaggaaaggaaaggaaaagaaaggaaaggaaaggaaaaaaggagaaagaagcacagcttggtgttcgtgacttgggcgaagggaagtgttactgcagtttgagggccagggaagactctgctgaacagataatatttgagttgagcctgggcatgcaaagatctgaagaaagagtgtgctggccgggcgcggtggctcacacctgtacttgaggtcaggagtttgagaccagcctggccaacatggtgaaaccccatctctattaaaaatacaaaaaaattagccgggtgtggtgctgcatgcctgtaatcctagctgctctgctcaggaggctggggtcagaggattgcttgaacctggaaggtgaaggttgcagtgagccgagactgcaccactgcacactccagcgagactccatctcaaaaaaaaaaaaaaaaaaaagagtgtgctggatgaacagatcttcgcattccccatggcaagaatgagcctggtgcttatgagaactgtcaaagctggcatgaccaaagcagtaggcaaagggggaggctgagaaggggctgggggtgcacaggggccaggcacaagcagctccacagagcacaggaaggaggctggagtggactcagagggtaacgggaagcccggatgcattcgccaatggacactgccagaagattgctgtggctgcgctatagatcctcagttcccggggtggagggcagcaaccctggaagtcgagctgagacgcctttgaggacatccagccacgagtgatggcggcttggaccagggaagtggaggtgggagtggggcagagagatgtgggtaaagtcaaggcatccttttggaaacagagctgacaagatgcgatgatggagtggacaagaccaggcgcagaatctggggagtgggactgactcccgggctctgggataagcagctagtggggggcagccggcgtgccctggatgagaagcaggccggggaggagcaggctgcggcctcagacggcagaacctggaggaaggaggtcctgaccccacagggagtcagcatccgaggtcctgcccgcccgggtccgtgtgggtctcgacaggcacctgctgtgactcatgagagcaggttgcagtcatcccaagcctgcctccgtgtcggggacctgaggagcgcccggacaccgggagcctcatgggtgcagcgatcaggtcaaaacctggggagtcatcctggggacaggcttgaccccagggatctgacgtggggacgccccgaggggcctggatcctccatctcaggcgggctcccgttccccagctctctggtctatcccacatcggggactgtgaggctccggagaattcccgcagtgcccacaggaaccacttcagaagccgcttgcgcaaccaaaaacgtcctcgtctactgtggggcttgtcattgaaaggggttggtgacacccacgtctgggctcgcgtctgacgtgtgtttacgtccacttcagtggtgagaatctccccgcctcccgcaccccgagctgcaaacaaaagagcccttcatgccccttagaggttgcctttgtatcttttctccagggctcacccatacttatttgttttcgatgtggtgttttgctaagtgtccttggaatgtgtctcggtggccaattgagctggaatagaacagagaaggaggcggccatcagtgccgttaattccttaaaaatcatttcttaaaaaacaaggaagtagcagcaccctgttggtttctccatcagtttctcttctgtcctcagctgtcattcatctttccagaatgaaaggcacctgctgagtccctagagcacagctagaccccagatgtacctcagagccctgaaaccccagccacgctctgtcctttcatgatgccacatggaaggcaatagatcaaatgtcacttttgactacagttatgataaaaaggaggggaatgaacttaggagactctccctggctggcagaaagttcatcagggttgatgtttttatctttcactttaatctatagtttcattttactcggaggttagttgataatatagctaagagatccctgtgctgtctctggtgctaaaatatttagtaaatctggaagaaaatggtttcataaacttcccagctgttagactgcatttctagttggcctcatttcccaaaaagacttacaacccacagaaactccagaggagctgggttatctcacatcggctgttctaaaataaagtggcaaaagctattggctgtttaatgagtctgagacttctctcattagaaggggaataagagagatgccataacggagaggattttgcggttggggattttgggtttaggggagcacggtttgcagagccagaggctctcctggtatatctatggctcagggtacaggggacaaggaggggagcaggaagagtgtaagtgtgtgtcccagcatcccagcgttcaacctcactctcgaagttgcagcctcccagcctcagggggagagggacaacagaaaacatatgtgaagggatgaataatgatttctgtgtctcaatgattttatttatttccttgaccctaaattttggatgtctataaaccacactttaaaaaaattctctaactcagaatgtgaggaatttgggaaattgaaaatgtttatgccctgagctcattcgtttgcctcccatttaccaacagcatgtggttccacatcactgagggaaaatacgctatttaggcaattaccaagtatcatctttcctgaaccctgatccggagcataacctcttgcatgtcactttaaactcattaattaccatttttagtaaaaatgcagtgactgcaggggtgtcgcttgtgtgcctcactccttttttttttggagaaagagtctcactctgtcgcccaggctggagtgcagtggtgtgatcttggctcagtgcaacttccgcctcccgggttcaagcaattatcatgcctcagcctcctgagtagctgggattacaggcatgcaccaccacccccgctaatgtttgtattttgagtacagacagggttttgccacgttggccaggctggtctcaaactcctgacctcaggtgatccaccaccttggcctcccaaagtgttgggattacaggcgtgagccactatgcctggtcctcactccttctctggttctttgtcacattattcctataatggtataaactattcttttttctgttgtttttgtttttcagacaaggtcttgctctgtttcccaggctggagtgcaataatgcaatcatggctcactgcagcctcgacctctcaggatcaaatgatcctcccacctcagcctcctgagtagctgggactacaggcacgtgacatgacatccagctaattttttaatttttttgtagagatgaggtctcactatgttatccaggctggtctcgaacttccaggctcaagggatctgtccacctaagcctcccaaagtgctgggattacaggcataagccaccatccccagcccagaaactattctttttaaatttatttcttttgtacatgtgctcagagattattaaacacaaagcatgccaagtggtaatgataaatgtagaaggtaacagtttgtaatctatttacatgaatcatattaagctacagaacagcacattcttctgacagcctttggcctaggatcccgatcatatcctgttatgggtgatggatttgccaaaatccctttgagaactgggactcccaacctgtacactgacaatttcaggaaaatcttttcaaaattatttacaaaaatcagaataaagtatttctaaggagtaaaaagccctgggaaagatgttgtgtgtgagagagaaagagaggccaggcaaggtggttcgcgcctgtaatcccagcactttgggagaccgaggcaggtggatcacctgaggtcgggagtttgagaccagcctgaccaacatggagaaaccctgtctctactaaaagtacaaaattagccaggtgtggtgatgtgcacctgtaatcccagctacttgggaggctgaggcagaagaattgcttgaacccaggaaacggaggttgcagtgagccaagatcgcaccagtgcactccagcctgggcaacaagagtgagattccgtctcaaaaaaaaaaaagaaagaaagaaagagagagagaaggctgaaccattgattataaccagcagagccagttggcagctactgtgcagccagccacacgtctcattgagacctgcaggaacagccagtaaatgagtgggaatggatgacccttgcacacgaccctgctccaaaatcagaactgtgtctgcagcccaccttgtttccctctggcagaaaaataaccttgagctgtgcagctgctgagctgaacatccagaggactgagcacacccagacctgtaagtgccacagaggaagcatggaatgaggaagctttagctcatcctggaagatgagaacgcacacctgaaaccatgacctttttgagatttttaataacgagcatacttttagactgctcttaggctctgtgtctctgaatttatagagagagagactcctcagtcaggcaggctgtccagtggggccaagtcttaataaaggttaaatcaccatccccttccttcaccatcttcatctcatgatcagagacaatgtcatcctcatcctcaaagtgatcactggtggggcagccccctgtgccaaccctgccccgagtgccaacctgcaggcatctgctgattccttaggacaaccctaggaagtttatgctattttatttttactttttggagaccaggtcttgctctgtcacccccgctggagtgtagtggtgtgaccacagttcagagcggctttgatctcctgagctccagtcatactcctgcctcagcctcccaagtagctgggactacaagcatgtgcaaccatgcccagggaattttttaaaattcttttgtagagtgagccactatttttaaaaccttcttttaaagatgaggaaacagaagttctgagaggtaaagtaggttccccaaggccagtttgtgagtggaggattaaaggttccaatgcagggagcctcactccagcacctgcgttcttaaccactccaccacgtcctttccgtatgtctaaacattctgaaagaaaaatattttataacaaagaagtgcacagtagagtttctcattaccttgatattatattctgtggtccgtgaagacattatcatcaccagacacgtgacctgtggtcacctctaactcaattctctcacactcgcatcccagacagacacagaggctcacaatcacgtgcaccacaaagaggattatttttacgtttttatgatgagttcatgtgcagctattcaaaggctttggaaaccttcccatctcatagcatcttcaagagaatgtttctttctttaacccatggaaaaaaaaaaaaaaaccttcctagtccgaccttgctcaagtctttttgacaatagtccctgttcctcggtcgcagtaacaaagaataaaaatgggtggccaagacacccagccgtgtcctcgtgaagagagaaacagcaccactcacactccactctgcctgatacagtcagaagcatcttgggagaatttccaatttgacagtcgtgtggaatgagaaaataaatgtgcagggaacaggtttgtaagaatttacatccagcttgtgcaacatggcaaaaccccgtctctactaaaaatataaaaattagccaggcatggttgcatgcacctgtagtcccagctacttgggaggctgaggcaggaggatcgcttgagcccaggagagggaggttgcagtgagccgagatcgcaccactgcactccagcctgggcgataaagcaagaccctgtttaaaaaaaaaaaaaaattccaggactcattgttttttctatttgaggggaaggaaggatgacgtcggggcaattagatgtaaacttttggcaggaactcaagaatgacaagtacaagaaaactcaggaaggagtgaaacttctccatatgccactccccacaaactagagttaaaaccatggcaaaaatgtgttgccaaataagtgatgctattgctgcataaatacgaagcattgctgggtttgttgttttctgtgtgtgtgtgttttgctgtgttacctaagccaaatatgaactaatacacaaggacacacagtaaccatgaatgcagtcagacaagtaatgatttacgctgtgtacagattgtgacgtttttggttctttgcagggtcggaataaatagagaacagaggcagagcatccaagaaggaaaaacagaagctcctggcagatgctgaaaccggaaagaggcatgagaagacagcaatgggatctgacactacggccctgtctgtcagggctatgtcagttaccaacccatctgatagaagcagaaggaaaacaaactggtccgtggaaggaaaggccagtggtgatgctggctgcaggcacagctggatccaggtgacatcctggggttcagctttgcccttctattcagaccctttccttgctgcggatgtttacaaatagtgccaagcctggagtcactctctgacttgtcttaattatgtcattagaccagcttttcttttcttttctctttttttcttttcttttttgaaacagggtctcctgtcaccaaggctggagtgcaatggtacaatcacagctcactgcagcctcaaccttctgggttcaaagaatccttccaccttagcctccccagtagccaggaccacaggcgtgcactaccacacccagctaattcttttattttttgtagagacaggggtctcactatctttcccaggctggtctcgaactcctgacctcaagtgatctacccgcctctgccttccaaagtgctgggattacaggcatgagccaccacgcctggcctattattacttttttgagacaggatcttgctgtttcgcccaggctggagtgcagtggtgtgatcatggctcgctgtagcctcgacctcctgtctctacaaattttttaatttgtagagacagggtctggctatgttgttcacagggctggtctcaaactcctggactcaagtgatcctcccacctcagcctcccaaaatgctgggattacaggtttgagccactgtgccaggcctcattagaccagttttctgacaaacgtgatagagaaatcataatcattttcttgttggttagtaaggaatagaatagaaaatagcaactcattaattcaagcaagtgaatatgtagaagagggggtccacataggggagaaggcggccatttttccaagaaggaactctgacttgctgcagatatttaggggaaaattcctaaaataatggggattttaggaagcttggagaaattcaagatgacctattgccaggtaaaggaagcaagttgtcaaaatgtatgaatttgaggctctagaattctccaaaagctttagagtggcctaaataacctgattaatatttttcaatcctgggtggcagtatatagaatacacgccactaacatgggaagagttccaagacatgccacatgaaaacaaaaacaaaacaaaagaaacaagttacagaactattaagatcatgcgatattatttacgtacagcatatacataaatgacatctgggtacatattatgcaaaggcatagggaaagttctggaaggataggatgcaaaccaaaagagaatatacttctggagaatggagagaagggccagaagtcacaggtctttactgcccaggggtgtacctgggactattctacagtcccagctgcttaggaggctgaggtgggaggatcacttgagcccaggagttcagggctgtagtgaactgagattgagctactgcactccagccttggtgacagagtaagacattgtcttaaaaaaaaattaaggccaggtgcagtggctcatgcttgtaatcccagcattttgggaggccaaggcgggagggtcacttgaggcgagcaatttgagaccagcctgggcaacaaagtgagacctcatcgctaataaaaatagaaaaattagctgggtgtggtggtaattagctgagtagctgtaatcacagctactcaggaggctgaggcaggaggatcgcttgagcctgggaggttgaagatacagtgagccaagatcgtgccactggcactgcagcctgtgtgacagagaaagaccctgtctcaaataaattaataaagtttaaaaaaagagctctctagccttgttgcgacattttacatcttcacaagaagaatgtatccagccaatgacttaaataataaaaattcttttttttttttagatggagtttcactcttgttgcccaggctggagtgcagtggtgcgatctcggctcactgcaacctctgcctcccgggtgcaagcgattctcctgcctcagcctcccgagtagctgggactacaggcgtgcaccactatgcccagctaatttttgtatttttagtagagacggggttttaccatgttgtccaggatgatctctatctcttgaccttgtgatctgcctgcctcggcctcccaaagtgctgggattacaggtgtgggccattgtgcccggccaaaaattctgttttataaaagtttcaagcacatcttaaggcttctcattttaagcaaccagcctgtggcactcttctttattatacattcaattcttcatccatcttttgtttttccaaatctgtgtaattcacccttaacaacatctcagcattttgcagagcgagaagcccggcgggaaagcacgctcctcccaaaccacatcaaccaaacatatcccttactttcacgcagaactgtaaaacaaagagtattctttactaagttagagactttaaaatagcagatgaaagaacgccgtgttcttcaagattccgacctctctcctcctctatctttagcatgaagttcctaggatgctgtgaatcactgcttgtttgggaccagcgtcagctgacctgtcgaaacagctgccttctgtagtaagaaaccggcctatgtttggaaaaccacaagtctcttatttttcattgcctggttggcacttgttgcaattagctgtgggtcagaaataaggatcaaggatggtacctggtctcttgctgagagccagaaggaacagagatcgcatggtctctgacccagagaattctcaatcttgctggaaacacaaacccacaggaaactccagttaagaatgaacacaaatgtggtgtgtgatgagcagccacagcaggcactagctgtcagctggagggcatctcggcctcactataaattatctgcaggaggaaacgggacagatctacaggcagtggggacgggcactgggtcttctcatctgctctatccacgagagtctagtgggggtttcatctgccaagtgagcccagtgctttggtgaggtcacgcttgaggcattcgttggtgtgttgttcccatggcttccctttttagcccctccatctaagcggtcatttggggtgtgaggatcttcactcactcactcctgccccgagcccagactcgaaggctcacatcagctgatggaagccaagatcagactcacacacgtgacgccgcgccctcccctgcactctgtgcaccaggaggctgatctcgcccaacgccgtcgacaaggaactcttgccctctagcttctggttggctctgcttggagtcagacctccagggagtggggcctgcctcaccagggctgggctctctgagatgggggttaagaagactggttcagccgagcgcggtggctcgcgcctgtaatgccaacactttgggaggcagaggcgggcggatcacctgaggttgggagtttgagagcagcctggccaacatggtgaaaccccgtctctactcaaaatacaaaaattagccgggcgtggtggtgggcgcctatagtcccagctactagggaggcttgaggcaggagaatagcttgaacctgggaggcggaggttgcagtgagccaaggtcacaccactgcactccagcctgggtgacagagcgagactccgtctcaaaaaaaaaaaaaaaaaaaaaaaaaaagaagaagaagaagaagaagactggttctataaaggcaagaagaagctgaacataccaggatagtgacccgtttctgggacaatgacacttcacggaaaagaattccaaatggccaataagcacaggaacaattgctcaacgtcactggtcattaggaaaacaaaatcacaatgattttccactggacacatcacacacactctgagcaaggctaacataaagaccgaggaccccaaacgtcgatgagggtatggaggagtcagaactctctctcggttgctgggagccctgaacgtttctgctccggagtgctcaccggaagagaagacagttggctctggaagccaaaaagtcatcagtatctgctctaggggcaccgcacacgtgtggggatcttgggaatatagtcccttctgccaggcagaaatgaggactcagtttggtaagatcatctgatttctgtggggttttttggagaagctgaaaattcagaattttgtttaaaatcttttgatgtttcaacactgaccattcaagtgccctgaaaagatgtactggggccgggcacggtgggtcatgcctgtaatcccagcacttcaggaggccgaggtgggcggatcacctgagaccgggagtttgagaccagcctggccaacatggtgaaaccccgtctctactaaaactacaaaaattagccgggtgtggtggcggccacctgtagtcacggctattctcggagtctgaggcaggagaatcacttgaacccaggaggcagaggttacagtgagccgagatcacgccactgcactccagcctgggcaacaaagcaagactctgtctcaaaaaaaaacaaaaacaaaaacaaacaaacaaacaaaaggatgtcttggagccacgtaagtcctggggacatccagtcctctgacctcataaagatagtgaagctgacctacatacaaaatggatttgacaacgaaaataatagcaagtgggtcaaagatcgttttagtccatcctgactgctatacaaaataccacgagtggggtaggttataaaccgcagaaatgtgtttctcacagttctgagggctggaagtccaggatcaaagcatgacagatttcatgtccggtgaggacccccttcctggttcatcgagggcaccttcccactgtgttttcacctggcggaaggggcgaggcagctctctggatcccctttaataagagcactaatccccttcttgagggcttcaccctcgtggcctcatcacctcgcacaggcccccacctcctaataccatcacctggggcactaggtttcaacatacgaatttgcagggagagcagtaacaaacattcggaccatagcaaagattatcgcgggtgtttaaggccagaagaggcatcacgattgtcccccatctcacgcccatttttaaataattgttattacagctgaatactgtggaccatggctgccggtcaagggatctgcctcagacgctttttctaagatctattaaccagcagggagttttggaactttataagcgctgccccataatcttgctaatgatacaaaatggtgttctgtgaaccttaaaacatctattttcaactaggaaaacagaactttcaactcagaagaagactttttcttctttcagcttgcttgataattttgcattccctagtggtgttaaatgttacttagatttataatagaaagcaattaccagacaaattcaccatctccagctaatatggtttccttcaaaatgcaatgtttctgaagaaacagataaaagccaggcttaagtgatcacattgtgtgaggcaattccttttatatctttttaagagtgattacagacaaatctgctttgccaaaaaagccaacgcctagtacacttgtactttatttttttggcatccctaagtcccttatttttttgtaattagagaaatatttggtgaccataacttctctcgcttggatgaggttatcccccttcccttcttcctccctacccggcccctccaaactgtacagcttttcccaaaattctgtctgtgggaaattccagcctctggcccctgcagcttgctttcactgcctgtggtttatcttgatccaaattgtagcgtttcattccaaaccctcccagtgcaaagtagactatatttcaagtcaaggttgcagcccagcgacccttaaggttgggtggtgaatggaacgtgtgaatcctagctctgtcactgcctagctgaaaaaaatccctccaccgcctgttaattgagttttctcattcgtaaagtggaaagaatagtatttacgccaaagggtaaattagcacccctaaggactgagtgagcttacatctgcaaagttcctatgcgtagtagccattcaacaaatattagcacccatccctctctcctcaaagctcaagaaaggaccatattctcaggttccccatccccacatatatttagccctaggagcagatatcaattactttttttatctgtccagaaaccaaacatcctctcttcctgtaaaggcttatagcagaagtggttggcaccacccaatgtccttctgcttctatgtctctcccatcatcccttataattatgttagccttgtaatgagttatgggaatatgagcaaaagtaaagcatatcattcatcccctcccctgctctatccaagccagggcatttaagatgcactggaggtaactcccctccttcttttctgcttgaaggcagaggactctgaaatggagccccaggttggaagagcctggatccctgagtcactgcatggaagggagtacactcactaggaacacctgcattagactctgacacagaaaatgaacttgtatcagctgaagcccctgaaatgtttggaggaatttgcatgtggatggagtaggagggaacatttacacctactgtgaaagctgaagtgggtaaaatccttcctttcctgactgatatggtttggatctgtgtccctgcccaaatctcacactgatacggtttggatctgtgtccctgcccaaatctcacgttgaattgtaatccccagtgttggaggtggggcctggtgggaggtgattggatcgtgggggtggcttatcttgaatagtttagcaccatctcctccgagcagttttcatgatagagttctcatgagatctggttgtttaaaagtatgtggcatggacccccttccttctgctcccactttgccgtcctccatgagtaaaagctccctgaggccttcccagaagcaggtgctgccaggctccctgtagagcctgcagagctgtgagccaattaaacctctcttctttgtaaattaccctgtctcaggtatttctttacagcagtgtgagaacagaccaatacaccagccttggcacagctgggagcaagcctgtgactcaggctctatgcagatggccctctcccctggcactttgaatctccagcagcaatgaacagtctgtacctgcatcctggcctcagctgtgattcctgctgtccagccttctgaagtgcccttggttggttccattttccaagatagaccctctagctccacaatgatgctgtgaacccctgacgtcctttcaaaaattccctttttgcctaagaaagtcagagtgcttgcaatcgagagccctgactaatacacttgatatcagtggagaaagaatgtttacacatacttcgtacatcctcggccaagctggccaccccgatctcccctccactagctctgatgcaatggctgaagtggccacacccttggcaagatctccatgaacatgtcttgtgaatttacgacaatccaaccaaccagtcctggtcattcgttggccataaaatgcacattggcagagaaggatccatgaagccagtgctgaattccaagagcaagctcagatttctgagcgtaagtgataaaacttgattctgggaggagaaaggtcaggataatgcctcctctgtctgagcacatggacctccactctgaagagagaagaacaggagagatggccagagtgaatgctcaggggacagagttttgttccctccattcagccctgctgtggtctcaccaatgcctgggctcaccaggcagttcacacaacttctggatctgttaactttcctcctacggtggcgtccctagatcggaatgaaaatctaatgctgtggccgctgctgcagcaaacaaacccaaacaccgaatggctcacacgtgatggatgtttctgtctcattctcacaagtccaaagggtgcttccatgtagccagcaactgtgtccttcacgtggtgactcagggaccatggtcccttccatccgtggctctgtttgtaatgtgtggccattgaagctgccttgttagtcacctcaagccagtagcagagaaagggaatggctggccgtgtggcggaaatatttgcgggtcacgactgcaagtgtcacgtacggcttctattcacatcccatcggccacatctaactgtgaggtgaggccaggacattcaaccacatgcccagagagtgaggtcgtttgcccaggaagaggaaatgtgtggcaagtgctgacactcggccacgcaaagactcaacttggaggctgaaagtgcagaaaacaccacaagcagccatattccaacccaaatgatcagggcaggtgtgtattgaaagaaggcagttctctaaataggtttgtgtttctgatgactgcctggtctgcccctgggaactaaagtccaggacaagatgataaaagtgtgaccccaattaactgctccaatttcaacatgggagaatatgattccaacatggagaaatatgacttcaacatgggggaatatgatttcaacatggagaaatatgacttcaacatggaggaatatgatttcaacatagggaaatatgacttcaacatgggggaatatgatttcaacatggggaaatatgatttcaacatggggaaatatgatttcaacatggggaaatatgatttaaacatagggaaatatgatttcaacatgagggaatgtgatttcaatgtgaggaaatatgatttaaacatggggaagtatgatttcatcatggaatatgatttcagcatgagggaatatgatttaaacatggggaaatatgatttcaacatgagggaatatgatttaaacatggggaaatatgacttcaacctgggggaatatgatttcaacatggggaaatatgatttcaacatggagaaatatgatttaaacatagggaaatatgatttcaacatgagggaatgtgatttcaacgtgaggaaatatgatttaaacatggggaagtatgatttcatcatggaatatgatttcagcataagggaatatgatttaaatatggggaaatatgatttcaacatggggaagtagatttcaacatgagggaatatgatttcaacatggagaaatataacttcaacatgaggaaatatttaaacatggggaaatatgatttaaacatgggggaatatgatttcaacatgggggaatatgatttcaacatgagggaatatgatttcaaatagagaaatatgattttgacatggaggaacatgagttttaggtgctaagtatgagcaacagagacgttagaccggcagaccctttggaaatgggctggccctcgatgctctgaggtcatggggaaatcttagcctcaaccaaaacaaacaaaagaaaataaaagaaaaccactcttctcgtgccctggttcaaacagttccctttacaattctaagctgatggcagcattgagtagccgcacctgacagctactttctccccttcttcaaggcctgtttgccaccagctcccttctctgagtgcagaaagcctgtgaggctcacagaggcgagggccgccagcccgatgcctgcaaggtggggtgaaaccataggcactccataaacttggccacctggcccccaaaccacctgccacccctggagtcgacggctcctcctgcaccacctcatagctaatgaaggatgcaatcacgttggccgtctggcaaatctacatgtctgccagggccccgccacagggcgcggtgggaattaatactgggaggttgtgccacgttcctgacgagtgcaacgcgggtcagggaggggtgacctttccctctccagatgccgttctcgcctagacaccagccaccctgaaggaactgaaacaggacccctgaagtgagcaggcgcgtgtgggccgctgttagcgcacagcttctatcgagacatctagaatatgtctagatgtctagaatatgtctagatgcagaactatcaattctagaattccacgacgaaatctttctcaaggttcagactccgagcctcagcgttctgctctgctgcccccctcgtggagatgggtgtctactgagctcgcggagcaggtgggtgtcacctgcgctaacaggtacttagtaagggggtccgttcgtcaaatggaaacacgccacccttatcgtgaaaaggggagccgtcagtccccactttcccctgatatccactatctttaccatcatctaatgacggaggatgacccggtgtcctagcgggattaccaggatcccaccaacgctagcctcacctccagatactccacgctcacccagcgtgtgcccaccatgttccaaccacacagaccagccgggtcctccaaaagcccgcatccctcctgcctcagaggctttgcacacacgccccctttccctggaatatgatccaccccaccccacctgtggctctcttggccaatgaaccccggttcttccttgaacctcagcacttccccgacttctgaagctcacagcccccgttagacacgttcacagctgcccgctgcgcttcctcgctgacagcatttaaaagttaggaattaccagtctctgtgcttgtctcccaaactaaaataataagcctcaacaggagaggtaccaagctgagtctgactcaccctttgtctccagccgctagtgcaagtcaggcctcccgcacagggctgcccaattttcttgagtgaagagatgagatgaatcctgcaggtggtaaacagggtggaggtaggctactgccttctgtggaagtgccttcctcgagctacgtactgcacagcaccctaataccgacgcgtggttcaagaaccactagcctcagtgtcggccgggagccggttagaaaaacacagagtgccagggcaccccaaatttctcatgaaagtttgagaggtgctgcacagtgaaactgaggaaagcatgcatggacgaacaaaaacctgtggcttttgtctcagagtccctttgctaaaatcttgccgattgcctctttccaagcatcaagacctgatatcctctgaaatctcagaaatctctaaagcgatgatatttgacagacttatgtggccttacgaaccacctggatacctcaaaggacttttccagcttaaattgatttatctgatgcccccacaattgacagagctactgcagctggcgtcacgacgttaagagctgccacaaagtctccctgttttcttgagtgtttacgttataccttcaatgattgaccttccagagacacgatttcactgaggcttagaacattgaattatttcaagacacagctccacacacacgtattagttcccctaaaaacctggatattaggtgcatctgaactaccctaggtattcagtggcacagcgtctgcctcggcttaaaatatgacttcccaataacgttgttatttctacgattcctttgctggctgtgcatgcagatatctgcggtttcatgtgcctctttgcaaaggcaatcagcccaagcagccgagcgtaaacgcatttctagtcgtctgtgctgctcagggcgtctcagaagacacaccagtctttcctcccctaagttgtaatgctctgaagcacttaaggatttcattagcaatgaactaatcgctgttctgcaagacctgaaaagaaaattaaaatgtgacccagaaaaggacaccgtcctttggtactgcttaggcagccgaatctctcttgttccaaacgacacctgcttgatgtggcttttcttccgtaataagttacaaatccgtactgcgatcattaatcatgagagcctcatccacgtcccctttttgagaaggtgagctggaggggtgattaccgcggaccatttgaacaaaggcgcgtaagagtgtggccacagcgtggagcgtgagcgtccccatgtgtcgcgaaggggaatttattccatgaatgtcgcaatcgccaattgcacagcgattctgagaggcggcagcccggccgggtcctgcgtgccggggatgcggaggtgcattagacagtcaggcgccctaccccatagcacatatttcagctggacagcaaatatctgtgtgccccacaaacaagtcccagaggacagggacctcttgcttggtttaccaagaatcactgagcgtctagaaagggtttggcacaggtgaccaataaatatgtatcgaatgaacaaatacaaataaaaagacaattacgcattttgggcaaggcatgttggctcacacctgtaatcccggcgccgtgggaggccaaggtcgtcttgagaccaggagtttgaaaccagcctaggcaacatagtaagaccccatctctacaaaaaattaaaaaataaaaattaaccaagcatggtggcacgtgcccgtagtcccggttactcaggaggctgaagcaggaggatggtttgagctcaggaggtcgagactgtagtgagctatgatcacaccactgcactccagcctgggtgacagagcaagaccccatttcaaaaattaaaaaagaaggaaattatgcattttaaaaatgtggttgcatgggccgggcgcggtggctcacgcctgtaatcccagcactttgggaggccgaggcgggcggatcacgaggtgaggaaatcgtgaccatcctggctaacacggtgaaaccccgtctctactaaaaacatgcaaaaaaagtagctgggcgcggtggcggcggcctgtaatcccagctactcgggaggctgaggcaggagaatggcgtgaacccaggaggcggagcttgcagtgagccgagatcgagcctctgcactccagcctgggccactgagggagactctgcctcaaaaaaaaaaaaaaaaaaaaaaaaaaaaaaaaagtggttgcatgtttttcttcttgagtttgaagagttctggtatattctggatacaagtcctgtatcagatatgtgactttcaagtatttttgcccattctgggatatacatacattttcattctcttagcatcatttgaagagaagaaattcttgattttgataaagtacaatttataatctttttttatttatagatcatacttgtgtcatatctaggaattatttacctcacccaagataacaaagattttctcctatgttgtcttcctgaattttagcagttttaggtgttacagctaattctattaccttttttgagttaattttatagatgatacaaaatattaattgaggcttgctttttctgcctatggatgtccaatttctacagcataatttgttggaaagattatcttttctccgttgaatttcttttgcagctttgccaaaaatcaattaaccatatgcctatgagttcatttctggactctctactctgttccattgatctttttgcctgtctttatgccaataccacactgtcttaattatgataactttgtagtaattctaaagtcgggtaatgtaagtctaccaactgtactgatctttttctaagttgttttggttcttctaggtcctttgtactaccatttaaattttataatcgccatgtcaatttcttcaaaatctgctgagatttttattggaatggcattgaattgatagatcaatttggggagaattgacatcataataatactgaaactttcagaccaagagcacagtctatggcccattcatttagaccttctttctcttagtagtgggttgtagtgcagtgtcctttacatcttttgtgtctacatcatttttatgcctttgtaagttatatttctatttcaatttctgcttgttcattatgattacagaaattcaatacatgttgtatatagattttatatccttttttttttttttttttgagacagagtcttgctctgtcacccaggctggaatgcagtggtgcgatctcagctcactgcaacttctgcctcctgggttccaatgattctcctgcctcagcctccccagtatctaggattacaggtgcatgccaccatacccagctacttttttgtattttagcagagatagggtttcactgtgttacccaggctggccttgaactcctgagctcaggcaatctgcccacctcggcctcccaaagtgctgggattacaggtgtgatccaccgtgcctggcccacttttcaattatagcagcttttttgtagatcatatagaattttctacatatacaatataccatctgcaaataaataatgcctttacactttccttcccaatccagttcccttttatttctttttcttgccttattgcaagagcaattgcacattgcactgcacctccagacaacatcgagtagacacaatgagaacaggcactcacccgtgccttgccctgatcataggagaaagtctttttagctgcttaagtataaatatatattaactgtaaattttccatagatttctttcattatgatggggaagctaccttctaattatagtttgcagacagttttaatcagaaatggatgttgaagtctgtcaaatgctcactaggcttctattgagatgatcgtgtaatgtagctcctgatatgtttaattatattgattaatttttaaatgtcaagttaatcttacatttctggggtaatgcctacttgctcatgatgtattatcctttatatatatgttaatttggatttgctaatattttaagaattttactcaaatattgatgttcagtgctataactttccctctaagaatgtaatgctataaatttccccctaaagccactttaactcatctcataagttttgacatgctgtgttttcattctcatttacttcaaaatgctaatttttcttttggttccttttttgacttatgggtagacatgtgttattgagtttccaaatacttagagattttgctgagttttttttattgatttccaatttttccaactttttattccacatgaccaaaaaatatattttgtaaaaaaaaaaaaaaaaaaaaaaaaaaaaaaaaaaaaaaggggccaggtgcggggggctcacaactgtaatcccagcactttgggaggccaaggagggcggatcacaaggtcaggagtttgaaacccagcctggccgatatggtgaaaccctgtctctactaaaaatacaaaaattacccgggcgtggttgcgggcgcctgtactcccagctacttgggatgctgaggcaaaattgcttgaacccaggaggtgggggttgcagtgagccaagagcacaccactgctctccagcctgggcaacggagagagactctgtctcaaaaaaaaaaaaatatatatatatatatatatgtatatatatatgtatatatatatgtatatatatgtatatatatatgtatatatgtatatgtatatatatatgtatatatgtatgtgtatatatatatgtatatatgtatgtgtatatatatatgtatatatgtatgtgtatatatatgtgtatatgtatgtgtatatatatgtgtatatgtatgtgtatatatatatgtgtatatatatatgtatatatatatgtgtatgtatttatgtattttgtgtgacttgaagtcttttaaatttactgggacttttcttatggccagaatatggttttccttggtaagcgttctgtgcgcacttgaaaagaacgtgtattctaccattgttgagtagatcgttttaaaagtgtcaacttggatgatgatgttcatgttgttcatgaaaatgttcatctttactgagtatttgtccacttggtctatcagttgttgagtgagggtgttaaaatctctgacaatatttgtagtttttctacttcttgcacatctatcagtttttgctgtgcatattttgatgctcttttattaggtgcatgaatgtttatgataattaagatttcttgatgaatttatcccctttataattttgtaatgatcctcttaattcctggtttttctgctacaaagtctactatctctaatgttaatatagtcaataagcttccttgctattagtattagcatactgtaactttttctattcttttacttttaacttacttgagcctttaaatttgaagtgagtttcctgtaggcagcatactagattgtccaatttggcatctctttctttcaatttgaggtatttataccatttacatttaatgtgattactggtatggttagatctaaatctattatcttgccatttattttctatttatcctatctattctttgttccttcttctttttctgccttctattagattaaatgttttaaatgattctattgtatttccatgctttgcttattggctataattctttactgtattattttagtagctgcattagaatgtaccacattcatcttacacctactgcactccaccttgaggtaacattacatcacttcatgtatggtataaaagccttataaaaatacacttccatttctcccttattggcctttgtactattaccattatacatttcacctctacatatgtcataaacctcatatgacattgctttaaacaatcgattatgatatgaagaaattttaaaagtaggtaaaatgtttatatacccacagagtgaccataaccagttttttttcccttgtatagatacaggtttccatctgtatccttttgcatttcttgtagtacaggtctcctggcaattaattctttcagcatgtgttggtctaaaaccttctttcgcctttgtttatgaaagatattttttctggctgtagaattctaaattggcatttggggggtttatttcatgatcagtgccttaaagatgctgctccactgtcttttccattaacattgtttctgatgcaaaatctgctgtcttccttatattttttcctctcaacaaaatgtatctttctttctccctttcctgccattccttggctgctttgcagattttctcttgattactagttttaagcattttaattataatacacattgctgtggttttattcaggtcttttatgtttggggtttattgagcttcttggacctgtgagttcatagctctcataaaatatagaactttttcagcaattatcttctcaaatgttttgtctgtctaccccgctccttttatatctacagatggtccctgacttacaatggtggacttaacatttttcaactttatgatgggcttgttgggacataaccacatcatatattgaggttatctggatttaacagtggttcaacttatgactttttgactttaagatgggtttattgtgatattgaatgaattttcaacttacaatattttttacttatgatgggtttatcaggacgtggccctattgtaatttgagaagcatctggacacttgcagtaattccacagattaccaatgctatgattatttttattttgtcctttttatttatttcattttgaatattttgtattgctatgtcatcaagttcactaatatttttttctgccattaatcctatcaaatgtgtgtgtgtgtttcttttagagacaaggtctccctccatcacccaggtggagaacagtggcacaaacccagctcactgcagccttgacctcctggactcaagtgattctcctgatttagccttttaagtagctgggaccacaggcatgtgccagcatacccagataattttttttatcttttgaagagacagggttttactatgtttcccaggctggtattgaactcctgggctcaagggatcctgcaaccttggcctcccaaagttctgggattacatgcatgagccactacacctggcctgtatttttttaattgaattatagttttcatcttgagacattgtatgggtctttataatattctctatatcactgcttaccacgatcagtctttcccctagcctcttgaacatgtagaacatatttacaataactgaatgtcctttactaccagttctatcatctcttgtcatttctggactctttttttttttttttggttgattgatgtttctccttaacatgcatcacatggccaggcatggtgtctcacgcctgtaatcccagcactttgggaggtcaaggaggcggatcacaaggtcaggagatcgagaccatcctggccaacatggtgaaaccccatctctactaaaaatacaaaaaattagccaggcgtggtggcacacatctgtagtcccagctatttgggaggctgaggcagga

SEQ ID NO: 711 - DNA, 225724 bp, Homo sapiens
  misc_feature (1)...(225724): n = A,T,C or G
actttctctgatgttttcattgctgcattatccttaatgctcagatggtctctttggctagtagggtggactcttgagtccttttggtaggcccctcattgtctgtgacagcctttccactttttgctgtgacaaaagtccccatgctcatttcacccctttcctccctgggcctggcatcagccatttccccaggaagccctgctcctgtgtctgaagaatgtgatctagacaccgaggtcagcatgctggggaatgtattgctatacatgacgatgacctgaccattctttcctaggctttttcagtggactgggctaagatttttttaaaagataaaatgaatcatgatttgttactgagaatccaaattaaattaagaataaaggaaggactaaaaatttttttgaaaggatttttacttaataagggcaatattacatctttatttcctttcaactatgccccaaattctggttctcactgacacataattattcacttgctattcatagtacacacacaacagactcaaaataattatgccagcatctactgtcaagagtatgattacttaaaggtttattttttattttttgtgtcattctttttgtctataggtatatcccactgggctagataatcaaattactttttgttgttgttgttgttgtttgacctggggtcttgctgtgctggccaggctggagtgcagtgactgttcaccagtgtgatcatagcgcactacagcctcgaactcctaggctgaagtgatcccccgagcacttgtgactacaggtacacgccactgtgtccagctacaaattactgggttttaaagttgctttgaatagtttttcctctgtgtgtttatttttttgagatggagtttcgctcttgtcgcctaggctggagtgcaatggcactatctcggctcactgcaacctccgcctcctgagttcaagcaattctcctgcctcagcctcccgagtagctgggattacaggcacccgccaccacacccagctaatttttgtatttgtagtagagacagggtttcaccatgttggccacgctggtctcgaacccctggcctcaagtgatccgcctgccttagcctcccaaagtgctaggattacaggcgtgagccactgcacccggctcctctgtatgtttatatcattaacttgacttactgttaggtttgctttattttttctttgaagtttagggattaatttttttaaatttaattttgcattaagttttgtgaagtatttatgtcattctgacgtcaaatatataaaacatattcggagtctagcttctttcttcatcgtccccttgtttctcctttccctttagtggtacccagttttaaagtttgttggttatgtttccatttttttgtatgtgtgttttccatgtatttgtatatatgtgtgtatatatatctgtgtgtatctgtgtatatatgtgtgtatgtatatatatctgtgtgtatctacatatacatgtttcctcttgatggggttgggcgcagtggctcgcacctgtaatgccagcactttgggatgccaaggcaggcggatcagttgagctcatgagttcgagaccagcctgggcaacatggcaaaatcccgtctgtacaaaacatacaaaaattagctggatgtggtggcacacgcctgtaattccagctactcgggaggctgcggtgggaggactgcttgagcctgggaggcagaggttgcagtgagacgagattgtgcccctgcactgcagcccgggtgatagagccagaccttgtctcagaaaataatttcctattgagggattgtctttttagtagattgttttagaaggtcacttgttcattagctttagttttataaagatacttcaaagataagaaataaaaggaatttgaagtcaggcttggaacattttcatttttaaatttggaaggtaattatttcctatttgttcctagctattgaacaaagttttgatcaggatgagagtgggaaccggacttcagtggatcttcggatacgaagaacccaggtttgctatcagcctcgtttagattaaagtaatgtcgcagaataagtgtttttactttcttcttgcagactctgaataatttcatctttactgtcatgcttatcctcatagtatttctgcacaaaaataatatagtattgtaaaacaaaagtatctgagacagaggtttattttgccaaagttgaggacacacttggagaaaagaaatacaaattagagtaggatctgtggtttgtgcctttcctgaagagggttttgaggacttcagtatttaaaggggaaagagcgggcaggagaggaaggaggaaaggggaaaaaaaagagaaaaagtgggggtaggcagcggggtggccacactgctgtgaggctttgctcagggctcactgcgttcacatttcacatgtgggaagagaggagtgggggtcgattctgcactcctcccgtgcccagatccgcctcttacgtgggccagtgtgagcctgaggtgagggaggagctatacatgcatttctcagggtgggccgagggtgacttctagtcttgtctttgtcctgtacctgtgaaggtaagcggctaatgtacattgtcagggtgagattctgcagaactctgttttagagttagtttttggtgggggggatatggattctgaaagattctgggacctacgaggaatttccttgtgagcactttgtgcaggaggctgctggggcgatgtgcggccttctgtcactgcagccatctgtttgagaagaggagggagggcagtgttttgcatgactcagttcccaagcttaactgtccctttgggatagtgagtgtgaggtcctgcgattttattttcctttcacagtatttatagaaatctctttattgtgaagaaaaatctattcggtccatcaacagagttctattccaaagagtagggaattatccaaatgattttagtgtttgtggtaaggccgccacgttttagtggtttgtggtactgcccagaggaagacagagccctgaggcctcgagggcacgaggcgatgaagcacgcgggctctggggtccgcctgcctgggtcccctcatgggcacaaggcgatgaagcacgcaggctctggggtccgcctgcctgggtcccctcatgggcacaaggcgatgaagcacgcgggctctggggtccgcttgcctgggtcccctcatgggcacaaggcgatgaagcacgcgggctctggggtccacctgcctgggtcccagtgctgatctgtgtttatcagaaaagcctgtgaccttgggctaatgacctcaaagtcatggttttctttaagtagggttgtgaccggcatagtaggggtcttgtaaaaattaggtaagatcatgcatgcaaagttcttagcacagatgctgccatggggactttgccattgtcattttccatttgcaggagcagaataacatgtagtttgagtttccaaaatgcatgtcttgcatgtcactttcagtagaaggcatggccctcagatacgaatgtagttttcctgtgttgttagcattcggtgctgtctcggaagtttgtggaagccatggcggagtacaatgaggcacagactctgtttcgggagcggagcaaaggccgcatccagcgccagctggagataagtgagtaatggagactccgtctttgttaaaatcatgtttttctcccttaaggtctcacttcaaatgactttaacttcagaaaaggaaatccatgtctattttcaccaatagtgtaaaacccaaagaccactcgtagcttcctatgccgtgagtcaggcaaacctgttcttcctgtcttcaggaagtcctaagcggtggggtttaccttgctcattgctgttgcttttagagtttcagggagattgggagagtgctcagtcatttcctctttgagtgtttctgtgtcctcagtcccgccctgccctggttcgggggcatcttcatggctcctcacatctctccttgtctgtgagcagaggcagcggccctattgccccagactcttttcaggggtgtctatggggacagttggctgtggcagtggagatggcgccttcttcggggacagacgggtctgtttcagggataaaggttggtcaggtttgtagactccccattgtgaaagattggggttcccaagctcgggtccttcagctgtgacacaaacccactgtgaggacgtcccactgcagctgctctgcctctccccatgagactgggggccgtggacagctgctcatgagcctcaggttgcctgctgtgctgtgagtaggaaatccctttgtccctgacctggggccttggaccttctgccggcccccacggagccctggcaggccagcgtgtcagctcgcaggtcagatgaagcctcaggcccatcccggctcccaacgccgcacatccccctcagagaatgttgtcatatgcccgccaggccgcttgaccttgtcccacagctcagcgaggctcctcatgttttagatactcttttccagtgtgtttggttttggtcagtttctcttgcttgtctgatctgcctttaacctcctctggtgtatgtttcatcggagacactggtttctgttgctagttctgctgggtgttttacatgtctgctgtgttgctccccactgtacaactgggacgcacttgtagtaacttgaaccgtctttgtctgccaactccagtgtcctgtctgctctggttggttgatttccttcctttctgtggcttgtgttttcctgcttctttgcgagcctggtaagtttcgagtgtgtgccagacattgtgaacgttactttgttgggtgctgagtatttctgtattttgagtatttttgtaaatctccttgggctttgttttagaatgtagttaaatcacatgagcatggtttagcctttgggatcttgcatttagagggagcagagcagctttatttgagggcctgtcattcctcactcctgaggtaagacccttctgagcacctgctctgatggccgtgaacctcatggcaccctcgtctgcctggcagcgtgttccctctggcatgctggtcagcactccagtgagcatgcggggtctgtgcagctcgctctctgcatctctctcatctctcatactccatcttgcaaatccagttgccttggtctcccctgagctctgtgcctttgccttaggacttcccctgggctccacctgggccctttctgctctgtggctgacacgagagttccgtctgagggcagcagcaggctcacctggcttgtttccatctgttgggaatcagtgtgtggcctgatgctcagtgtcttggaaatcgttttgtagattttggtgggtttgtggttatttcaagtggcagggaaaatacggtccctgttgctccatcctggcagaaatgctcaatcatgatgtcgactagactgcttttctatgaaaaagtttttacaaaccactttgacttcagggatctgttagtactttttaaagtgaaagtcatcattacaggcagccggttgcactgtgaggatttatgctctgggactctgtggtgagcgcttttctagcacagagttccccagcctgggcttgaaggccccgcaccatctctcctgcaggtccatcctgtcttcactccccatgtgaatccggtggcgtgatcagatcgcctaagtctcttctctctttcccacattattctatctcagcccacagaattcatttccagtttcttctcttgcaatcatactctatcgaatgcagtactgtttgtgaaagtgtcttataagcaatgaagtatcatatacgtgttgggagttttttttagtaattcctttaagtctgttaaattctaaaccctccatgtggctattccgaagtgagcaggtctatgcaaactcacccccaaaggctgagcgagctgagacgccaaagaaagaggctaacaaatccagtttctcgaaggaaacattggctagggacgtacgaacagaagcccccgagagacagagacggtggaccccacagccgcctgccctcagaaagtgttctttatacagcaggctttcagggtagaacgtgtgcagccggccctgtcttctgacttgcttgacaacacttgggaccactggtcaggctggatgagcatcttgatgagaggttgcctgtgccggaggcatcgtcttcagacctcattgcagaacagcttggcatgcacgagtcgagcatcggtcatcacggtggttttgcttcaggatggcgtcactctggccacacagcgggctgtcttcatacagtggtcttctccaaatccttgcacctaaaaccattttgtcccctttctttcttccttccgtcagccctgtcatcaggcaggtttcttaccttgtatcacaggatatcttttcctgtgctgtatgctttgtttcttcaaatggcaagtgagtttcttcttggaccagggcatgttacataggtccacagtgctttctctggaatggttggggctgtatgtgtttcagagttcagaatttttcagattttaggaagatagtacaatgtataagaggtgtattatgtaatccccaggtggggtctaggactgcaccctgtaatcaggcacattcacacagctctccagtgaaatgtgagtattcacagtaagggggaggagttaagattataaatagccatgactcagtttaggtcagattttgccgctcattgaattttgacatcgagcttaaggaaaacccagttttcataatgttgtggatttcagcattctggataaggaattacgaatgtatactgcatttcacattctgtaaccccaggctgtttcttagacttagcagttagccggtgggaagacctttgtgaacgtgagacatgaactgtaacttttagtttgtttttttttttttttttttttttgagagagagcctcacgctgtcacccaggctggagtgcagtgttgtgataaccacttattgtggccttgaactcctggatccaagggatcctcccacctcagcctctcgagtagctgggaccacagaagcacaccaccatacctggctaattttattttttgtagagacgaggttttcactatgttgcccaagctgaaatttctagttttgatgattatattttacattatttagaacaagtttcatgtttttaaaaaagcaaagcaaaactcagagaatctccttattgagctattttgaatagatttttaagttttattttattttttgtagagatagggtcttgctgtgttgcccaggctagtctcaaactcctagcctcaagcaatccttccaccttggtctcccaaagcactgggattatacatgtaaaccaccatgtgtgctctcaaatagatttttaaatgattgagaattacctcccaaaaaatagtgtaagtaaacaaattttgcaatttactaactttaaaacttttttcattaaatgacatctcaacaactttattgagaagtaaatctcttaatatgtgaatgatatttggagcatacaattaattcagtggtttttggtgtatttccacacacaatcaatttaaaacacttttatcaacccaaaaagaaacttcacacccaccaccagtcattccccatttcctctcctagcccaagacaactgcattctactttttactcctgtacattttcccattttggatgtttcatataaatggaattatacactatgtgttctgtgactgacttctttcctgtaacacagtttttccaaggtttcaccatggggtgggcagggtgtggtggctcacatgtatactaatcccagcgtgttggttgggaagccaaggtggaaggatcgcttgaggccaggagttcaagaccagcttgacaacatagcaaaaccccatctctgtaaaaaaaaataaaaataaaccaggcatgggtgtgtgcctataatcacagtcacttgggaggctggagcaggaggattgcttgagcctaggaggtcaaagcggcagtgagctgagattgcaccactacactccagtctgggtgacagagtgagaccgtatctttgttaaaaaaataaaaagggctgggtacggtggctcacacctgcaatccgagcactttgggaggctgaggtgggcagatcacttgaggtcaggagttcgagaccagcctggccaaaatggtgaaaccccacctctactaaaaatacaaaaattagccgggcgtggtgacgcacgcgtgtagtccccaccactcaggggtcagaggcatgagaattgcttgaacccgggaggaagaggttgcagtgagctgcgacggtgcccctgcactccaggctgggcgacagagtgagaccctgtctcaaaaaacaaagcgacaaaaaccaaaagcgtcctttgtttttgtggctgagtcgtatgtcagtgtgcagctagaccgcagttagctccttcaggcatcgggggacggacgtttgcgttgtttccactttttggcaattatgaataatgctgcttattagatgacatttgaattatgacatttattcatttacttttgtcttctgtggcacaaactatgaaaaatagtaattaacaattaggtttccaaaacctgtgtacatgtttcttcgaagtcattacacatttaactcaaaaggaaagcattaacttccaaacatggaaagtgttcaggcatctgactctcattacgtggactttattgatcctcatttaatacatgctacattcagctcaacccccttttacatgaggcggagttaaactcttagggaaaccagtgtgccgagacattgtttaccgatttcctttctgcagttgtttctcactaatattaaaatgaaattttattgtttataacatttacaaagtttctcggagtatttttatttcttcttgctcctcaatcttaggttcacttctcattgtcaatatctgcttaagaaaaggttaaaaaaattactgaaaaatgctaacaactatgattgtagttgctaacttatggttgcaaatggctttgtttttaaattgtgctgcattctgagtggggctgtggttgcgggtctttcagctgggagaaccaccacagacgacgagctagaagagatgctggagagcgggaagccatccatcttcacttccgacgtgagtgggggtgcggccctgtggctccatgtcctcttctgtagacagagctttttaaaaaccctttaacttccaaacccatcataagtttattaatattatcttttatttttgtttttccaagattatatcagattcacaaattactagacaagctctcaatgaaatcgagtcacgtcacaaggacatcatgaagctggagaccagcatccgagagttgcatgagatgttcatggacatggctatgtttgtggagactcaggtagttacagactcttgcattctccaagagagatatcagtcatgtgtaaaatcttactgcatcccactctgtctagtggatgtatctaggaaagctgttattttggatccaccaaattcaggttaattgcagtgttatatgtgatgctgaaatgctggaagcagctttaacagttgaactgttaacaggaagggactggttcagttgattaaattatggagtgttcataggtcagccttttaggcaaccataggcaacctaaactttgttcatggagaattcttactgaaatatgcagatgtttgtgctagaattaagagaaaagggagatacaaagatcttctgtgtatgcccgtacatatgtatgagtacataaacacaaacacatggcacgagcttggctccataaaacagtatccacagaaggaaaggcgtatatcaaacagtgtaatggcagtgagactatgggaattttaatcttctctaaaagtatttattttcagattttctataagaagcatatattacagtaataactaggagaaatgtctgaaagaatcaaccccaagtggggatacaatctatgacacagatgcaagcttgtgcctgttacacggggtttcccatctgcccagtaacacagatagggagtgaaagcaggtgtggaaaggcccttctgagtgaaccgaagagttaatgcaattcttaataaatagaaaactcctctgggaggctgaggtgggaggattgtttatgcccatgagttcaaggctgtggtgagctatgatcatgccactacactccagcctgggtgacagagtgagaccctgtctccaaaaaaaaaaaaaaaaaatacacacatatatatgtatgtatgtatatattgaactctccatgtaaagtacgggatggatcacagatcacatgctctgtgatgtgcatgggtatgttcacactcgctctttgtctttgaataaggtcttctcgttatttttcaaataccatggagataagactctgttgctggttaggattcagctgaccaccaggtgaagcggaagcatttatatcaaaccatcctaagtaaatggtttcctcacttgtcctgagcctggtttcggatctgttttggctggagtcatcccctaagtaggttcacatctgatgggcttattttctgagactgcctggattgtgtaaggataggaatccatccacacacaggattgttcctgcctgcttcagcaaccttgttaagaaacactgtattttgaagaactttataatgagaatgtgtgtgaaaaactcaggcaccatgcctatttttttttttttttttgagacagggtcttgctctgttgcccaggttggagtgcagtggtacaatcttggctcactgcaacctctgcctcctgggctcaagcagttctcctacctcagcctcccgagtagctgggaccacaggtttgcaccactacgcccggctaatgtttgtatgtataagcatttgctagaggaaaccaacagctacacagagggcagggatgggacgatcttactcctttttgattttgggggccccgttgccattcattatatggtaagtggagtgtggggagtctgattaccattggttacttatttccaggaagcattccaaaggaaaccagctggacagaaagaacgagagatgatttctgtaattactaaagcttttgtagtaccttagacttcaattgtaattgctctataccaaatgcattgcattaagctccgttagaaaaatggctgcatccctggctttgtttcactgtttccttttagaagtctgttggtattgcattatattgactcatctaatgcaaatgtgtgcatagtcagagattactagtaagttgaagtttgtgactgagtgagttaactctccgtcattcttcaatgctttacgattcactgctgcaggttgtgtctggacagacaaccaggtaatacgttacctccctcacactttgctgaattcacctctgtttacattttgctcattaatgtagtcagctgagtgtcagatgtgagctatgctcagtttactgatttaaagaagtagttacaattttctactttgtggaaaagatgtcattctttgtatattgtctgtctgtgcataatggtaaaatactagttcaaccaaaagctggctgcctcccttcaccctgcccatctgtcgaaagtgtctgcgtgttaaaggtatctcagaattgacttgaggtgcctttaattatcaacatggtggcccattccttttcattctttttaaaatataaattgagttttgattgctttgcactggcacatgtataatggcctcatcttttatctttctgtaaatgtgaaaaaaaccctcagtatccattacatgcacatcgtgtttatataaaacctttgttctatggttgtcttaaagatacatgattaagccatttgaaaatgtcttctaagtttgaaactttttgttttaagggtgaaatgatcaacaacatagaaagaaatgttatgaatgccacagactatgtagaacacgctaaagaagaaacaaaaaaagctatcaaatatcagagcaaggcaagaagggtgagtttggcttcgaagaattaagctgcgtttttctcttcatttggtttcaagttgtaatacattgatgtaagcctgcctaaaaggtattccaagaaataattaattaataaatgttttattttaaaatggaaataattttttttgctaaaaatttaaaaggtttattagatgaattatttgtagttcatcttttgtgttctaagtaattgaaaccctagggctgggtgtggtggcacgcctgtaatcccagcacttttttttttttttttttgaattggagtttcgctcttgttgcccaggctagtagagtgcaatggagtgatcttggctcactgcaacctccacctcccgggttcaagtgattctcctgcctcagtctcctgagtagcagggattacaggcacccgccaccatgccaggctaattttgtattttcagtagagagagggtttcaccatgttggccaggctggtcttgaactcgtgacctcaagtgatccgcccatctcggccttccaaagtgctgggattacaggcgtgaggcacggtgcctggcaccaaattgttggctacacatttgatgcagtgaacatttatttttaatttaggttattcgtgacttcttggtttggaggaaagaagagaattatttgagaccgtggacctgcagtcttaggtagcacccacttaaagggatcctcaaaagaagggaacccctttcactcaagatgcacagactttgcattaaaaagggttcagggaaccctgtgtgatttttttgttacggggcaaaaatttaaaacttactctcctaacttaggcattttatgatagtgcccctgacactggagagattatgggtttttcacattgtcacctccttgtgctaatacacagagatgctgattttcaccgtgttaggaaaaaatggagtgagacggtgtgtgtggatgcacctccaggcgatggccctgagacgcacccccgggctgcaggctcagccgccagggcacaccctcactcacacccccgggctgcaggctcagccgccagggcacaccctccgcttttcctgggtatgtctaagtatgctcgtcatctctgaaatgccagacatggtttctcatgttatttcatttattgctttgaaaaaattggcccctaatgtaaactgaggtgaagagatacctgtataaagtgcttaacttagttccaggcctaagtcagctttcattaaaaacaggcagtcctgttccttttctccatgacctgaacacgtcagtctggtgaaaacgatagtgaaagttcgttggttttacaaagggggaaggtggtgggtgtgatacgttttcattctcctctgtggatgagcaagcctggctctgtgaggtgcttggggtctgtgcggtagctggcgtataaactcgtcagagacgtgatgcctgtttcagaaatgacactgtctttttgatgagatgcctgctaatggaaccctcctggcttgtctccctgtccccttgccgctcaaatgctttgctgctgcccctggctcaggtgtgggtcgtccccactcctagtgtcctgcatttattcccgcggagccatgtggccctcagagggaggccaggcaacgtttgtagaagggttttttttttctgtgtgctatgtcaggagcagtgaagaagtaactgccaagaacataaaagaaggagcgaaaggccaagtactgagtgtgtcggggcttcatgacgaggcagtggggctctccgtcactgagctagcaggcccgcacctctgtacatgcggaaaactaactgcatgtctcagtcatcagaaatgtggcaaaatgacttggtcgtgctgtccccatggatgaaacctgaaataacagttacatagcagcttatcgccaagtagtctgaccttattaagtcactctctcaagaagtcgcccaacagtattaagcagtgtcctgtaacttagcttctaaagtgagttctgatgggttgttttgctttattttattttatttttttgagatggagtcttgctctgttgcccaggctggagtgcagtgacacgatcctggctctctgcaacctctgcctcctgggttcaagtgattctcctgccacagcctcctgagtagctgggattgcagacccacgcccggctggtttttgtatttttagtagagacagggtttcgccatgttggccaggctggtctcaaactcctgacctcaggtgatccatccgcctcggactcccaaagtgctgagattacaggcgtgagccaccacacctggccaggtcgttttattttaaatgaaggatgtcttttaatgtggcaatatgaaattaaccatgcatgatataatcagcttgcttttctttgacagaaaaagtggataattattgctgtgtcagtggttctggttgccataatcgctctaattattggcttgtcagttggcaaatgatggtgtggataacgtcagtgtgcatgcctctctgccagggtgggagtaagtaactcatcaactaatttacttattaacttttgcaattaaccaataatagtatttgcttaattgtaatagacataaaactaataaaagcttgccagccacgcagtacagataatgccatctagtgatacatctgcctgtgtgctgattcgagtgcccagccactgtgtttactgagaacaagcacaggctgggcggtaactcatttttaaaccaaggtcaccttcttatcccgtttttaaaagtgtttttgagacagggtctagctgtgtcacccaggctggaatgcagtggcgtgatcatggctcactgcagcctcgacctcctgggctaaaactgtcctcctacctcagcctcccgagtagctgggactacagacgtgcaccagcacactcggctaatttttaaaaaaattatttttagtagagacgagaactctctgtattgcccaggctggtctcgaattcctggccctcagcctcccaaagtgctgggattatacatagacatgagccactgtactcagcctgaatcttttgtttttgatctaagaccattagctctttacatgtagtggatccttcattaaatgtcatagaaattcagtgaagattaattctcagttgtaatgttttgtctcctgagttttagcttttagagtaattgcaacactgaaaggtactttataaaatacactaacgcatcattttactatggaatcgagggcatggatgaacgctgagaaaaacattgactgaaaggaacatccttcgacctttctataggcagcatctattttatttaaaaatatttcctttaatattaaaaggaaaattacgtattatatttagttagcatgcctgttaattcttaaagaattctgaatataaaaggtatcagtttatttaaagaatcaaggtgtgagtgtcacctttcctaaacttcagcaggctttgtggtttccccctggttttcttctgcattgggagccatccttgcactggccctgaagtggcaatgctgtcggtgtgttacaggtggacacagcagtgatttctctgtaaatgtttggcacaattcttgtattagacagttgtgaactgttcccaggtgtctagagtgtggcaagtcatccccaatgaatttattcttgggttatggaagtgactgcagacttgatagtcacccaaggctttttaaaaagttaacatacagcagaaaggaatcacgagcatggttaagtctcactattgctttgtaatctttaagatttattccttcaacatggcaacaccctgtctctacagaaaaaaaaaaatccaaaaactaattgggcatggtggcacacgtgcctatagtcccagctacgccagaggccgaggcaggaggatcacctgagcctggggaggtcgaggctagagtgagtctagatcgcaccacggcactccagcctgggtgacagagcgagaccatctcaaaacaagagattgatatcttaatgtgagcatctgttacgctcaccatgcagttaccagatgagaagttttccagttagtcttctgacatttatgcaaaagccacaaaattacacctgaaattactctgtaaggagctctgggatgctgcgtgtgttaacattccattatttggcagtcagaactctcttaccgtctatttttattaggcaggatgtttgtgtaggatgtttattaggcaagatgttctatttttttcttcttagctttgctgaaaatattgtacgtgatttttcttcattgttatagtagtatttttcaatattttcatgattctaacatgtactttctgagttttttcctagtagctataatatggttagtttaatgtggttacactaaagataaaattacaatttgtagcgcggacacagtgaaatgcgcgacttttcatgggcactacttggcattaaggttgactaaaagaaggctcctctcagtgtgacccctggggagtggggcttgaagtcctgtgccccgggcctggctggccatttcaccctagtgtctgtaaataagaatgaacatagaaggatcctcattcataaaaagcagaccaaaatgaataccagcagttatctttgcataggaaggcagtggttaatgtccttaacttcacttttaaaatattaacatagcctttcatcctttagcaattggccttcctggggctggctgctgcccctccctgcagggtgtgccaggtgcaggcctgtcaccccggagcatgggtgggatgggctgctttaaggagacaggtggagtcttacaggtattcggtgagagggccctggcccagacctggagctggactccccagggtgtaccctttccactctcgctgtcaccaggagattagatgactcctgagtcctgtaccctagactccatgtagttgacagtcatcctgaaagccagatgtggcaggaaagtgcacacacatcgagcacccagacacgtggcaggcagcacaacagcagcaggagatgagagcacgctgcgtggagctgactccaggtggcccagctgccagcacactcacttgctgagcgggagggcgcgcgcctccctctggagggagggaaggcatcacagagaaaaggaagaagaggtttctctaggaaggtgctgagagtggggcgtaggagcgcatatagaggatgagagagtggctggggctttgcaggaaatgtgcgtgatgttaacagggaaccagagtttgagggaggggccctcctgcaggcagctctccccggtcctgaggagtcactgggaggctcaccggggcctgccatgcgcctcttgataaccctgtataactgactgagccggcagtcttggaactgtccaggctcagcaaacaggatttcttaggtaaaagcactcgtacatttggaactgtaattaaaatgatggatctctgctgttcaaaaagagaactcaaagtcctacagcgcggtgcctcctgttgtgtcttcctttccttccctcagacaagcttcctggaggagactccatttattaagccaaaggtggtctcgctttgccttgtgtgaggatacttgttaattttaaaaaagttaaatgctgtgtcgcaccctgcttccagaccatcagtgcagtagaagaatgaatgaatgtcttgttgatttcttacacatttgtcatatttaaatgtaaaaaatggataaggccaggtgcagtggctcatgcctgtaatcccaacacttcggaaggccaaggcaggaagatcgcttgagcccaagaattcgagactagtctgggcaacatagcaagaccccatctcttaaaaacatattttttaattagctgggcatggtggtgcatgcctgtcatcctagctccttgggacactgaggtgggaggattgcttgagtccaggaggatgtgtttgcagtgagccatgtctgcaccactgctctccagcctgggcgacagagtgacacctcctttcagaaaagaaagaaaaaataggatttttcagccaacaagaaattcgtttaaagttttacaaatatgtgtaattcatccaattaaaagcaatcctggagttttattatgattaaaagaaagtgtcggccgggcctggtgcctcacgcctgtaatcccagcattttgggaggctgaggcgggtggatcacgaagtcaagagatcgagactatcctggccaacatgctgaaaccccgtgtctactaaaaatacaaaaattagctgggcgtggtggcgggttcctgtagtcccagctactcgggaggctgaggcaggagaatcacttgaacccggaaggcagaggttgctgtgagccaagatcacattcttttctatgacatggaggagtcctttcttgataatggatgtattttttaaactatcccaaatcccagaaggattagttagcaaatgccattgttgatttctttgatacattgcaaattaatgtttttctttatcttgcagaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaaattgctcttgtggctgttactgtgtgtcatgatgtaatttttggagtatttggtgatttgttgatgattagtgtatattacaagcttctgtggttcacggctcagttgtcagtaccatgtattaagggacttgctggaattcttgctgtttctaacagataccaagtcagtgaatttgggctctatctcaaagtcactctgtttgaattcttttgtcaatttgacacattccatttgttaatggggggatctccccgccccccactatgttctgagttatcctctatacttaatcctcattcagagtttttcttattaagtagaatttctttacttcctcaactgaattctgatcatattggaaagtgacagttgaaaaccactattgaaaaaaaagagaagatagaactggagaaaactaattcatggagacagagccctagatgttaattttaatctatttctctatttctcccagaatgaatttccttccaaatcagtcttgacgtgtacagtcaataatttatttatactttttaaagacactgtaatcctatagtatttattgcctaaatgactttttatgaatgtcttcagcaaatctacactcacatcctttcatgagtttaaaaagtggattaaaccgaggtggaattcaaactggaaaggttgcatgtccactagagtagcagaaaaacctggaaaaactgctggcctcgtggcgagtcccactcagccccgggaaggggtagggctgggtcccccacaccgtggccagtgcgcagacccctcctcccgcccctgcccgcgctccctgactcctgcgctctgctaatgcaaacgcgagtgccccaggcgtgggtctgtggccggtgcctgcacctgcggagttgccgaggttttcctccctaggagcactggccggctccttattttagttgccacaacaacactcactgttaaaagcgagccctaaaggaaagaacagaccatacaggggcgcacacagcttctcaaatgaatagaaaccaggccctcggcgcagctgaggaagagcctaatgcggatcttcctagttggtttcacatggaaccaaatggacctggtaccacgcaaccttttgttaagttctgctttgaagattttgttaaaattcgtatgtgtgcggtgtgggaggggtggagcgtcacaccgggtttaaggcaagaacatttagacatccagaggcaggagccctccggagacgggtctgattgtcctggcgtcagaggagctatggaaatgcgcgccaggctctaaatgactggcaggtggcaggctgtgatgtggacagccctgtttcattgttttccatttgagcagtaagagaaattcaaggcggcacttggccctcctcttctgactcacagtctttgaacaagagagtgcagattcctaagcctgagaaaacagggcctctggcttcttggcagggagaggttccagagagtgcaggggaggccctgcctccttgggtggggtgacctgggcctcctgggacctcagttccctgcctgtgaaaaagacggacggaggtagagaatcccagggtgcctttccaggactaaagacggtgccttctttatgtaaattccatccttcgcaagttcactgtggagcgctctcccggggcccagtctctaggcgcagaacacccagccaggtggtagctctcctttgcaaattgtactttttaatgtgtcgttgagtttgctaaagcaggttgccctgtgagtagagtacaaggctggtcgtcaggcggggagagtgacaatgttttgaaattgttgaatttcctgagcatgcaccaggctcagtgtcttggagcagtgcgggaaggctggtgttgcggcggcctgaagaagcacagctgcagatgctaacgcaggcctggtgagcaggaagccggggcgtggctcaggcggaggggagaggccggggcaggtctggcccggccatgggggccgggctctgagctggagagcaaggtaaggtcctaagcgtcatgtccggaggagtgggcagacagcgagggttgcactgaagtggcgggagactggagctctgtgacggcctgggggtgaggccgtggagcccggggtggtgtgggcagcggactctccagctgcttcctttccccctgtgtggcgtgggcagctgggtctcttaggactcaaagcccccccaaaagctcatgtctacaagctggtgtggcctcgggtcaagtagggccaggtcccatgggaccaagacatggcccatgcagctcccaacattccctgtgtccttccgtgctcccactaggaattaggacccagacgcggaaacactcaagtgtagatccctgccctgggcgcgggtggccggcccagtgtggggagggagggcctctttctctggcaggccagcagcaggcctggagggaagtattgtctgccattccttcgtcgtgtttgaaaaagtgctttactgaggtataatctaccatacattcatccatcataactgtgtaattatatgattttagtaattaatagaattgtgtaaccacaaccctcttttttgggaacatttccatcaccccaaaactaccgttacgcccatttgctgttaatcccagctcccaccccggcgctaggccacccccggcgatgctttctctccatcagtttgtcttttggacgtttcatgaaagtagggtcaggtatgagagtcttctgcatctggcttctttcactcgcagcgtcaccgaggctgtccctttgaagcatgcgtgggtagtcggtccccttttgctgctgagcgtcctttattgtagggggacactttgtccctttgccacctcacggacatggaactgttgccttttattttattttattttattttattttgagacggagtctcgctctgtcgcccaggctggagtacagtggcgtgatctcggctcactgcaagctccacctcccaggttcacaccattctcctgcctcagcctcccaagtacctgggaccacgccaggctatttttttgtatttttggtagagacggggtttcaccgtgttagccaggatggtcttgatcttctgacctcgtgatccgcccgcctcggacttccaaagtgctgggattacaggcgtgagccaccgcgcctggccgccagttttactatgatgaataatgctactatgaacatctgtgtacatatatttatatggacttatgttttcattttccttagtagctttctgggaatagaaatactgggtcatatgtaaatttatgtttaacattttaaggaacaactgaactttccaaatgctgtgtcattttacttccaagtaaaagggaatgtataaggattccagtttctccacatcctcaccaactcttggtattgtgttatgtttttaaacctatctgtgctagtgggtgtggagtggtgtctcactttggttttcatttgcattttcctactgatgaacaatgttgacatcttttcatgtgtttattagccattcatagatcttttaaagtaagatattaactcaaatcttttgcacattttaaatttggctgtcttatttttgagttttatttaattttttttttttttttttttttttgagacagggtcctgctgtgttacccaggctggagtgtagtggcacagtcatggctcactgcaacctcgaccttctgggctcaagcgatcctcccacctcagcctcctgagtagttgggactacaggtgcgtggcaccatgtctggctatttttaaatttttttgtagagatagggtctcactatgttgcccaggctgtcttgaactccagggctcaagtgatcctcctaccccagcctcctaaagtgttgggataataggtgtaagccactgtacctggcttatttttgaattttaagagttctttatatattctggataaagttattgtcttatgcaatcttatatcttttaaagaagttaagaaaataaaggagaacgtatatttgcagagtgttttatgttaacatagtgaccatttctggtgctcttcatttctacctgcaggcttggatcactctctagagtagttttcttccagcctcaaggacttcctttggtatctcttgtaaagcaagtctgttagcaacgcattctctgtctttttttcatctgggaatttctcaatttcaccttcagttcggaaggatagttttgctggatattgaattcttggtttacagttttttttttctttcagcccttgaggatcttatactaccactctccagcctcctctgtctcatgcatgaatttggctgttaatcatattgatgctcctttatatgtgatcagtcatttttctcttgctgctgtcaagattttgtcttgtcttttagaagtttaggtgtagatatctgcatattctgtttttcatcacattttggaagctctgggccactatttgctgaaatgctttttctgcgtctttgttttctttcctcctgccactcccactgtgtgtattctgggatgttggatgctggcctatatgtctctgaggttctgtttgtttttcttcagtgttttttctgtcttttcttaataatgggtaacctgtgctgatctaacttcgagttcacagattcattcctgtaccttcttgggtctactgttgaactcttttagtgagtgttttcattttggtgattacttttcaactctagaattttagtttggctccttttaaaaaataatttctgcatagttgagaatctctatttgttgatttattattattttaattatgtaaatatagttttctttagttctttgtattttaatttttttacctgctaccttaaactattaagcgttattagttctttttaaaattaagtttctttttgtttccaagacaaggtcgcactctgttacccaggctggagtacagtggcccaatcactctcactgcagcctcaacctccctgggctcagatgatccccactcccccaaccttagccttccaagtagctgggaccacaggtgcatgccaccatgcctggctatttttaaaatgctttttgtagagacagagttttgccatgttgcccaggctagtctcgaactcctgggctcatgtgatcctcccgcttcagcctcccaaagtggtgggattacaggcatgagccatcattttaaaaatgttttttagagatggggtcttgttatgttacctaggctggcctccaactcctgggctcaagtgactttcctaccttggtctcccgaaatgttgtgagtacaagcgtgagccaccacacctggtcttctttagttctttgatcctgtttataacagctgctttgaagtctttgctaaatcagaaacctggagacacggagagagagtttctattcgctgcttttttatgctttcatggatgagttccactttcatgtttctttgcatgtatcatttgtttaaagctggatgtttttagtaatgtagtaattttggaattggatccgcgaagatgattgttgttgctgcgtttttgattgttcatttttaattcctttcttcgttggtaacttgcccaggctcaacctgtgaaacctgtctctggtacgtaggcgttgatgtccctcatcagtttttaaatttattgtttctattttacgtctgcttcccaggggttgtccccttgtctacatatgtcagcggtcagccaatagctgacagaggttgagctgcatgcccttgagcctctgctgatgcacctgtgtgagggtggggagcgtcttcagaggggagcctgtttttgagtccgcctaggcccttactttctcctgtacccccatggtcgatgagggagtaggcgtgagcctgttcttctctatctgtatcccctttcccgccaccctcagcctcctcttgctttgtgcccaggtgccaggcctgagggccgcatccacccctcatctgcgctcggattcctgaggctctgcggtgggaagaacaagcagcaggaggggcggagggcgcgccttcactgccagcttgctttggacccacgccccgggcttggtcactgcctgaccacagttcccaccaggaagagacccaccttccctggcctccgaatattctgtttctctctggtcccttctggcctagggtggtggggacttcctgctgtcgctggtctctgggtccttaacatctgtcctttgttgcttatctctgcccccatctctgagagtagcccttccagtcaggccttttcatgtaaatcgtccttctcactggcttgtttcctgcggggatgctgaggactcaggggtggtcccaggtgtcggcccaggcagacaggtcagtggtgagatcatttgctaggaggagaaaacgcaggggaaagtgtgtttgctggtgaataatcaagagttgtgctttgtaaatggtaaacctggacatagaagtcaaaaattaaatcagccattgaagatatgaggctagagctcgggaaggaggcgctgatgacggaaaatcagggaagcatctgtgtagatggtgccccaaaccacagactagaggagaccaacccgggagaacgtgggaagagagaaggggctcaggactgggagctggggcattgcagaactagaggcctggaggaagacgagggttcagcagaggagcctgaggtggaactgaggggagggcaaggatgggaaagagtacggggtcctcaagtccaagtgaaaaaaaaggttcaagaaggagggagtggtcagtcagggaagctgcccctgggaaggccaggaagagggggccaccgggttcggcaacactgacctcgctggtgacctggacaggtgtggtttcagagggagctggggacggaagcctgaatgaagtggactcagcagagatgggaggtgaggccgtgccctgctgaggtgggaggtgaggccgtgccctgctaaggtaggaggtgaggccgtgccctgcagagatgggaggcgaggccgtgccctgctgagatgggaggtgaggccgtgccctgcagagatgggaggtgaggccgtgccctgctgagatgggaggtgaggccgtgccctgctgagatgggaggtgaggccgtgccctgctgaggtgggaggtgaggccgtgccctgctgaggtgggaggtgaggccgtgccctgccgagggcttcgttatacagggaggataactggagggaatgtgaggtcagtggagggtgttagtattttacatgggaaataatagatactgaaaagggaagaaattatatgcaagagagagggattaattatagaaaccaagaccttgagtcagtgacagggtaggggaaccagggcagcagcagagggtcgctgggcagcgggggtcgctcatcagctggaggggtccatggagcgacacctgcccccacctcacagctggaggggtccatggagccgacacctgcccccacctcacagctggaggggtccatggagccgacacctgcccccacctcacagctggaggggtccatggagccgacacctgccccccgcctcacagctggaggggaccatggggcgacacctgcccccacctcacagctggaggggaccatggggcgacacctgcccccacctcacagctggaggggaccgtgaagccaacacctgccccccgcctcacagctggaggggaccatggagctgacacctgcccccacctcacagctggaggggaccacagggtggacacccccccacctcataggcccgttggacgatcacgtgtggaataatgcaatgtgtttgggttcgtgcctggcacatcgtaagtgtgaattagtactgtgtggctttactctttggttttctgaacatttttattcttgaatagaattcgggctttatctttgcctgtagccagaaggcctatctgactacttttccctagaccaaaacaacaaaaaactacactcccatgacatctctccaaacgggattctctgtaagtagaaaaagatgactgagtttgaaaataccagtcgctccccggttctcattatcatattgtcagaagcatcctgtgacacccacaaagtttagcacgtaatcccatgcacggcaagcccaaagctggcgggctggggcggcccgtggtagagaaagctgtcacctttgggattccgcagacagcagccttggtgccactggggtagaagcatccgcgtctccggcattcggtgtcagcatctacagttagaccttcccatccttatgggctgggcccctctgctgtcctcgagctgcatccaacaccggggaaatgagtcctgacgaccgagggacgtcaccaagagtgtcaccacccacaccgagcagccacaggctccatgtccagcccctccttcccccgggagggtgagcccaggaggtgagagcagagatcggggcctggaggtgcggcctgggaagcctgttgtgggtgccgcctccctgagccacaacctgtcctggggatcggtggacgctccgtggctctgcagagctgcttgtaccacccttgctggaggaggaggttctcgcagtttgcttccgtttgtggatgagagacaggtgggttggttggttcttcccatcatggcatcacagccattccacgggaggtgatggcagctgattgttctgagtctctgctaagtggaatcaccccaagacctcgagtgcatggacccactgggctctgggccccgcagagacgtgcccaggcctggatgtgctgactgctgggctgtcccacacagctggagccaggagcccacagtgggcagcaggaccttgacttcaggcgggcagagccgggcatctcctgtctcctccctgccctggctgggataggtttttaggagtaactttgctagagggaagattctgagacatctgcgatcctgagctgctccggtgggcacctgccagaagacaggagcccaggctgcaggagtcgctggtggaggaggggtgaggcggcgcccctgcctctgtggttctgcatggggcagggcccctgctgctccgggcggggaaagaaggtaggaggcccttgctcccatgactcactccaggctctacacacgttggagttttctgtttctttctgagcttctaatgcaggaatcacaagctcagatccctcacagatgctatgttttgcttcggcgtgcatcctaggtgggattcttagacatgggaaacacacagcaacatctggcccttccacaaagaagtacgtatgctcccccagcaccctttgttttttgagatagagcctcactgtgttacccaggctggagtgcagtggtgcaatctcggctcactgtacctccgcctcccggattcaagtgatcctccgacctcagcctcccaagtagctgggtttacagttgcccagcatcacacttggctaagttttgtattttttgtagagatggggttttaccatgttgctcaggctggtcttgaactcttgggcttaagcaatcctgcttcggcctcccaaagtgctgggattttgggtgtgagccactgcgcccagcttactctcctacttttttcatgaaacatgcagctctttggtttttcagatatttctacaactctgactgaatgccagggaagattctatgtgccaagatccagcagtgaatggtcccggtaaaatcactgtcccaacaaggtgtaatctagaggagggagacaggaaacaaacaaaatggttaagtcaaatgtatctgtgctgggtggtgataaaaattttggagaaaaataagtctccgaggggatgaagaatgctgtgtggggattgtacatccatgtgtagggcagtcgggaagctcttatgataggtgatatttggatgatgaccagtggcaggtaagcgtgcgatccccttggatttctggggaaggagctttcctggctgaggaagaggtacatgcaaaggtcctgaggtgggcatgggcctggtgtgtccaagcaactgcaaggaggcttgtgtcgctgcagtgaccggacaggagggagagagaccacagggcgtgtgtgcttgggtgagcgggtggggggccagatcactctgggtctagggggccatcatatggactttgactttgactctgtcaaaaatgggagtgactagaagattgtatacgtacaattgataacacttatgtgttaaaggcgttgtgctgactcctgtgggtagatgtgccaaaagggtagaaaaagatagaagaccaagccaggtgcctcggctcacacctgtaaccccagcactttgggagtctgaggcgggaggatcgcttgagcccaggagttgaaaaccagcctggacaccatagtgaaaaattagaaaatagctgggtgtggtggtgtgtgcctgtggtcccagctactcagaaggctgaggcaggaggattacctgaacctaggaggtcaaagctgcagtgagctgagatcgcaccactgcattccagcctggacagcacagtgagaccctgtccccctcttccgcaaaaaaacaaaaaggaagagcgattatgaggttcctgaggccatctagacaggaggtggcggggacttagagtggcagctgaagttggggcaaaagaggttggacactttatcaatatactttgaggtttgagtcaaaagccctttggctgggctgttagagggtatggggtatctttatggggtaatgaaaagattctaaaattaatggtgacagttgcacaattctgtgaatatcctaagaacaattgaatcgtatggtatatgagttatgtctcaacaatgttaacagaaatgaggatttgcagatggatttggtgttggggtctgagaaggagaggaggcaaggaagaccagcctgggcagctggaaggatggtcttcaaggaggaaagcagacagaggaggggcaagtgttaggggagggctaagagtttcaggagttcagttgtgttttttgttttgttttttgagatgaggtcttgctctattgcccaggctggagtgcagtgacatgatcacagctcactgcagcctcgaactcatgggctcaagcaatcctcctgcctcagcctcccaagtagctgggactacaagtgcacaccaccacacctggctaatttttaaatttttttgtagagatggggtcttgctgtgttgcccacgctggtctctaactcctgagctcaaacagtgctcctgcctcagcctcccaaagtgctgggattacaggtatgagccactgggcctagcccaggagttcagttaggtctcggctgtgatcagatatgcaaggggatatgggggaagcatttggacactcaacactggctctggggagagggccgcaggatgaatgacaggagcacctggctggtgagtgacagggggaagacaaggggcaggagtgagccctggacccctgatgctcccaagttaggaggggaggagcggccagccagggaggggacgtcccagaagccaggaggttctgtgtttcatttcctcaccggaagcagagagcatgggcacagagagacctttctttactgggcagaagcagcagtgccagcccagggtacatgacaagtgcctcagcatgtgggatcagggagtggggatgctggcaattgtggattggaggctctgggtggcaggaggctgccttggggctatagctgttgccatgtacaaataagagccaagggctgctgggcatcaaacgttcaagagaaactggaaattatgagattttgattggcttttcaaaatgtccatttcattttaaaaacaaaaacctacatgtgcctaaccacacaagtctgtgtccccacctggcctgtggcccgtcactgtgttctgctttctaacacagggagttactgccaggggcatggagtctctgtcaggccttttcctaagcaggtgtaccctgggagaggcatgggctgttcagggtgtcggtgcacctgcactggtgttgacccttagtgtgatgccaggcaggggccctcagccccccaggatccagctgggtctgaagttgagggaggaggtggaatcctgcatgaagaaagctctgctggctgagagcctggctcccacgctgactgtgtgactgtgggcaacttatttaatgatcctaagcctgagtttcctcctccgtaaaatgggttcataacagtgctcacatttttgggccacagcgagtatttaataagactgtacataaaagccgggagtggaggcatgtgcctggagtcctggctgctggggaggctgaggtggatcacttgagccttggagttcgaggctgcagtgcgctatgatcatacgtgtgaatagccattgccctccagcctgggcaggatagtgagaccccatatctaaaaggaaaaaaaatattctacacgtacagagcttagggtgttacttgacacatagacactcagtaaatgtgatgaaatgcattttgcgtgaatatttcggctctggctatttacattagtccagaaggtgaaccctgtgctacttaagtttttatagcagcactgcgagcgtaagcaaaaccagccacagtgcagcagaacagtaacaggagagccggctggggccagaaaccagcagctggacagcgctctcatggaggcaaagcctgttctgaccccagctccagccttttctagccctgcggccgcatcgtcccctgcactgctacttcctgtttgaacaataggacctcagtgcagcttgattcagcgagcgttaaatgaaataacgggagaatggactttggctctgaccccggccataatgtttgctgttattacaaagtgagggccaagattacagcagatccgcacacacggaggttagaggtgttttggggtattgtcagagagagactaacagaactgtctttggacccatggatggttttgtaaggaagtagtgcctaacgcaagttgtagtaaagacccatgggtaaatgaaaacgcctgtcctgggacccgggagaccgggagggagctccaaggctcttggcccaagggcgacttgctgggaggtgcctccttccagctgggaagccagtgcccagagcagatgcctctgctccgccacagcgctttgaaatggtgactcaggcttcatgcacgcccactgctgcccgtcagaactctcggcttcagcagttagcttggaaggcagtcgtgagcggggtattttgggcagcatctcagcagaggggccccagctgtgcgggtgttctccgcctctgcaggcgctgcctgccctgcagaactccctcctcgcggcccggggaggccgcagggtgcagttgggatgacctccctggcttggttggctccagcctgagcctttggggccgggctcctcagggcagcaggcgcgacccgtgaagacgtcagcgattccagcgctctccatcatcgctcgtgcctcctgtactggaggttttcacactgcgcgcttcctccaccctctaaggagaatgaggtccttcccccgggctcccttttttcatgcagaatggagtcaggggaatgggccgagtggagaaaataagcagagagccgtgagaagggggagagggctctggccggcccagctggctccagcacattccttggtggggaaattagagtgaaatgagtggagaaaaaactaaaacatgccagagaagctcaggtgggctgtgaaataaaaaagctgaacaagaggaggaaacccaggagggactgaaactcacagaaactgggtgccaggaagagtatgttttgggggataggtgggccgggtagggagttagtgagagaaaagcagcagaacagattgcaaagtgcggaagaaccgagggtgaaagggaaggagatgttagatgttactgctgcaacttccctgtaaatctaaaattattccaaaataaaaagtagaagaccaggcacagtggctcatacctgtaatcccagcactttgggaggccgatgcgggtggatcacttgaggtcaggagtttgagaccagcctggccaacatggtgaaaccccatctgtactaaaaatataaaaattagccaggcgtgttggcaggtacctgtaatcccagctactcaggaggctgaggcaggagaatcgcttcaaccagggaggcggaggctgcagtgagctgagactgtaccactgcacactagcccaggtgacagagtgagactccatctcaaaactaaataaataaattaattaattaatgtagatttttaaaaagaaagtattgctatggactatgaattagatgccctaaaagcttttccaagaagcacaactaaagacaggaattgctttttatcacctttggttcgtgaatcctagtatttctttctatgtgggccgcgtacagcctggttcacatggggcctggcgtttgtgtgggttacaggagatctttttattctctgaaatcacacagtgattaacgtgttcccttttaataggatgtgccatgttcaccttgatatttgggtttttgaagaaaacctgtaaaagctgtaaaacccgaaccatgaggacaccccaggggcacacaggtcagtctgttggacactgcgtatttctcattcgtttcttcgcctcctttggtgatatccggccttactgctagggaggacatttgggaaaatcccttaaaggaagtctgggtcccttggcagagtcatgtaatctcccatctcctggctgcagatgggattgatagtctttgaccattgatcttaagcaggatgcatggagatctctgtgagcttccaagagacagactgcaagtctgcaatgcggaagggatgtgctgcgtcctccggccccttccctggctaaaatggctccttcatttaatatcctgcttgcttttttttttttttttttttgagacaggatctctctctcacccaggctgcagtgcactagtgcgatcacggctcactgcagcctcaacctcccagactcaaatgatcctcttgcctcagacccctgagtagctgggaccacaggcgtgcactaccatgcctggctaatttttgtatttgtaattttttgtagagatggccatcttactatgttgcccaggctggtctcgaacccctgggcttgagtgatccacctgccttggcttcccaaagcgctgggatcacaggcgtgagccactgaacccggcctgcttgctcttttgatatattcctgattcattaaggttaatgcatctgttaaaaaaaataaaagagaagagagacttaagagaaataccaaaggttgtctaaaccgtgttgagattccgatttgaacaaaaccaactgaattttttttttttttgagataagcagatacatttattatggactgggtattagaagatagtaagggattggtgttagttttgttggatgtgataatatcacggtgttatgttaattaaaaagtctgtcagtttacaaagcatccggaataccctcctcttcacagcctctttaaagacctaaaaacctaagaatgagctcccaggcagcacgcagcggtgcgcgtcgtggggcctaagagggacagaacactcttaggtctgtcactaccactggccttcttatttctctctcactgtgctttaaaaaaatatcctaggacggtcttcctgagctcagagtgggggatccctgatgttggcacgtcacagggtgatgttgatgacacagagcctggtgaatggatgcggctgtcttgaatcagtgcggtgaatgcaggcgtagctcaggggacgcagtcggtgcacatgaattcagaacggtagccctgccagccccactgccttcccggcctctgagaggggccgattcagggttctcggtgaagtgttggcttcccaaggctgcgttagcagggagctagacttagtttcctctgagcaagaaacataatcatcagtggatgagggccctctccaggctgcagaatcctttctttggggaggttgctgggcttgttgatggtgaagactcagcagccatgtaagaaggacttaatgaatccctggggaaccgggttgtcctcggagctacagataagttatccgaaaatccagccccctttctttgctgtaatatatatgtgcttgtgtgtgtgtattttttcctttttacagtagggactggtggccaggtgcagggcttgtgcctgcagtcccagtactttgggaggccaaggcaggagaatcacttgaggctaggagttcaagaccagcctaggcaacatagtgagacctcatctctacaaaaaataaaaaaattagctgagcatggtagctaattcagaggctgaagtgggaggatcatttgagtccaggagatggaggctgcagtgagctgagatcatgctactgtactccagcctgggtaacatagccagaccctgtctcaaaaaaaaaaaaaaaaaaaattaagacaataggaacttgttaaaaatatcacaattgttgaatttccacatgagtccccccaacacttttaccttgtcctctgtctttctgcatacacctgcctgcctctccatgactggaggtggctggaatagtcaccttatctttccccagatctttcccagatggcttgaaatcccccagtgcggggtggcctcactgggagtctcctctggaaggctgtgtgtccttgctctcacgctgggtcctgaacctcctgtgtcttggaggcccatgttctggaagtgatcagtgatgtggtttggatatctccccctcactgtcttgtggtaatgagtgagttctcgctctatgggtccctgcaaggtctgattgttaaaaagcccggcaatgggcgtggtgatgggtgcctatattcccacctactcgggaggctgaggcaggagaatagcgtgaacccagggggcggagcttgcagtgagctgagatcgcaccactgcactccagcctgggcaacagagcgagactccgtctcaaaaaaaaaaaaaaaaaaaaagcccggcaatgtcctacccttccccactcccccgtcccactccatgtgctacacctgctccccttcccctttctccatgagtggaaggagcccaaggcctcaccagttgttggcacatgcttcttgttcagcctgcagaatcatgagccaaataaacctcttttctctatatattgcccagcctcaggtattcctttagagcaatgcaaagtggacttagatagtcaatgaaacaaaggggatgtgaggctggtggcccaagtcagctgaggatgctgggctgagagcataccttctcttgcctgctggtttccatggcacgaacccctttctttcctcactgcagccactgtatgtaatcaagtcccattttctcagcacctagagctgtactgggcatgaaatagatgttacttgaaggaaagagcccaggtagcacagtcagcagcagaggcagcatgtgtcgccctgtctgacatcgcgagccttttcagagacccaggggctgctaccagctaaggcagtgtgcagccattcagcaaatattcatcagcacctgctctgcgcgaggcctggctctaggtgccctgagcaagccaaacagggaacttgctcaccggaacttaggttctagtgcagaagatcgacagtaaaccagccagccgaaaccccatacagctctgaaatgagagcaagagaaagactgtgaagaattgggcgcacggtattgggatagagtggccaggaggtggtggaggtaggggtgttcaccacagtggccagggagaggccaactgaagggaggacggcatgtgaagaaggtggaggagtggggagaagacccctggctgtgggagctgtgagggcagaggccgtggagcaggagcaacttggcagtttaagggacagagtgaggggtcgagtgcagagtgtgtcgagctggggagattggtgggaccgaggtagagaggagggcagcggccagaatgtgtcgggtgtgtaggtcatggcggggagtatttggagaggagtgtgggaccctggttaagtttaagagacaggtgttctggttcagggaggcaaggagagggcagagaaggaaggctgtatttgggtattatctgggaattagggaagcagtaaggaggagtgtgggttgccagggtagaggcgagagattaggaatacattttacatccagaaaggtgagaggggactggaacctctagagaggtaggtttgggtagccattaaggggaggcggatggccaagagaaacacaaacgaatcaggaacttggcttgtagtctcaggtttagcatccactgctgtgcagactcagagaaggcactgaccccttctgggccttagtaccaactataaatgagatagttgaatgaggttggtaggagaccctaaccagcataggaggtgattttcggtacaattggatgctaaaatgtaattttcaaaaggtggaaaacaactgttctataaatataaaataagcacatgtaaaggattgtatttaactcatcagtgaacgagggaacttgtaagatgttgtatttaactcatcagtaaacgagggtacctgtaagatgttgtcttagtccactttgtgctgttagaccagaacacctgaggctgagcaatttatcaagaatagaaacttctttctcacagttctggaggctgaaaatcaagatcaggatgctggcgtctgacaagggctttcttgctgcatcctcacgtggcggaaagtggaagggcaagagagagcgaacccatcctgaaaaccccagattacagaggcactaatccatttatgtgggtggagctcccatgacccaaacacctccaaaggccccacctcctgacaatgttgcactggggattacatttccaacacatgaatctggggagacagattcagaccacagcagatgtcaaggctggttcaaaggacaatgtgaagaacaaaggcatgctgaaatgaatttgataatagatgcaaacttgggtaacatcctacaggacaataaggtgtaagtaatacttgggatcatctttccttagacatgagcatcagttgcatctacagtgaacaacactgattacattgccatagaggaagctttgtgttgctctcagataagaagcatgcacactgctgtattctctacatgaacttctattctacagttgtaaaatagttcagtcaatagaaagccaaccacagagacacacctagtggtttgtttttgcctatttttaagtttttaatattttttataacagatataacattgaatccatagtgaagttaatcactttttaattacccatttttctaataattaaatcaacaagggagtctcctttgggtaccaatcaatctctaacctttctaaacttcttgtttgaaaaagagaaaggcagaagtgggcctcaagcatgacgccttcaactgactgtacaagctagctgcagtttgatgatactgttgaattttctttattatattgttaccttttattaatggcaatggatatattagttttccatttttggttgagatatgaggcttcctttaaaacatatttaagtaaaaaagaaaagtgagtcaatgtgtttaattaaacagccaaaagtattcaaatgatgaatgatatagatgggatgaatagaaagtcatagaaaatttatggtgatcactgaaggttgagaaaaacccaatctgatgagcactctgctccatgtcaggtcctgcctgttgtgcttgtctcccagactgtcttttaactctcaccttcttacaaatagttgaatcttaatagctattattaccttacatttaacaaaataggcatatgcatattttttcattttctccctctccactaaggaaaacttcagagagagaaagaatttctccagggtcaagcatccagctgagcattccagtagagaatggcagtgctggaatcccccgctgttgtccggcttcaagactcttttgcactgtctcccagccctgctcccatgggagttgtggagaattcccagggtgaagaaagaacctggggatagagcctccttttttcattttttctttctttttttttttttttttgcgatggtcttgctctgtcacccaggcttggagtgcagtggtgtgatcttggctcactgcagcctcaatctcccaggttcaagtgatccttcctcctcagtctccagagtagctgggactacaggtatgcaccaccatgcctggctaatttttgtgtttttagtagagatgggctttcatcatgttggccagactggtctcaaactcctgacctcaggtgatccacctgcctcagcctcccgaagtgctgggattataggcatgagccactgtgcccggcctcatttttcttttcctttttacagaaatggaaatcacatggtaggtcataaggagctgacagggctggagttccagtgagtatctgccccggcagtgcggcagcagacgggaagggtgggaggtcatctgagctggtagggtgagaacaaatataaatctcaggggggatccacaagggagcccatgtctttggtgccacacaaatgcagtaagagctgtggacaccagggaataccagggagtgtttaaaagccccacaggcagaacacacgcagagaaagcaggagactaggcactgtgggttcttgggaaagagctgattttagttgcaaaagcagaggaaaccccagacattgcatggctttaggctttaggctttagccccaccaccctcacaagtcttctgtctccagggggccatcagtgcctcagttccactcggtgcagaccccagggttcttcccacccctgcaagccacccatcagggtgaactgagagatcagcagagtcacttacaacgaaggggaattgttctgggcattggttagtaaacaggagagcaaaaggggagaagaaaattgtgtacaggcgttgagcatctctagccgaagaaggtgaggcatagaggtgtcttaccaccaggaacagatctgagtcatgcagcaccaaaatacgtatttgagtcatggcatcaaaacgttcctggtggtgaattcatgtccgtgcgggtctgcagcaatctcaattcttgcctcctcagaagaaagaattcgactgaggggcatgaggcagaaagagagatcggagccagtttcagaacaggagtgaaagtttattaaaaggctttagaacatgaatgaaaggaaggaaaggatacttggagaaggaccaagcaggcatcttgaaaggcaagtgcttttttttttttttttcattttttaaccccttcctaatgtcactggaataagaggcctgtcccagaccccaagagcgggttcttggatgttggatgaggaacaattccaggtgagtggcagagtatagtaaagttaaaatcgtttatcagagaccactcggttacagagtaggatgtcctccaaaagcaagagaaggaacgcgcacaccttaaatacgattcttatttatataggttaacagagctaagaagagaggtcttttgtgctttattacagaggctggtgatcagcttctgacaggctattagtattattttcctatgttactactgatttcagcaaggatttacgaatgtactattaaccttaaatcaaaacctactcttaaactaagaatgctttttgttcttaaaatattaagagattgccataaaattctgcgtctttatttagttagcatcattaacttgttccctcaaccataaacatcttgtgcccaagagtgcctaccccctgggggtgtaaccctgcaggcatggctatatcccacatttattaaagacagactcactctgattaggacgcctctgacactagtgtttgatcctaagagcaggatgccccaagctgaccatggagtggtgatgctgctggtgttgcccgcagacaggcctgggtgcccctcctgtatctggccttgcctactgggccaggtggattcatacccaggcgggatccaggctgaggctggagttgaaagggagccatctgtttgtggaccaccgagcaccagcagtccatcctcctatttttgtgttcttttggtagtggggaggagtggatggagagttgcagtgtcctgctgggagggaggtgcaggggtcatgggaggttgggcccaccctgcacatcattcttgggctgtcctgagcactcaccctttctgtctgccatgtgagggagacatccctgtagcactcctcctcccgaccctgccccacatccgagagccctttgcccctagggattgaagggccagagggcccaagccacctcctaggatttttttcccttgccttccctccctcccatcctctccaatttcctcttctcccccctattctttcactcccttcctccttccctctcttcctccctttgttctttccactctctttcctctctctctttccaagcttccatcagcaatgcatgataatttcatttgttttacatctcactactggcatgtgacattgataatggtggtgatgatagggatggtggtgatgattttggtgatggtgatgatgatagtaatgatgatggtgataatgatggtgatggtaatgatagtgatggtgatgatggtgatggtgatgacgatggtgatgatggtgttggtaatgatggtgatgattatatgataatggtgatggtggtggtggtgatggtgataatggtggtgatggtggaggtggtgatgacgatggtgatgatggtggtggtgatgttaatgtgaaactggctttgtaaggcctgaagcttatgcaaattggtgacctctttaagaaatactacctgggcttgaacccttgctgcccactgtgtccctgcctgaatcacttccactttctgtgcctcagtttcctcatccaagagttagagctaacagtattaatagttctccctcgcagagtgaggattaaatggggtcatggtcagcattttcaatagtgcaaatagtaagcacttgatgggtgctttctgttttcaacctgactctgaggtctcctctatcatacatacacttattattttattccatggtgaagctcacataacataaattaacaatcttattaactactccaaagtgtacaattcagtggcatttagtgcattcctaatggcatgcagctaccatttctgtctagcttcaaaatacattcatcacgtcagaaacaaaccctgttgccattagtagtcactctccattccctccccacatgaatctactttctgtctctgtggatttgcctgttctggacatttccagccatacagtatgtggccttacatgcctggcttctttcccttggtgtggtgctcgcaagctccatcaatgttggaacacgggtcggggcttcatcccttttgatggctgagtgacttcccaaggtatggatattctggcattgagattgttttaagtccctggggtggaggtgtgggcaggagtgaatacacacttccaagaagctgctctgaagaaactcaagctgctgtcccgctaccagcactccatgacatcatgaacacgacgacatcatcaacaccatgatataatcagcactgcatcattaacaccaccacatcatcggcaccatgacatgtcaacaccatgacatcaacaccaccatgaaatcatcaacaccacatcattaacaccatgacatcaacactacatcatcaacaccaagaccatcattaacaccgtggcatcatcaacactgcatcattaacaccatgacatcaccaacgtgacatcatcaccatgacatcatcagcaccatgatatcaacactgcattaacatcatgacgtcatcaacaccatgacaccatcaatgccacgacatcaacaccatgacatcattaacaccacatcattaactccacgacatcaacacaacatcagcacaatgacatcaccacgacatcatcaacaccacatcaccatgacatgatcaacgcatgacatcatcagcactgcatcattaacaccatgacatcatcagcactatgacatcatcaacaccatgacatcatcaacaccgcatcattaacaccacatcattaacaccatgacactatcaactccatgacatcaacacagtgacatgaacaccacatcaacaccatgacgttgtcaacaccatgacatcatcaacaccacatcagtaacaccatgacactatcaacaccatgacattaacacagtgacatcatcaacacatgacactttcaacaccatgacatcatcaacaccacaacaacacatcatcaataccacatcattaacaccacgacaccatgagcacatcatgaacaccatgacagtatcaacacaataacatcatcaactccatgacatcatgaactccacaacataaacaccatgacatcaacaccacatcaacgccacgacatcagcaccacgacatcatcaaatccatgacatcatcaaccccatgacatcatccacactgcatcaccaacaccatgacatcagcaccatgacatcatcaacactgtgacatcatcaacaccacatcaataacatcacgacatcagcaccatgacgtcatcaacacaatgacatcaccatgacaccatcaacatcacatgattaacaccgcatcattaacaccatgacatcagcacgacatcattaacaccacgacatcaacaccacaccaacaccatgacttcatcaactccgcatcattaataccaggaaatcatccacaccacgacctcagcaaccccatgacaccatcatcagcactatgacatcgtcaaaaccacgatattatcaacaccatgatatcaacacatcaacatcaacaccacatcagcaccatgacatcatgaacacaacatcatcaaccccatgacatcatcaacactacatcattaacaccatgagaccagcaccgtgacatcatcaacaccatgacaacatcaaaaccatgacatcaacatggcatcattaataccatgacatcatcaacacaaggacatcatcaacactgcatcattaacaccatgagatcagcaccgtgacatcaacaccatgacaacatcaaaaccatgacgtcaacacggcatcattaataccaagacatcatcaacacaaggacatcatcaacactgcatcatcaacacatcatcaagaccatgacatcatgaacaccatgacatcatcaacttcaacaccacgacatcatcaacatagaagactcctgtgagcaaacgcagagttggggcttctccccaccactgagtgagcaacactgctgtagcggacaccaacaggggcatcctccgattctattctgacccctctacctggagacggtgtctgatcacacagggagagggctcagtcctaagacctccccccctactccagacatgagctgcacgtctgggccttctgaccaacttcttgatgttggggttcccacaaccccctctttgggtttgattaatttgctagagtggctcacgggagtcagggaaacacgtttcctggtttattataagtgatattgcaaagaatatacatgaagagatgcacagacgaggtacggggaaggggcgtggagctgccatgccctccctgggcagcccctccaggagcctctgcgtggtcagctctctgaaaggtccctgaaccctgtcctcttgggcctttgatggagacatcgttggacaggaatgattgacaaccatgtagaaatgcaactggatacacagggcgtggtgtaaactcagcagggcttgtctgtccagattcttcttttttttttttttgagacggagcctcactttgtcacccaggctggagtgtagtggtgtgatctcggctcactgcaacctctgccttccaggttcaagcaattctcctggctcagcacccccagtagctggttttacaggcacgtgccaccatgcccgactaatttttgtatttttagtacagatggggttttgccgtgttggccaggctggcctcgaactcctgacttcaggtgatctgcccgccttgggctcccagtcttgggattacaggcatgagccaccacgcctggcccagactcttctcagcttctcggcagcatttcttcctctaggggatgaggcagaacccaccctggaatgaggatcttctgacccacagtcagattagggtcttgagattcagcttcctgaggcctaaactgccccaacgtgataacaaaaggctataaccagggctgtgtgagttaggaggcaggagctgtggatgaagacacacacatttatttcacggtgaagctcacataacataagttaacaatcttatcaactactccagagtggacgattcagtggcatttagtgcactgtggacggatgattcagtggcatttagtgcactgtggatggaaatgcaggggagttgattgccctgccacttgctccgagcctctgagaggtgactgccacaccctttggcattgaactctacatcctttggatccgtcagcacctttccagcaattccttgggtcaagcatgtgggattcacttgctcttaaaatgaatggttaactgtgcctgggctggtacaacttggtgctgtgtgaccccagccgtcctcagccctccttctcacacctccaccttggccagtacccacctggatttctctctggtcctccaagctgctgaacttgtcccctccgcagggcctccagcctggcatgctcttccctgggagcgccgcgtgctacttcttacaattttgggtcttgctcagatgataactccttggggcagccttccccgaccaccctccccaggcactccctgccacaaatgtccccactgcacttacgctgcggggagttctctatccgcttccttgttcaccctcactggtctccccaggaaagctccaggagggaggcgctggttctgtgtattcacctgtgctggggctggcactccaggcagagctgtggcggaaggaagtggcccgagacagcctgattccatcttttggtttctgtgtgtttcctcctcatagacccgcaccagcgaacagggaacctgcaaccagggggtggacactgaaataaaaacaaagtgagacagaaacttctgctcctgcaccgcggctgcccctgagtgctcagtggcggggctgtggccgcctgtggtcgcggtgcggaacttgccttgcaggatgctgtgcggggtagcctggaccccaccatggagggttagcctcctgtccccggccctccaatgcctgcacagggcgggttctgcatggctgtccaggggatgatgcaggcgtccagatgcgggaaacggtgactggatggagcgactgctctccagccttgtcctagcagacagcaccatctgctgggccctgggtttgtgtctgcaactggatgggctctagcggggttctgcccaatctagcaattcgaggtggcacatctacaccaatatccacctgctgtttaccagacgccatgccaggcaggtggtcagcagtgtgcatgcgaccacttgctcacggcctgcactgagctgtgtgtggagagggacctgtgggacctgggtgctgcttgtggtgcaggcccaaccaggctcagggaggggcgtctgctgctctgaggcctcggggggtgcccacccgcccaatggtcacccaccacgtgcggggcaaatgcccaccgcagtgctcacctccagacaaacatcgctgccttcctgcagctccgttccaggcagggaggcacagatgagacgtggtgggcagatgaggttgtttcaggttgtgttagacagtgtggaggaaatcaacagaatgctgtggacagtgccccggcggtgatgggcagattagggactgcacgcaggagtcagtcacgggaggggaatggcaccactgtcccaaaaacagcaaaaacgagtccaagcatggcactgatgggacatcagaggagacaaaaggtggtggctgttggtggtgcagtgaggggaggaggctgggagggaggtggaagcttgggcagggcccgttgggcttcgcattctattctaagcaccatgggaagctgtcaccgggctttaggcagcgcgacgacaggatccgatcgaggctttccgtgttgctagcaaaggaattcaacattcctgacatgggtgaatggagagaaaagtgatggggctctttccagaggtcaaggttaaggggactctcatggatgggatgcatcctgggaccagcaaagtgggaagtggtcgcctcgcccaagcctgtggggaccagagagggaatggtccccggaggcccacagagtagggccgaggacaggggaggacacaggaacacgaggggctgccgagggagcaggaggtgcagccgccctcagatctggcctgcaggggtggagcaggaaatgacaaacacccacctcttctcctggggatggtggagcctgaggcaccacgtccacgaggtcctcttggggtggaggcagacctggaggggcagacacactctcagcttccagaaaaccttgactccaagaagtcacactgagagatacccctgtcgctggagagatctccttttctgatataaccactttattcccatatctttggggtgtctggggaggtgactcagtccctccaaagggaatgagcgtgaactgggagggtgtgttggacccaggagactttcacggcgataaccacatctccccttgccctttcagcctccttcagtgggacccacttcccttccctgcaccgaaagggggtggctcgtgagtatttttagatgaggaacctctgcccatgcagtcccaggcaatgagctgcgctctcagtgtagctttccacttcactcccctctaagctgcaccctgctgtgggctgaggctttagcaggggccggaccagggtcctctgtcagcgccctgctcagcccttcataggctggttgtggttttgctccccacagcaggcaatgctggcaccagggaagaggggtaaagagacagggctgggctcgcttggcagggctgtggtgcttgtgtgggctgtggtggttggcagggctgtggtggttgtgtgggctgtggtggttgtgtgggctgtggtggttggctttaggtgtcagcttggctaggccatggcacccaattatgtaaacacacatgaatctcagtgctcccgggaaggtattctgtggacatggtggatgtgccccgtcacctgacttttagtaagggcaaatgccctccacagcgtgagtgggcctcacccagtcagctgaaggaaggagacattctgccccaagactttagcctcagcctcagcctgggtttccagcccgttggcctgtcctgcagatttcagacttgacagcttctaatcacatgagccaatcgcaaaaagaaatctcctatctggatccacatctacatttatatacccatatccatacatatatccatgaatacctccatatccatacctccatccatgtccacgcctccatccacatccatgcctacatgtacatacatgtctacgtctgtatccatgcctacatccacatctgtgcctacgtccacatccatatctacacccacatccatatctatactcacgtccatgactacacccccatccatatctacacccacgtccatatctacaccctcatccatatctacacccacgtccatgactacacccacatccatatctacacccacatccatatctacaccctaattcatatctacacacacatccatatctacacccacatccatgcctatgtccacatccacatctatacccacatccatatctacaccctcatccatatctacacccacatccacgcctacacccacatccatatctacacccacatccacgcctacacccacatccatatctacacccacatccatatctacacctacatccatgcctacgtccacatccatatctacacccacatccatatctaccccacatccacatctacaccctcatccacatctacacccacatccacatctacacccacatccatagctacacccacatccatatctaccccatatccacatctacaccctcatccacatctacacccacatccacatctacacccacatccacatctacacccacatccatgcctacacccacatccacatctacacccacatccatatctatactcatgtccatgactacacccccatccatatctacacccacgtccatatctacaccctcatccatatctacacccacatccatgactacacccacatccatatctacacccacatccatatctacaccctaattcatatctacacacacatccatatctacacccacatccatatctacacccacatccatatctaccccatatccacatctacaccctcatccacatctacacccacatccacatctacacccacatccacatctacacccacatccatgcctacacccacatccacatctacacccacatccatatctacacccacatccacgcctacacccacatccacgcctacacccacatccacgcctacacccacatccacatccatatctacacccccatccacatctacacccacatccatatctacacctacatccatatctacacccacatccatatctcactctcatccatacctccgtccacatccgtgcctacatctgtatccatatctacagccacatccatatctacaccctcatcatgtctacacccacatccatttccaagtccatgtctatatctatacccatagccacctctgtacctatacccatatccatttccatatctgtatctatattcatagccatatctgtgtctatacctatatgtacctccatacctatattcatatctacatccaaatttatttccatagccacatctgtatctatatctgtattcatatccatatctgtatctataccaatatctatgtccacatccatatctatgcctaaatctgtacccatatctgtatccatatccatctagatccatattcctatctgtatctatacccatattcatgtccatatccatacctctctctatatcaatatccatatccatattcatccattcccgtgcttatgtccacttccatatccacgcatgtcctgttactctgcttccctggggacccctggctgaaacaggaggcttctattgaactcactggatgtggcaaattaagaaaggtttctcttgttctggggtcttaggtgacccctgctggtcccctctgttggtgatttccttgaccctggggtgctgccctctctgcagcgtcagcctctactggttcttgaagagaagcagcaggccagccccatccctctggatttatatgtgggggcagatctctcggtcatgggtctctcaggtgctagcaccacagcatggagttatctgagttgtcatctcagagcaggaactcatcaccaaggagagagtgccaagccatgcatgaggaatccactgccatgatccaacacctcccatcaggccccacctccaacactggggaccacatttcaacatgagatttggaggggacacacatccaaaccacatcaccacacagttgtggtgataagatataaaatctatcatggcaaaggcaaaaaataaaaagaaatgaagttgagtttaacaatcagtggtaagtggcagttataaccactgtgtcttctgtctcatagtggaacaccgaggcatggggcagcttcccatcaccttacctttgatgatggtacctcttagctttcttcttggggcctccgtctctccatttgtaagcagaatattggatttgctagttcctgcggtcctcccagagtgacatgctaggctgctgactggaattgcggaggggccagagcagaccgcccctagaagggtccgcccaagtaggaaatgacagcctccctgccttgtcatctcctcctccagagtggacgtatggagacttcactgcacatgtggggattgtgcttgttgacctcgtagttccctctgaagagggcatttgggtctcaatagaggcccagttgctgcccagggaaataagaaattctataacatccacagcttatgtggccttaaaaactcaaagaagagctgggtgcggtggctcactcctgtaatcccagcactttgggaggccaagatgggcggatcacaaggtcaagagattgagaccagcctgaccaacatggtgaaaccccatctctactaaaagtacaaaaattagctgagcgtggtggtggatgcctgtagtcccagctactcaggaggctgaggcaggagaattgcttgaacccggaaggcagaggttgcagtgagctgagatcgcgtgactgcactccagcctggcaacagagcaagactccatctcaaaaacaaaaacaaaaacaaaaacaaaaacaaccaaaaaaaaacacacaaagaaacaaaaccaaaaacaaagacaaaagaaacccccaaaaaactcaagtccatatgtttaaatatttgacaaccattgcccttttgggggattcgaagggagcaggaggtcttcagggctgctgaggcggaattggcaccattcactcaaagcttattgctttctgagctcttgtctgttaaatgtccctggacagtcctagccaatgaaactcaccttagtttgcttcaattttcctgtctctgttcattcatgaccaaatgaactattttggggagagagaaattgccattcctggtgaataacaagttagtagatcattggaggccaattcaaggcctgttaggagcaaatccagcctttgcaaggattatttcaaaacctggcatttccgtcgaaaaatcaaactgggcttgctgttgacctgaccatgtgtgttgagaccacagtcctccatcttacttgggtcatgttgactcatacatcggtagtttggaacccactttgtccatggaaatggtggtgttggtggaaaataaagcatggacaattaaaaacaaaacttctgaagttactgtctgatttttttttttttttttttttttgagatggagtcttgctctgtcgcccaggctggagtgccgtggcgcgatctcggctcactgccagctccacctcccgggttcacgccattttaccgcctcagcctccggagtagctgggactacaggcgcccaccaccatatccggctaatttttaaaacattttttttttgtatttttagtagagacagggtttcaccatgttagccatgatggtctccatctcccaacctcgtgatccgcctgtcttggcctcccaaagtgctgggattacaggcgtgagacactgtgcctggcctgctgtctgatttttaatttacctttgagccaacttttaaaatcagtctccctaataaatgaggggggttgaggggtgaaaaggaggaagacatcccagcagcaggctaggtgccagaaggaagctgtcctggggttaaatgctggccaaggctattactgaaatgggtaactcacattcagatgatggaatctggctgcatttagtgagctcttgcatgtgtatatttttatgccatatactgcacttccttaaactcaaggtatttgatgcacttcacgtagtggttctcagcagggaggctgcagctagactgctgtcatttaaatacagtgtctgccactcactagctgtgtggcctagcactgggcttggggtgaggggagtgaggtgccaggggcagtgcacgtgcaggcagacccctgagcagggtgccttcttaaattcccggccccaggcgcttcacttgcctcgtcacagtcccagccctggagtgacccggagccttgtttagctctatacctcagtctcttcatctgtgaaaggggggtgactgtgacacccaccccatagtgttccaatgttggggatagctgaattaaaaggctggaggtatttaggatggctcctggcacacggcaggcgctgggcgagcatcagctgtcactcaacacacacagaggctgctttctcaagggcaggaagcaggggaccttgaagcttttccttctggtggttctggagtttccatgcatgtgctacttggaagccactgactttcaacatcaagctcctgctgcacccattttctggggctggcctggtgcttgggagcctcattcttgccttgccagggtctgcctgctggactggccactggtaggctagaggaggctgcaaggatgagtggaagggaggacctgttgccctgcttccctctggttcctgctttacttcctgttcctgcctcatttcctgctcctgctttcctttctgttcctgcctcacttcctgcttctgctttacttcctattcctgcctctttctggctcctgctttacttccttttccccctttagtttctgctcctgctttacttcctgttcctgttgtgcttgctgctctgctttcctttcctgctttacttcctgctcctttgcttcctgctcctgcctcacttcctgttcattcacttcctgcttctggtttacttcctgttcctgcctcacttcctgctcatttggttcctgcttctgctgcttgttcctgcctcacttcctgctcctgctttacttcctgctcctttgcttcctgttcctgcttcacttctgattcctactttgcttcctgcttctgcttggcttccagtctcgcccttcagctcccactcctcatcctgctcctgccactgctgccccacagcatgacttcctgttggtggcaggtgggcttgaccttaggactttagcacccagaatggggaaataggcaggagaaaggggtctcctagaaaggcggaaggcggggactctgtggctgtgggaatgtggggatgccaggagcctcctaccctgctggtgggagtgaaaaatggtgcagccactttggaaaactatttggcagcttcttaaagagttcaacagagtcttaccatgtgacccagcagttctcctcctaagtattaaactaggagaatgaaaaacctaccttcacacaaaggctttctacagatgttcctcatagcattattcctaattactatagaaacttcaaacggcctggatggccatccgcaggtgcccacctgagcaagtgtggcccatgcgccctgggactcactgccccgctgtcagagagtatgcgctgcagcttcacgccacagcaggcatggcctccgaaatagtgcctgacatggaagaagccagatgacactgcaagacttcatggataggaaatttctgggagaggcaaaacggtagagacaaaaagtagatccgtggttccctgaggatgcgggtggggattgactgccaggggtacagtgaagctttctggactgatgtggctgccttagaactggattttggtgatggttgcttaattatacgtttactaaaagccatccaatgccatctttaccatgggtcaactgtatattcattataatcctataaagctgcttttaataaaatcattgtccaaatatttaaggtggtggatatcccagttacactgatttgatctttataaatgatatgaataaaatgatcacatgaaccccccacatatgtacacctgctatgtatcagttaaaaaaaaaaaacagtgcctggccaacatggtgaaaccccgtctctactaaaaatacaaaaaattagccgggtgtggtggcacacgcctgtaatcccagctatttgggaggctgaggcaggagaattgcttgaacccaggagctgtaggttgcagtgagccgagaatgcaccactgcactccagcctaggggtcagagcaagactacctctcaaagaaaaaaacaaaaaaacaaataaaaagcagtgattgtccccttctccgtgcaggacttgggaccgggacctgccctctcacgggcgtttggggtgttctgtgttcgctcctgcaggcctgcggagcatggggtgagcagcagagagcgctctgccacagctcccaggagaagctcgcgcccagctgtggatgcggctgctttgtctctgtggcaactgttttcttaaaaaccttgggtcaatagaatctgtgtcaatcaaatcccattttctccttgacctacgtgaccccttaagagctgtgtacggtgctgctgaagagcggcctcggggacttaaggcctggaaatccagcgtgtaggagtgatccgcacacaatggcacctgtagggcgttgctctggggcatccctgcagagagtgcttttgtgagatggagaccattcaggccccgtggaggatcccagacagcagggggctctggtggtccacgggtgggatgagcccgccggcctgtgctttcctgcacaagggcctcctgaggggaggactccagggagtttcccacaatgcccagcagctctgagtaatcctcctgggatgggagagagggagcacacggaagagaattcctaggtgaccgtggcagggacaaacggctcagcaggtggcttgtccggaagtgctgtgggagtctgagctctggtggaatcccaagattaaaaaacaataataagaagaaaacaggctgggcacggtggctcaggcctgtaatctcatcactttgggaggccgaggcggacagatcacctgaggtcagaagttcaagaccagcctggctaacgtggggaaaccccgtctctactaaaaatacaaaaattagctgggtgtgatggcacacacctgtaatcccagctactcaggaggctgaggtaggagaatcgcttgaacccgggagatggaggttgcagtgagccgagatcgcgtcactgcactccagcctgggagacagagcgagtctccgtctcaaaataaaataaataaataaataaataaataaataaataaaagcaaacccactgtgctaaaggaatgtaacaatgccctgacagtcatctcgctaagcctctcttgataagatgaggctggccaggtagtgaaagggtttagacctggttggaaagcgactgtgtctacatgaaatgggggttattttatcctcaggctgctgcggcatccacatgcctgctctgaggtggcgggacacggttcgtgaccagctgaactgagggtggggtgggaggactgaaggtttggaagctgtgaggataatgatggcactggctttgatcttgttaactgtgagatgctgctcagacacattggggtgaggtctgtggccagctttcactatgggtgtggacagagaaggggtttgagttggagacagacgggaaagttatcagggggaagtgacggccgaccacctgagagtggtttcacttcctggaggatacacatttacatatattaaaaaaagagctgagtgccagaccctgtaaaaacaatctgaaaatcagtcaaagaagacagatctagctaaaaagacggagaaatccacgtggccagagtaaataaatgaaacaatgcaatgaaagcagctcttctcatcaacaatttttatggcaattttgaaacatctaagaagggggaaagaattgttctgtaacacggacgaaccaccatctggattctgcggttagcatttggcagcatccatcatctcaccgtcactctctccatcatggaatccgtcgtagtagtctttaaccaaaagcagcttttaaaattctgaaattgaattatagactcaattctaactttcaattacacaattgaaagttacgtcggcatcctaaagtcccttccactccatagggtaatatttagatcaaatcttcctaatggtaaatgtcctagaagccagtgcagctcacaaataaagaatctcatttcaagagagcaactgtgaactcagggtaatgaaatctgtccaaatacacaggtgattgaaaaagcgtgccaacctttcattgtatgaatggagaataccttgggcctcttcaagctgggaccatgcagggcaaacctgcctcccattctattcaaagtcacccctctgctcagagatagatgtatattctgattgcctcttttggaaagacttatcagaaactcaaaagaatgcaaccatctgtctctcacctacctgtcacctggaagcccccagtgtaggggacttgctttgagttgtccccacctttctctacagaaccaatgtacttcttacatgtattgattggcatctcatgtgtccctaaaatgtataaagccaagctgtgccccgaccaccttgggcatgtgtcatcaggacctcctgaggctggggcatgggtgggtcctcaaccttggcaaaataaactttctaaattaactgagatctgtctcaaattttcagggttcacagttagttaaacatgggacgatcgaggtagccaatactcatgtgtgcaaggcactgttctcagcgccgttcacggattcccttatttcaggttcatacaaacctacgcaaaccaaaaataaaattctaaggcccccagccttctgaatgggcccttcctctcgcctaagggcattccaaattgaacctgaaaaactagttcagggcatgatggaaagcgcaggtcagtcatgcctcattttcctatcctacctttttttttctgagatggagtcttgctctgtcacccaggctggtgcaatctagactcactgcaacctctgcctcctgggttcaagtgattcatgtggcctcagcctcccaggtagctgggattacaggtgtgcaccaccatgcccagctaaattttgtatttttagtagagatggggtttcaccatgttggctaggctggtgttgaactcctgacctcaagtgatcctcctgcctcagcctcctaaagtgctgggattacaggcgtgagccactgcgcctggccttcctctccttccttttggaactcaggaaaagctgattagcatttaacatcaacgcagaccctaagtctgaaaagaaacatttacagtctattttctctgaagtctgctacctggaggcctcatcggcatcatgaaaccttgctctccacaaccccttattgtaacccagacatttatttctattgatagtaatgctttcaacctgtgaacctagaacatttgacggaggtctcagttactatttagaaagtttattttgccaaggttgaagacacacacccatgacccagcctcaggaagtcctgatgacatgtgcccaaggtggtcgggcacaggttggttttacacattttagggagacatgagacgtcaatcaatatatgtaggaagtacactggttcggtctggaaaggtgggacaactggaagcaaaggcaggaagactcgaagctgggaggggacttccaggtcactggtaggtgagacacaaatggttgtattcttttgagtttctgatgagctttgccagtggaggcagatcagatatgtgtctatctcagtgagcagagggatgactttgaatagaatgggaggcagatttgccctcagcagttcttagcttgagttttctttagtgattttgggggcccaagatattttcctttcacaaaccaactgctaatcagaaaattttaaatttacatttgacctggaagccccacccctgctttgagttgtcccacccttgcagatggaaccaatgtaaatcttacatgtatttggtggaggtctcgtgtctcccttaatatgcataaaagtaggctgtgcccccaccacctggggcacaggttctcagcaccccctgagggctgtgtcacgggtcatggtcattcatatttggctcagaataagcttcgaatattttacagagtccgactcttcgtcgatacctgtggggcatcagcgctctcatcattccgttttatggatgaagaaactgaggcccagagagtttaggtgacctgcccagggtcccacagctggtcaggggccatgctgggatttcaccagagcccagatctctggcacctgtcagcacaccatgctgcctcccagacaaagcaaagaggtgccatcttaaaccctccaagttagccgcgatctgtaaaaaaggatgatgcttcctgttggcagggatgcagcgagagaggcctgcccacaggaatgtaaatcggtgcatcccggaaggctgtttggcaacatgacccaagagccatgaaatgcgtgtgtcgactgatccaggcattttgttcccaggaataaatggccatgaaacaatgcaagaggtggagccaatgtcctatccaggggtattcgccggagaatttgacgagtgaggcaccaagcagcagaagatgcttattgtatacattatgaaatgctcctgtaatagtaatgttcacaggtcacgatttaaagaaaaatttatatgatgagaaagtgtttactctgtagaacacatcaggttacaaaacagaatttaggaaaacaaaataaaatcacaaccgtcttcatctactgttatatgtgtatacaaatacacgtaattataatgtatgtatagtccataaaataataacataaaatacattggaaaggtaggtcccaaaaataccagcaacggttatttcaaagaagggctttttggggtggacttgacattttgctttgggcttttttgtgtcttctgcaaggggcatgcattactgtattaccttaggcatctgaatgctatccttccattctcatagtggtagttacagaagaggctgcagtcagctcaaacgcttcccttttttattgcgggtgcagaggcttcgagggagagggaaagctgtcagtaggtggcgccagagggtggcagttgtctcaggctgcgtcagggctggtgcgagccagcctggccttaaagtgaagcccctggttctctgccatcccatgtgcaactggtgattttgcaatttctgcatgtgtgtggggcctggctcccctgtggctggaggcctgcatggagcagggggcatgccaagctagacagtgacaaattactaccatcgagggcacctaagcacaccttgggctctataaagcacagccagagccaagtgctgcccttaaaaatcagataatctcaggcggttgtgaagcaaagtgaaaacaggaaaatgcaaggggcggagaagctgtcggtggagagagaaacagtggagagttctgccaagaagcttatgcagctttttcctctgaggggacagagaggctgggagagtggagagctgaccctgttggtctaaaccctttcctatggagggagcaggagtgaaaatagcaaccctgaggacacggatactttaggtcagtgtagcagttgagagactttgacctggacatagaagccagagatgtatgggttcaggctctcagaaaaaatggagtcagtttctccctccattaatgagaatagataaacccagctcagctaaattcttttttttttttctgttgccaggctggagtgcagtggcacgatctcagctcactgcaacctctgcctcccaggttcaagcaattcccctgcctcagcctcccgagtagctgggagtacaggcgcccgccaccacaccccactaatttttgtattttagtagagacagtgtttcaccctgttggccaggatggtctccatctcctgacttcatgatctgcctgcctcggcctcccaaagtgctgggactacaggtgtgagccactgtgcccggccagctcagctaaattccaaaagtgtttattgactaccttggaaatgatcataatgatgataatagtaattacaattgccaccaacatttatgaaacccttactgtgttaagtacttaacatgggttattgcatttaagccccaccatggtccagcaggtggatatgactgccatcatccccgaattacacatgagggcactgaagcttaaagaggtgaaacaacttttccaaggtcacccgtggctaggtcttattgcacacttaataggagccaaggagagtgagtcacgatagggcaggttatgctgctgtaacaaacacattgaaaacctcagtggttgaaaaatatgtttatttctcaatcatgttatatgtccattatatgtcatcaagagggctctgcttgttgtagttcctaggggtctgggtggaaggaagctccatctgaaagcatttttccatgtgggtagagacaaggaaaagatcatggtaaaccacacatggactcctagagcgcctcacctgaagtgacatgcacaccaatgactgctcacagtgtgttggccggagcaggtgccatggctctgcttcagtcagtagagggggatgggcacgaatatgttcctcttgcaagaaagggaaccaagtatctggtttccttattctccatagcaggggtccccactctagccacagagtggtgccattaggaaccgcaccacacggcaggaggtgagtggtggacgagcgtgaccacctgagctccgccccctgtcaggccagcagcagcattagattctcatagcagctcaaaccctgttgtgaactgtgcgtgtgaggggtctaggttgcctgctccttaggagaatccaatgcctgatgatctgaggtggaacccctccccacctcggtctgtgggaaaaaccgtcttccatgaaaccggtctcaggtgccaaaagtttggggacggctgctctctggctcctattaacgtgcattggtttggaaaaagtgcattattttatttgattttacaacacgctgtgtcaggcgttattattatttttgttttatgcaagagaaaacagagtttctgtagcacacccggctcacatggctactaagtggagcaggtatgattcaaccttagctctgttccagcctcaaagcccagttcttcaaaaacagttatatcccatggcggggagggggtctcagtagatatgttccaggaagagtacgcttcttggtttataaaataagatatgatattaaatatttggtatttaaatattgcatttaaatattcgtatatatttaaatacaatttaaacattacatttaaatattcatgtatatttaaatacaatttaaaaattgcatttaaatctttgtgtatatattgttccattatttaaatattgtatttaaatattgtacatggtatatgtatgttatatgtacatacatgtgtatatacacatatccacatatatacacatatatgtatatgtaacatgtgtatatatacatatacatatatataacatatacaatattgaatattatatatatatgatatacatatatcacttctcaggaatgtgtttaaagagaaaatgtaaattttgggtccctaagttcaacacaatattttaaacaaaatgataagtggacaaaatctcaactcacactcaacatgcaatgggtagagccttgaaatcttgtgtagatattttgaaaaggtcacccagtgtcagcaaaagaaccgggcatctcaccaggcatctcagacgttatggcactaagggagaaatcctggagctaccgcattcaaaacgacggtttgtaacaatctcatgaattgcttgatggccagggagtgatgttctgagatttctacctactaacacaacaacgcgttgtgtatatttagggcatgtactggttttcagttatgttttaggaaattgggtggcacgtttgggtttatgtgtagcatggaatagcttagtaatagaaagaaactaggattctggagaggactttcacaaagaaattccgatattttgggaagagattgttgaggtactaaatgagagatgaatagtggaatcaagtatgtggtacagttgaaaaatactacaaattcttgagtccctgacatcaagacatagaatgggaaataagacctacgcacctgtctgtgtgtgcacaggtatgcatgtgtgtgcacatatgcttatgttcagatggaggctgtccgtctgaacttaaaaaataaggactaatcaaaatatcctccagggactctaagaaataaccgagacaggggttggggtggcctaagagactctgttatgtacgctgtggtaataaacctgtgaacagcacattgctatgttaattcacacttgtagacatgttggcaacacatacggatatttagtctttggaagactctggggaaatctcctgtgtgaagcataaaacccctagcattaccataaaatgatgtttcttctttccaattatactgggctttttggaatcgtcgtctcttaacttaaaggattatctttcagcggtagaatattcgatctttgagcaataggttgttgcatgagatgtatttacaccaagatttcatcctggccctttcactggtaccattctttctttagctgcttctgccccaagagtcttatcgtcctctcattccagtgttgtgtattttagttgctgttgtttctggatcatgcattaagcagtaagcatgatattgacagttttctgtgtcctttcctgaggtgggctggagaggatctgttcctggaactagatttcctttctggatctgttgacaaatgaatctcacacacaacttctctgctggcatcagcatttgctattccccatggagtccagggttcatagcttttctgggcatgaaccctatgatctatcagccaactggacaaacagaccaggcagaagagctgctcgcaaagccagaaacgtgtgcatgagctgctgggtggctcagggaaggtgggctggagcagcttggcgcttagttaccagtctcgtggagaccctcgctggtgttttaaacatccttcctgctgggctcacctcttaaacacatcagcagtatctcagtagcgaagtagatgtggaggacgctgactctgggaaggagaggaggagtggtcagcctcatgcagagccttcccccagtgggaatgtcacctgaattagggcctaagagctgctcatattttaactgaaaactaccttgtggggagaaggacaggaagaaaccctaagaaaatatagtgcggtctattttactacaactatatctggagcttaaaatgaaaaggaagaaaattgttacattcgtttaaaatgggtttgagcaaagcaatagaatacatggctaacagtggcttaacacatagggctttgtttttctcacaagaggaggggtttgaatatggtcaactgagagcaaggattcaatgcatcgaggatgcctggctgtcgttcttatgattctctgggcctttgcctcgtggttgaaggatggctgccacagctccagccatcacatctgaattcagaatgggaagcaggagaatgaggaatgagggataacactaatttcatttgtttcctcttataaggaaagccagcactttcccagaactctctcctctctatgcccgtcagatttttgcttagacctcattggccagaagagtgtaacacagctacctgttgctccagcagaatcagggttcactgccaccctgaattaatcagtatatttctgtttatataggaaaaggggtgaatggatatcagaaagcattagcagtatctgtcccattaggggtactgagttttgcctaatgactttctcctcttctgtttaggagaactgttcaccctgtacctcaccagggagagggcgatgccctctgcaagggttctctccaccaaatccaaaggtcatcagtgccacagagaatcccagcccctccagcaggtgcccagggatgccagtctggacagacacccagaaatcagtctactggaggtgaacagtgagggcctggggtggggtcggtgttcaggtagctcagagtaaatgccctttgcattactggcctgtagataaatgagcctggagagcatggcccccaggaatgacacaaagaaaagagctttctctgtctttgggatgatttagagatttttctactgccttaaaaaacttttattattttgatataatttaatgcagaaaagcagcaagaatagtgtaaataactccttcaaacctttatccagaattattaaactgtttatattttgccccaattttttatcattggtttcttggtatctatctatctatctatctatctatctatctatctatctatctatatctattaatcatctatcaatctattgatcatctattatctatcatctggctattatctatcatctgtctacctatcacctatctattaccttattacctatcaattatctatctatccatcttctatctgtcatccctctatcgtctgctatccatacagagagaagagagggaaatagaggaaagagattttcccccagaattatctatttgaaagtaaattcagatatcttatcctttatccttaatatttcagtgtgtttttttctaaaaacaaggagattctcttataccaccacaatacaaagttcaaaatctgaaaatctaatactgatacaatactatgacctaatctgcagtccctattctcatttgatcaactgccccaataacttcctaatggccactttgtttcccagtccagaggccgacccaggatctcacactgcatgtgttggccacgtgttccagtctccttccatctggagcagtccccgtctctttgacccgattgaagagtatagcaagttactctgcaggccgtccctgggtttgggtttgcttggtgtttcgtcatgatttggtttagttgtgcgtccttggcaggcccatgatatgtagataagttactgtggaagtgacgtcctggcctcagtatccctatcaggacgcgcaggactttggtcggtcccgctgctggtgatgttgactttggtcgcctggttcaggtagtgtctgttatagatttcccactctgaggctactggtttcccctttgtaattaataaatagttcatggggagatgctttgaagctgtgtaaatatctggtatttcacccatatattagaggtgcagcccccatagcttttttaccagtagggatatctaaaatttagaaatctttgatcattcctgccagtagaggtatgctaaatatatgtatatgatcaaaatgtttggaaaaaactttgaccaaaaacaaacaaaacatttgaccagggaacagcaaacgttttctgtaaagaatgagacagtaaatattttaggctcagctggccttatagtctctgtcactactagttaaccttgccataagagtgcagaagctgccatggagaatatgtaagcaattagctgtgacagcgttccattaaaacttcatttataaaaacaagcggtgggccagaattggttcatgggccatagtctactgatctgcaccttatgccacagtcaacttgtttggccctgaaaactcagaattcctccttaggggtgatatttctactctctagcctctgacctagaagctttagggtcttaattgctggcacataaatttgcaatgaaggaatcaaattgtgcagcagcctgttgtatgatctcaagggcgctgacatcaactgggcttagaacggccaagtcccctttgcctgtgtcaagaggttttcctctagaaacttgtattagtcttttctcatgctgctaataaacacatactcgagactgggcaatttacaaaggaaagaggtttaatggactcatagttccacctggctggggaggcctcacaatcattgcagaaggccaggagaagcaaaggcatgtcttacatggcggcaggcaagagagaaagatcagctctcgtgagactcgttcactcccacaagaacagtatggggaaaaccgcccacatgattccgtcatctccaactgggtccctcccacaacatgtgggaattgtgggagctacagttcaagatgagatttgggtggggaacagccaaactatatcaaaattattataaagaaggacctcaaccaagagctgacacacatgggttttgtttgtcttgtacagttttaaattaatctgagttatttttggtgggcatgggctcctccagttcccacgagccccactccctgcttctgcctcccgcctccccgcatttatgggttccgcttgaccgtgagatgatgtttcttttccacctctttgtgaggtcttgacaattagggaatcattttctagaattcctatctcttgcagccataggatgctaaatcccaaaaggaaaattcaccaaatcaggatgtttatatttagtgcctcaattagccacactccaagaagagaattttcatcattgtaaggcacactccagggaacccagcgcttcagaaggatgtggctctttgcttagtttgtttagctctgtctggttgtgcagattgggcaacataacctggatcggccaggacacttctggatcaaagtgttgcacccacagccggttcttggtggcacaagagcccaggcttctagtcccagggtgtttcgggtgggcgccagcaagtcagcagccgaggggaatgagtgttctaggcttgggggttggttggagacaatctgttagtttattttctcagagagggaggtttgtgggcaattcccacagtgggactagattgagatagtcaaccttctgtgtgatagctgccacacaggcttgaccagcagtggggttcttgctcctggatttccagccaatggggcaggggtgtcagccagtgaaacacacaacgtgaagatgtccggcactggcggaaacatgcagcgtgagcacatgtaggaacgtatctggggagacgtatatatgtggactctgtaggaatctgtctatcggggaaggatgtgggggtgctggagacccacatctcaagccatctctgtgtattctgtttttttttcctttgcaaagaggattgatacgtattttaaaaagttgaagtggatgtttcatgctcatgttttgcagccctgattttggggttttggaaatagtccagcaaaagtttgcctgattccattaaaaaatccaaatacagactttctcatcgcaagagaaccttctctttaccagagcactgggagcacccagaccgtggaggggaccctcttagggggaaaggtcaaactggagtcactgagctgaagccgctcggtgtcaggtggaaccaagtgtccccaaagggccctctcctgggcttcctcccgtgggggcccctctgcggggatggggtcactggccgtctctcacgccctgctttccctctcatgctgtatctgtggtctatccttatgcctggcaggtgtcaccaactttaagttgtgcgacttggggctcacacactcacacccttccagggtgggagggacgaacaagcgggtgaagccagacagaggatgctggggtgggcaggggagcggagggcccaaggacagtgggcaccccctgcccagaggctgccaactgctggcctgagggcagagggccagtgtccctagatctggtttttcaagagaagtcagaaatctggaattgcgtgtgcaacccccagatttttaaatcttgccatcaaattcagtttaaaaattgggtggaccaaaatgtatacaggctcagttccacctcaggctgcaggctgacttgtggaatcagttcaagggcactgtaaggtcatagttatcctggaggacgtgttagtctctgggtttgctgaataatccagctgtgccagttaggcctgggcgcagctgcttctacaggcaaaaataatagtggcttagacatagacgtttactcctttctcatgtaacagaaatctagggctgaggtgggcagatcatctgagctgaggagttcaagaccagcctggtccacatggtgaaaccctgtctctacaaaaaatacaaacattagctgggcgcagtgatacacacttgtaatcccagctacttgggaggctgaggcaggagaatcgcttgagcccaggaggtggaggctgcagtgaacaaagatcatgtcattgcactctagctggggcaaccagagtgaaaccttgtctaaaaaaaaaaaaaaaaaaaaaaaaaattccagaagctagtttggcagctccaagagggactgagcttttatctttttgctttatcatcctcatgtgaagactccattcttaaggtgacctcataggccagtatggtggctgaagctccagccatcacatccacattccaggtggtagaccagaagaaggggaaatgggacaagaatgcccctcccagaggggcctacctttaagcagcctttcctgcagtttgacacacaatctcctcttatactcattggctggacttagatgtgcaggaacttaattaaggaacttaatttttattctggacagcaatgtggccagataaaaatctgggttctattactggagacaattataagggtaaatattgtgtggataaagaaaatgtggcacacatacaccatggaatactatgcagccataaaaaaggatgagttcatgtcctttgcagggacatggatgaagctggaaaccatcattctcagcaaactaacacaagaacagacaaccaaacaccgcatgttcttactcataagtgggagttgaacaatgtgaacacatggacacgggaacatcacacaccgagacctgtcgagggtggaggggctgggggagggatagcattaggagaaatacctaatgtagatgacgggttgatgggtgcagcaaactgccatggcacatgtatacctgtgtaacaaacctgcacaacaaacctgcgcattctgcacatgtattccagaacttaaagtataataaatttttttaaaggtaaatattatgtagcatctaacttttatttttaaaaaaggaattcttcacttaggtgatctcatgggggaggtcagagggaggcactggaccagtttgaggggacagcgcatgactccctcctgcctcgggtctgaactttcctgcagtgaccacccttcctcccgggtcataaggaattctaaaaacaacaagcagaccgacaaaaatgacgatggtgatggcgcgggacttacctgcagcctctgtctgccgtctcctgcttctccctaggtctcagtgcagatgcctcctgcccagggcgactttctgcatccctggagtggctcgggacccctgttctgtgttcccacagctctcagcacttttccttcatgcacgttgctgcagtttgcaatgacagcttctgcgactagagtgctgatgccagtccctccccaagggcaggcctgagcccactgctttcaccgttgtgtgtcccagtgcaggagcctgcacgtaggggccacgcgacaaagaattgctgaatgaatgagttaccacaggacccgatataaaaataaagggaactataagaccagatgataagcaaaataaaaaaaataaaactggagaactaagagagctaaaatcatgtaagtagaaaaatttaatagctcaagagctagatctcaaggcatcttctttttaagataaggaaagctaaaggtgggaatcagtagcggaagaacaaaaggaggaaataaaatagttaaaacaggggcagtagagagacggctggctccagctctgacgtgtaggaagcccagaagccatcatttacttccagcaagaaacagctgaacaggctcagaacccgaggatgtcctcggccccctcagagaacaggttgtggatgagccaccaccccgaaatctggaaggatgggtgaatgcaggcctggggcagaagtcgtggaaacctcgaatgagtgggggaggatgggaacaccccggtggtgactttgctgagctgctggaggttgagtgtggaagcttgagagtgagaaaccctggggcctccctcctaggggtccctcacactcctgcggttcaaacctccaggaagcccacacgttctcacaagtgaaggtccaagaaagatccccgttggctctggaaaggggagcagaagagtcacccttgtggaatctgcccagagtgttctccccaacacaggcttgctccgaggcctgccgaggctggggaggcacttcttccaccccggccctctttagcctccctgtctcacccaaggggaacagaaaagctacgtcactggaggaacacttgtgaaggtcatagcccctaaaaacggagactccatcgtgggatgactggatgctttccttcccccacacctcaccgccacacatacacggctccggtgccgtaaccctgggttccagccgaaagggctgcaagatgtggaccctccctgaggaggaggacttagggaagccccaggtcaacaggtgagacaccagcagggacgttagaggagccggaagcctccggcaccggcagctgcagcaaccagtcagcacaacccaggcccagccatgtacgtcctcaggctgcagccctgctcacctcagtcctgttacctggcacagcatgtctggtctcaacagaaaattgcaaagcctgtaaaaagggaagagaaaaatacagacaaagtaaccatcagagccagacttaaagatgacacagatgttggaattaccgtacaaggatttaaaagaactacgattgatgtgttaaaggctgtaatggaagaagtggacaacatgtaagaacagatgggtaaatgtggctgcaggtacagagtttcacgtgtgcaggatgaatacgttctggagattgaatgagcggcatgatgattatgtttaataatactgtattgcagacttaaaacctgctaagagagcagatctgaaatgttctcatcacacacaaataccaaaaggtaactgtgttgctggctgtgttagcttgatagtggtaatcatttcacagtgtgtaggtggagcaaaacatcacattgtataccttaaatagatatgatttttatttgtcaattatacgtcaataaacttgggggaaaaaagaacagatgggtaggtagagaaatgaaaatgctaaaaaggaatcacagaaaatgctagaaatgaaaatcactgaaacaaaaatggtgaaatcctttcccggactcatcggtagatcgggcgtggcccaggcgagtcagtgaacttcaaagcaggtcggcagaaacttcccaacctgacatgagaaaaacacaatgggaaaacaaacagcaaaacaagtcaagtcgaaacaacattcaacaactgcgggacaatatcaaacgtgtcatatacgtatagctggaatattagaaggaaaagagattagagcagaataaatatttcaagtaataagggctgataaatttctgaaattaatgtcagaaccgaaccaaagatcctggaagctcagagaacaccaagcgggaaatataccaacagacatggctggacatggtacagtcacaccgcggaaaaccaatggagagacagccttgggagaagccgggggaaatcacctgacttgtgcaggaacagggataagaattccaggggaattttcaccagaaaccacatacgcaagaagagagaggagtgaaacatttaaagtgtcagggacacacacacacacacacaccccaacctagaattctatatccaccaaaattatccttcaaaaatgaaggagaaacaaagactttctcggacaaaaacaaaaacagagggaaccagggaaatgaaaattaaaaccacagtgagatatcacctgatggccattattaaaaagccaaaaaacaatagatgttggcttagatgcgttgaaaaaggaggatgtgtacactgctggtggacatgtgccttagttccacctctggaaaacagcatgcagattccttaaagaactaaaaggcggtcccatcactggatccagcaatcccactactgagtgcacaaaggaagtcattgtaagaaaaacacacacacacacagcggtgtgtttattgcagcccagttcacaattgcaaagatatggagccaacccaagtgcccgtcagctgatgagtggatggagagaatgtggtatgtctacaccacggaatacttcgcaaactcagctgtagaaaagaatgacagaatttctttcacagcagcttggatggagcgggaggccattcttctaagtgaaataactcaggaatggaaaacaaggaccacgtgttctcacatatcagtgggtgctaagctctgggtatgcaaaggtcgacagggtgatagagtggacactggcgactcaggaaggggaggctttgcagggagggaggaaaaactactcattgggtacaatgtacactacttggatgacaggtgtgctacaatctccgacttcaccgatatacaattcatccatgtaaccccaaaccacttgtaccttgaaagctatagaaataaaaaaaaatgtataaaaacagagagaagtcaccaccaccagacctgccctgcaagaaacattaaaagaagttcttgcgggaaaagaaaaacagtatgtcagaaactcagatctatagaaacaagagtgttggggagggaatacgaggtggtaaggtctttgatttttcttactcttaattgatctaaaatagaatgtcttgcttggcatcataatagtaataatgcattggatgattctagattctggttaattgaagtaaacggccatgtcacaaggaacgggagacgtaaaccaggacgccccaccacaaagagtctgcactcactcgggctggagccgtgttattccaaggtggactatagttcaggtgaatgtccgtggagagctccagcacaggcactggaaagatttcgaaaatgtatataagtgaaggtcaaagagagaaatcatatcaaacactcacccaaaaccaataagggcagaaaaaaggatattaagaaaaaagtatgaacgacactatgtccacaaatgtaataattttttttttttttttgagacggagtcttcctctgtcgccaggctggagtgcagtggcacgatctcagctcactgcaacctccacctcccaggttcaagcgattctcctgcctcagcctcctgggactacaggtgcgcgccaccacgcctggctaatttttatatttttagtagagacggggtttcaccatgttggccaggatggtctcgatttcttgacctcttgatccacctgcctcagcctcccaaagcgctgggattacaggcgtgagccactgcgcctggccaaatatgagaatttaaatgaaatggatcaattctttgatagacccaatctgctaaaactcactcaagagaaacaggtgatctagatagtcccatatctattaaagaaacacagtgaacacttaataagcgtgcaaaacaagcacggcccaggtgctgcagccaacatcatagttagtggcgagaaactggacactttccctctaagattggggacagggcagagatgtcccctcttacctgttcaactttgtatactgcaagtcccaggtagtgcagtaagatgagaaaaggaagtaggagatgtacagattgggacagaaggaatgaaactgtctttatttttattcgtttattttttttgagatgaagtcttgctctgtcgttcaggctggagtgtagtggtgcgatcttggctcactgcaacctccgtctcctgggttcaagtgattctcctgccccagcccctccagtagctgggactacaggtgtgtgccaccacacctggctaatttttgtatttttgtattttttttttttagtagagacagggtttcaccatgttgcccaggctgactcctgacctcaagtgatctgcctgcctcaacttcccaaagtgctggggttacaggtgtgagccaccacacctggcctcaagaaatttttaagcacaaagtacagtattgctgactgcagacctgatgtagtgtgccagatctctagtgcacactcacctagcgtggctgagactttacaccattgatccacagctccccgcgctccctctccagcctacggcagccaccactctcctctctgcttctgtgaggcatttgacagtttcagagacctcatctaagtggcatcatacaagatttgtccttctgagactggcttattccacttggtgcaatgttaaggtccacccgtgttgttgcgtgttgcagaactgacgtcgtttgaaaggctgtgtagtattccacggtgtggatcgtggaccatgtctggtgtatccattcatctgttgatggacgtgtcagttgtttccacaccttggctgttgcaaacagcgctgcgtgaagtccacattctgtctatggaagtcttgcagggtggggaagagcacagtggtgggaagcatgcgcagaaagcaggaggtggtcgttgtgagcaacgcacctaggctgagacgtgcactgggaataggacattgcgtgaggcatctgcaacggcccagcctcttgtaacagccaggtggcccctacctggccgatagctattgatcacgaagccagcggcgtccttagcccagggtactgcgcaaacaaccaaagcttgctcaggaaagactggatagttcgacaaataactcagacattgactacagacgtcactggggggattctgccctgagtccctgtgaagggattggccaatatcctcaccacaggctggacaccaaaccccctggcctggtctgtcttcctcttacgttgttcaagatagactcctgctcattccacgtggcgccgtcttgttccctcacagttttctgagatcagaatcattatttggtaaagatcctggtttaggaacattctagattagctctcgggatggcctcatccatggtgttgtgggggctgctttctccaggaagccctcctgcttcctgctttatctaggccctttgggaggggctctgtgcccccatggctcttgggacagggtcctgtgtgttccttgtattcagttggaagaaacctccatccaccatctttatcactttaaactgcacattgcatactggagacctacacacaagagaaataatgggaagatgccacataaacacacagatctccaatttgtcttaaagactcagaaggttcctttcttaggtggcgacccacctggtggccctgagcaggtcagtgactgtgtgctcttgggtccacccccttcacttcctgctctgctccgtggcccctgaaaatacacccccaggctctcttgctgggtggccgcagggaggatccatgcaggaagctatggatctccagagattggcgagtggggcagagaagggccagggcatttctcctgctgtctctgctcagagcaccacctatgcccgtggatctcttgtggccccagctcccctggacagcaccttcttctgtggctccagcttctggggagcagccccgtcctgggctctccctacctacccagcctatggtgttggcttcctgctgtggtctctggggtgcctctctatcatggctgagttgtgtcttcccagatctatacattgaagccctaattcctagcaccttagcatgtgactgtatttggagacagcgtctttaaagaggtgatttaattaaaataaggtcatgagggctggctctgacccaataggaccagtgttcttacaaagaggagattaggacacagatatgcatggagggatgaggacacagggagaagatgccatctgtaagctgaggagagaggcctctggaggaaccagccctgttaacaccttgatccagaacctccagccttcagagctgcgagataatatgcctctattgtttaagccacgtgtctgctgtattttgttatggcagcctggacaagctcatatactcaccatcctctgtttggcaatggatatcaagttcctccgatgaaactacctagtgttttcttatcacttttattatagtagaagtaagaggaaagtgacatatctttaatcctatgtgtctatcaaaagctggaagatacgagaccccagggcgacacgtgtctcttgctaggtgttgactctcccatgtgacctgcttagtccctggtcagcatctgactttgcaaaccctgatttaagctttcaactgttctgctaaagcagtatcaagaaagacgagtgctttttatttgagtttattgggtttcctgacgagctgggtaaactgatgctggtttcatcgctggggccttctctgtaattggtgggacacatacatttttgaaatttctgtaccaaaggaaaaaaaaagtccaaaatgtctctactgctccttgttcatgaacatgggtctcctctgcttttaggtgaaatattctcagtgttttttttttttttcacgtaatcaaggagatgaaacaattcagagctgtctaaggccgtcagaaatgtctccaaccaatctccttcagggtttatctgtgcttcgctatgttgggcttcaaatcattctttttataatttttggagaaattccaaagtctgtaaacagctcttgttcttaaagggactgaagaaaaacacacacactctaagcagaaggaagataaaataagagaaaccgcgtctctgggacttctgggtttgaacatgatgtctttgtagatgtgagcacaggggctgagcctgatgaagcgccaggcacgtgggttctaagcggctttttgcttctctggggaagtgtattaagagtgatgcgtggaaacagccagtggccagcgtgtgcccctgccccttcccgggttccttctctgcagggcagctgccttcttgttggctgttaccaaacgatttcatccctgagccagtggagaattgtgatgtttgactttgcgctccgctgggatgactgttagagccagcttttaaaaacagcagacaccaggccgcgttgctctgcccagatccctccagtgactcttgtcttgctcacaatgaagcaggagttcttgcacatctaaaagccacaccagctggcttccgggtcccttctctccctcccttcctccctcccttcttccttccttgtaacccatccatgctggcctctgcagttcctcagacatgctgtacatctcctcctggggcctgtgtcctcactattccctccaccaggcacgcgttcctcatgcacaccggctccctcattccccagatcactccctccacggccaccttcccaggccctcccgtgccaccccaggcccatctctccccagtccctggtttcttagcactgattgtaactgccttgctagtgttgattggtatttgtttactgtttgcttttccgtcctgagcacagaggcccggtgagagtaggggccctatcagcgcctctgctgaactctgggcaccgcgggcagtgcatggcacagagtcaatgcttggaaagatgtcctgatggaatgaccccgtcctttaagtagaggggccaggcagatcctcacatcagccctgaggcacgggaagacctgctgtcctgcatccactctgcaagctgaccagcctgggcaggaagaatgcctggaagcagtttcagcgcaggggtggggaggaggggtgggggaaggtgggggagggggtgaggtaactttctctactccagccacagagtccacagcaggagaaccttctctactccagccacagtggtcggcctgtctctccccctttcttcctctctttcttcttctgctcctctttctcctcccccccctccccacccccgtcacacccacccctgctggaggtggaggaaggcctgtctcacctgcagagggagaccgggtgtgcactgtgatgggacgcaggcccccttagcatttcctgaactcgggggtaagtttccccagtagctgggcccggtggttcagcctttcttactgtgccctgaaggactgtgattttctgtttttctcaggttttgaaagtaacctttatttttaaaaagttaatgtatgtgttataggaaactgaaaaacacaagaagcaagcgcggagtcacccacagccacagcagtgtacggcgggacgtgggactgtgattttccagcccaggaagagctgctcggtggcagccccgggacatggagccattgctcagacagcctcagtgggagctgctgtggctgttgggacaggtgtctccacagggagtgtgagtgcacgtgtgtgagtgagtgcgagtgtgagagtgagtgcgagtgtgagtgtgagtgcgagtgtgtgagcgtgtgcatgcaagtgcgactatgtgactgtgaatgtgagtgcaagtgagtgtgagtgtgtgtgtgtatgagtgtgagtgcaagtgtgagtgcgagtgtgaatgtgagtgcgactgagtgtgtgagcgtgtgcatgcaagtgtgactatgtgactgaatgagtgcaagtgagtgtatgagtgtgagtgtgagtgtatgtgagtgcaagtgtgagtgcgagtgtgaatgcaagtgcgagtgagtgtgtgagcgtgtgtatgcaagtgcgaatatgtgactgtgaatgtgagtgcaagtgagtgtatgagtgtgtatgagtgtgtgagtgcgagtgtgagtgtgtgtatgagtgtgtgatgtgagtgcgagtatgagtggtgtgagtgagtgtgagtgctagtgcgagtgtgaaagtgcgagttcgagtgtgactgagtgcaagtgagagtatgtgtgcgagtgcgagtgtgagtgcaagtgagtgtgtgagtgcgagtgtgagcgagtgcgtgactgtgagagtgcgagtgtgtgtgtgagagtatgagtgtgtgagtgcgagtgtgagtgctagtgtgagtgtggatgctccaccttccccctggcacaaggctctggatgagaggagagctcttcccacagtcccagaacccaggagtcaggggacctgagataccaaccttccatcctgcacggcgcagtcttactttggtggattatcaagggccgattttgtcttcgatgcttgcatcctatgtggatatatgtgcatgtgtgtgaatatgtgtaatatgtgtaatatctaacatgtatatagtataaatttagtgatatttaataatagcttttaaaaatacctgtaagattttatcgtaaatacagcaaatttaccctttttaggcttaagttcaatgatttttactaaataatagagctttgagtaaaagagagatagtggtgtaaaagggatctttcactcccagactctcagtccccagcctctctccctatggaggtaaccgccattcccatggtgggcatcctgtaacagtcagtacacatacaggcatccttgtctaatatgcaaatacaagactacataataccattcttttttccccactcagtatgttttggagatcgtattgtagcaccacctcattgggggctgctcaactgtgtgtctatatcctttgccaatttttttctattggattgttggtctttttcttattgatttgtaagagctctttatatattaagcaaggtagtcctcagcttgtcaagagacagacttatgaaaccaatgacgcttaaatttcagagacctcccttgcataagctctcatgagaccccggagaggaccgagcaatgggttcacaaagttgactcaggtttattttaactgcaagcatttaaaatgattgtatctttccaccgaggttttccctggtgtgagtgatgtcagagaggctgtgggcatttttggggactaggctaagataaatctaagttacagttaccttgaatttgaatttagagggatgtgttttaactggtttgctgtcacttctgggtctgtattatcagcagccatcatggtaccacttcctgtcatgcttcccccactctctgtactgaattattcttcatgaccctgtgtgaccaaagcttttatcatcatataacatgtatggtatttggcaccacaaacatgagtagcgggtgagaaaggaggtttgaaatgggtggagaccaaagccagtctgtggctaattctttcagtcttcagatataaactgcaaatgggggatgtggctgtcaccaatgcacggtgagaagagaagttcttctgtccggaatattctcaataatgcagcaaacacaagtatgaaccatcttaaatttattttgtttcttaatggtattcaaataaaaaagacgtcagaattcctatgcttaaaggacacactctataatagtagcctaacagcaagcctatttttactacaactctacttgaaataaattcattaaaaaaaccatttttttaaaactttcgttttagtttcgagggtacaagtgaaggtttgttacatacataaacttgtgtcggggggtttgtcgtacagattatttcatcacccaggtattaagtccagtacccaatagtgatcttttctgctccttttcttctttttnccccccccctcaccttcaggtagacagtagtgtctgttgtttccttctttgtgttcataagttctcatcatttagctcccacttataagtgagagcatgcagtatttggttttctgttcccgtgttagcttgctaagaataatggtctccagcgacattcatgttcctgcaaaagacatgatctcattcttttttatgactgcatagtattccatggtgtatatgtaccacgttttctttatccagtctgtcattgatgggcatttaggttgattccttgtctttgctattgtgaatactgctgctatgaacattcacatgcatgtgtctttatggtagaatgatttacattcctctgggtatgtaaccagtaatgggaatgctaggtcgaatggtagttctgcttttagctctttgggaaatcgccatactgcgttccacaatggttgaactaatttacgctcccaccaacagtgtgtaagtgttcccttttctctcaatctcaccacaatctgttattttttgacttttaaataaaagccattctgacttgtgtgagatggtatctcattgtggtttttatttacatttctctaatgatcagtgatattgagattttttttcatgtgcttgttggccacatgtatgtcttcttttgaaaagtgtctgttcatatcctttgcccattttttaatggggttgttttttctcttgtaaatttgtttaagttccttatagaggctggatattagacctttgtcagatgcacagtttgcaaacattttctcccattctgtaggttgtctccttactctgttgatagtttcttttgttgtgtagaagctcttaagtttaattagatcccacttgtcaaattttgcctttgttgtgattgctttttgtatctttgtcatgaaatctttgccctttgcgcaggtcggtatcgccaaggttgtcctccagggtttttatggttttgggttttacatttaagtctttgatccatcccgagttgatttttgtatatggtgtaaggaaggggtccagcttcaatcttctgcatatggctagccagttctcctagcatcattgattgaatagggagtcttttcccccattgtttttgtcagctttgtcaaagatcagatggctataggtgtatggccttatttctgggctgtctattctgttccattggtctatgtacctgtttttataccaaaacagtactatgctgttttggttactgtagccatgtagtatagtttgaagtcaggtaacgagatgcctccagctttgttctttctgcttaggattgccttggctactcaggctcttttttttattccatataaattttaaaatagcttattctagttctgtgaagaatgtcattggtggtttgataggaattgcattgactctgtaaattgctttgggcagtatggtcattttaatgatattgattcttcctatccataagcatgggatgtttttccatttgtttgtatcttctctgatttacttgagtagtgttttgtaattttcattgtagagcactttgaccttcctggttagttgtattcctaggtattttgttcttttttgtggcaattgtgaatgggattgcctttctgatttggttcttggtttgactgttgttggtgtacaggaatgctagtgatttttgtacattgcttttgtatcctgaaactttgccgaagatttttattagctgaaggagcttttgggctgagactatggggtgttctagatatagaattatgttatctaggccaggtgtggtggctcatgcctgtaatcccagtactttgggaggccaaggcaggcagatcatgaggtcaggggatcaagaccagcctggcttacatggtgaaaccccatctcttctaaaaatacaaaaaattagccaggtgtggtggcacatgcctgtagtcccagatacttgggaggctgaggcaggagaatcacttgaactcgggaggtagaggtttcagtgagccgagatcgtgccactgcactccagcctgggtgacagagcgagactgtctcaaaaaaaaaaaaaggttatgtcatctgccatcagagatagtttgacttcctctcttcctatttggatgccctttatttctttctcttgcctgattgctttggctaggaattccagtactatgttggataggagtagtgagagagggtatccttgtgctggtttgtcttgtgctggttttcaaggggaatgcttccagattttgcccattcagtttgatgttggctgtgagcttgtcatagatggctcttattattttgaggtatgtttcttcaatacctagtttattgagagtttttaacatgaatgaatattgaattttattgaaagccttttctgtgtctattgagataatcacatggtttttgtctttagttctgtttatgtgatgaatcatatttagtgatttgtgtgtgttgaaacaaccttgcatcccagtgatgaagcctacttgatcatggtggattagctttttgatgtgctgctggatttggtttgcaagtattttgttgaggatttttgcattaatgttcatcaagggtattggcctgaagttttctttttttgtttctgtttctgtcaggttttggtatcgtgatgatgctgtcctcatagaatgagttggggaagagtccctcctgctcaattttttggaatagtttctgtaggaatagtagcagctcttctttgtacacctagtagaatttggctgtaaatccatcaggtcctgggctttttttggttggtaggctatttattactgatttaataaatcagagctcattattggtctgttcagggaatccatttcttcctggttgagtcttgggagggtgtatgtgtccaggaatttatctgtctcttctcagttttctagtttgtgcacatagagttgttcatagtagtttctgatggttatttttatttctgtggtatcagtggtaatataccctttgtcatttataattgtatttattggaccttctctcttcctttttattagtctagctattggcctatctaccttacttattttttcaaaaaaccaactcctggattagctgatgttttgatttgtgtatgtgtgtgtgtgtgtgtcttgatttccttcagttcagctctgatttttgttatttcttatcttctgctagctttggggttgatttgttcttgtttctctaactctttcagttgtgatgttaggttgttaatttgagatttttctaactttttgatgttatgaatacttttagtgctatgaatttccctcttaacactgcattagctgtgtccccaacattctggtatgtttatgtttgtttgcattagtttcaaaaataacttcttgatttctgccctaattttattatttacccaaaagtcattcaggagcacgtttttaaaatttccatgtaattgcatggttttgagcaatttttttagtcttgacttctatttttattgtgatgtggcttcagagtgtgtttggtgtgacttcagttcttttgaatttgttgaagattgttttatgtctagttatgtcattgatatatgccatgtggcaataagaataatgtatattctgttgttttggggtggagagttctgtagaggtctatcagatccatttggtccaatgttgagttcaggtccggaatatctttgttaattttctgccttgatggtctgtctaatactgtcagtagagtgttgaagtcttctactattattgtatggcagtctatgtctctttgtaggtctctaagaacttgctttatggatctgggtgctcctgtgttgggtgcatgtgttcttaggatagttaggtcttcttgttgaattaaacactttaccattatgtactgttgccttttttgatctttgttggtttgaagtaggtttttctgaaattaggattgcaaccattgcttttttttctgtttttaatttgcttggtagattttcctccatccctttattttgagcctatgggtgtcattatgtgtgagatgggtctcttgaagacagcataccatcgagtcttgcttttttatacaacttgccattctgtgccttttagatggggcatgtggcccatttacgttcaaggttagtattgatatgtgtggattcaatcctgtcattgtgttgttagctacttattatgctggcttgtgtgtggttgctttatagcaacactggtctgtgtgtttaagtgtgtttttgtatcagctggtagtggtctttcctttctatatttagtgcccttttcaaggtctctcataaggcaggtctggtggtaaattccctcaacatctgcttatctgaagaggatcttatttctcctttgcttaggaagcttagtttggttggatatgaaaatcttggttgaagatttttttttctttaagaatgttaaatataggcccccaatctcttgtggcttgtagggcttcagctgagaggtccactgttagcctgatggggttccctttgtgggtgacctgccctttctctctagctgcctaaaaaagacatttaagccttcaataataactttaaaaagccaattttgatcatcatgctagaggaaagagttttctttctgttctctcaaaagaaaacaaaattataaaatcattgtcatctggagaagtaatcaaagattacacaaatagtgttaaaaacaaatattatacaaatattataaggtgataggtagcccaattaccctgattttatttttatacttacatgaatgcatcaaattagcacatgtacccctaaattatgtacatttatcatatatcaataaaattgatattatagtagagtcttaggcagttaattacaataaatatatgctatttttctggattttgtgatatttgtgggatttgtcaacattttaacatctggaatttgttgtgatttattttcttattctcgataaatgatcatttgtgtattttgtattggtgttctttgtgttttatttttcttaactagggctctccacattatataaactccaggccccacaaaattggacccacaactgaatctgaaatatgtgttgcaaatatgttatctcagttgtagcaaatcttttggttttatttgtggcattttcccactgtgcagaagtttacatttccacgtaatcagatttaatcagcatttccttttattgttcctgagttttcttagaaagtccttcttcatttgacaataatgaaaaaaattcataagttttctagaatgtctaatttttcttttatatgtttgaatacttgatttatctggaattaacttatgtgtaagaactttttcccttaattatcctgtattctgacaattatttattgagtattctatattttcttattgattagaaatactattttatcatatattaaattctcatatgtaattggatttgtttatggaccacccagtttgttctatgggtctgtctgttcatgtaccatgacaaaacaattttatttatatatttataatatattttaatgtctggtaaaactagttttctttcattactttttcttgccttcaataaaatgtctgggttatacttttgtgcttatatttccatactaagtttagaatcagcttccagaggtctggaaaaaaatctcggctttatgttgattgtaatcatattaaatgttaaggttgatttcaggagaattttataaaatttaaggaccctctccaagtgtggggttggcttttctttttgctccatttttcttttattttttcctcagttttcttcatatatatcttacacatttctaggcatgcctttctttttgtatgctattataaatggaatttttttccccttccattatacttcctaactgattattgcttttatataggaaacctattgacttttgtatattatttttgttcctccaaaataatatgcaataatatacaaatatatatttgctgggaacctaaaataatacactattctattcaattatggaatatatctagagctctccttttttttttttttttttgagacagggtcttgctctgtcacccaggctggagtgcagtggtgtgatcatggctcactgcgaccttcacctcctgggctcaggtgatcctcccacctcagcccccgagtagctgggactacagacatgaggcatcacacctggctaattttttgtatttttcatagagacaggcttttaccatgttgcccaggctggtctcaaattccagagctcaagtggtcctcccgtctcagcctcccaaagtgttgggattacaggtataagccaccacgccagacctattctatcctctcctattcaattcttatttgtaacagtttttctgtgattggttcatctgggtttccaggtagatcatcatgtcatctccaatactgcctagtttttagacctttctgactaccctactacttgtaaacagggcaggtttttccgagagatgttcctagctgagtgctgcacttatggtgaacacccagcttcaaaggctacttgaaaggatttagggggctgcacttacccaccggccttggaattggcctcatagaaaacttgctgtgctttgtggaagctcgggcccgcagaggtgctgatggtcagtgtcagcacagacctattattagctgtccagcgacaggagattccactttaatgctgaagcttcagaactacgttgcaaacaaaatgactggcattttctcagacagcagttccaagtggaaactgtctagttgtgctgtctccatacggagggctggaaaactgtgaatggcaattatgcagctttgcatctcacacttcctgacatctggcaaacactcgttccatccaggaccagataaaacaaatggtgccttattcacaggagtctttaacggcctaatagacccgatgagtagcaatgcctttgtgtggcctgtgtgcagtccagagctagcaggttgcctatgacaagcgctggagggggtcagcacttttgattccatcaccgaaactggtccccaccacagcagctcatttttcagaactggctagctccttcctgctgggttgaatacatcctcattcttcacaggcccagaatggcttcatctggattgttagttacctatgaaagtctctggtttgttacatttttttcagtattttatgcacaaaatttacctaatttttgtgaagttagaacatgacaccaagaaatggaatcctgtattatttttcttttctttcctttttttcttttctctttttttttttttttgaggcagagtctcactctgtcccccaggctggggtgcagtggagcaatcatagctcattgcagccttgacccccctgggctcaagccatcctcccacctcagcctcctgagtagctgggaccacagccgtgcactaccatgcccagctaagttttgtattttttgtagagatggggtctcactacgttgtccaggctggtcttgaactacgaggctcaagtgatcctcccactctggcctcccaaagtgctaggattacaggcatgagccactgtgcctggccctgcattctttctatgatttgaccatgtgtctcttggcagctacagtcaactctttggtctcaagttgtccagctgaaaaagtgggctcctcacgccgagacccatgacatgcagccccacacacatgggatactgcagacgacagtgcagccatgacagagactcagtggggctggtgcagacagcaatggccctgtatggggagaacccagcatctttgaatggaaacattttttgcagcttatttgttttcgaaccttggctttttggcctaaatgttccatggcattccttaacaattaatttcctctctgctgagaaaacaaaggtggagagtcattttcatgccactgaatgaccttttaaaagattgaatcctttctaagggggaatagctttatttccttctgtcaaatatttcatttgtcccctagaagagccccgtgaagtagacattatgtgataagcagacacgatcgttttacagatgtgggaaaagactgacctgctccaggccacacagatggagtcaggaaggggcagactgggtcagtggggcccaattcacaggcactttctacggtcttttcatatgtttttatggaggtaaagttcacatcacataaaattaaccattttaaagtaaacaattcagcggcatttaatacattcacagtcttgtgcaactgccacctctctcttgttccaatgtgttctcaccaccccaaaaggaaaccccactccagtaaggagtcactcctcatctcctctcctcctagccctcagcaaccaccagtctcctttctgtctctatgaattcgcctattttggatatttcataaaaatgggctcatacgatagatgggctttgtgtctggcttctttccccagcatggtgctctcaaggtccatccatgtggtagcaggaatcacatactccattcctttttcctggctgaataatattgcattgtatggatatgccacattttgtttccccattcatccattgatgggcacttgtgtcatttctaccctttggctgttgagagcagcgcagctgtgaacatgtgtgtacgagtatctggtaaccagtcccttccacgattttctgcagtcttgtagtttctgtgacctgataactctgctgcagggtgaaaaggaatcatctgtggtttgccacctactcctggatacagcacgtatctctttgttccatgcacagaggctggggccactctacacggggcttgaaagaagcctccagtcttgcagccaaattcagaggcatataattcagaagcctatccgggaggccaaaatgagtcctgactgggaaaactcgctggacccgtctgccacagtgttgaaaaagttgtcttgggaagaggtttcctctggctgtctaggtttgagacctttgcgattcctttaagatcacaagcaaaaccacggtgatggtaggatgtgttggttttactaaggagcccattttttaaaaaacttgtaaagtgagccttaattggagaagcaacagaaagcacctcgggacaagtccttcctttttgtacaaaggacccgtggtgagcccttccttggaattctcgtgtcctacactcgagtcttgtccctgcacagggccatcattagtaggagccctcagagcctcaattagggtatgtggagcccaaaataccaaaggggctttcctccgcatgagctatcttattcagcacctttcagtaacaagccatgggatttttaccccagggaaggaagcaagtgtgtgaagtccgtgcgtgtttcccagggttttttccctcctgcaccacccggttgctaggtagcgggtatatctgtgccaccacctgaagttctgtgggaagggggaatctgcggggccactggaggcttggggtggggaggggagccggacaggagagcaaagacccaggcagcttgggtcgctcctcttcatcacttaattctgagggcgcttgagtttctgagcttcctggagtagagcccagggcagcttttactttgatgtgctgatcggttgcctgtcggttgcaggagacccccggcctcctgcagggaagatcctgtgctgttttcccagggatggagagaaaagcaccaaccccaagccccgcatggctgagagctgtttgcctccatctctgtccgagcttttcaccacagctctgtgaaagaaactggcagtgaggggtatagccatcttggtgtgtgtatgcgcacgtgtgtgtgcatgtgtatttgtgtgtgtgtgtgtgtgcgttcaaacactgacgtttcagaggctctggttactgctgcatggcggatgatcctctctctctccctctctctccctccctctctccctctcgacctgcttgcctgcctgcagaaaactaatgaatcatgtctagctgaatgcaagcagtgcagacacaccaatgccctgcaatgttgactgggcgccgcctctgcctgcctctcgctccctgtctctccctctgctgctccctccctccctctctccctctccccctcctccctccctccttctctccctctccccctcctccctccctccgtctcgcccccagtttgtaatctgacacagtacactgcagttgtctccgaggtgaacctccggagccttggcacagctcgcttctaaaggtaggctgagatttatttttttctcctaaaaatagcttcccgtctcccctcgcctttctgcacccgagctgcagcggcgttgatcacagggggttagccggaaactctttgcccagacaaagtttatcttgcagcggatggagaatgcccttcagcgtggggtccgggggcgctgggtgcggggagcagcggctcgccctgctggcatgtcggtgctgcttggaattcaggatcgtctcggaagggaagggctgacgggcttcttcctgggtgccgggtgtcagctgcaggggtgctgtggctctgtcatggcccccaccccaggcttttaagaaaggcccctccaggcaaagtttggcacccgatggacacggccccgctcgcctggggagtgcgccccaggcttctcagacagcagcggctcagggcctggacttgtcttcttgggggcggggtggagggggggaaggggacgtgggacaaacacatcagagtccccagctcggctcaggtgcaaatgcacaaagcccgcaggctgcgcccaggaatctgtcaattcacgtcccatggactgacttgaataatgtgtttgtcaaaacagatgttccccggcagagtgtgtgcgtgcatgcgtgtgcctgtgtgagcagtgtgcgcgggctgctggccgggggcagactctcccagtggaaaccgtatttcaccgggaaaggcagcgcgtacgggaccacccgcccaggagcttaggtctgggtaggtccaggtgggggcccggacatctgtcagcagaggcctcggtggaagcagcctccctcctgtccccggggagcgcacgctggctgaggtcggggtggcggctggccggagggagggaggactgcttcacctcccggcctggtcactggccccgggggaggcgggggtgctggctccgtgcctgcgtggcctctgggtccctggaggttcttagggtgagtgaggagggagggaaggggaccctgtccagccccatatttctctcacggaggagccctgaaggagactctgctcacaagggtgaaaaccccacttcgtccagggaagggaaatgtcacagatggagcaggcctgagaggagggagagcggctccctctgaaaatggaagatcggtgggaagaggaggtgtccgggctctgggccctgcggcaggccaggctgctgggctctgagcaggagtgggcaggggaggggagctggcgtgcaggctcactcacccggtttctaaggggaacagtgggggaaggctctaaaaaatcaccacctcccccacgcacatggcccctccctggctccctcccagccttgctgggctgtccgggaatcagcttcagactcatcccccgctgggctgtggggtcttggcttgtcctgtgagacatgatcccaagctcccagtgggatgggcagggtctgaccggctccggaggttccctgggggcacggtgtgaggggaaggccggcgggcaccccttctgcagtggggggtggtggggcgtgcctggggtcgagggctgtgccgtggccatatggcagccgcctggggcccagagtggagcccttccaggttatttcagggaaggcgctggcagcggctattcccccgtgccccttcctagaggatggcaaactgggtcagggagagggtggcactgcccacgtgcccgggagacaggaagatgctggcgctatgggggccgccccccacgcaggaggcaggcgccacgcagccctccccggggcatagcagccggcctcccccatgctgcaagcccggcagagaaccccaagcctgcagagtccgggggtgggcgtgggtggtggagaagcctcccaggtgaggccagcgtgcagccgggctgagagctcctggccatgaagatgaaaagacaagcggtgggccctacactgtagctttcagtttcatctctttggccccatgcactgttggcgcctggaagagaccagcatgtgctcagggggcgggaggagaggcaggagctggctctttcctgagcttgcttcgctttccatttcaaatccaccccctgccacgtttgtatttttggagtctggttgaagttttaattggagcagcgattctcacacgttggtgagcgctggcatcctggcgggtgggttaaggggctacaaatctcagaacctctgatccagcaggtctggggaggagccgggaatccgcattcccacgcagtcccaggggaggtggaggcatccagggaccccactttgaggatccttgaatacagcgtgaccaggaggcgctttacgcatctctggggcatgttgccagctctctgttggcctttggctgaggtcatacatgaagctgagtgcacgcctcataggttggtctagacccgcaagtgccaaacctcagggaccagagggcctgacccgggagcttcctttgtgtccgggagtctccctagggcacggcaatgagcatctgttccaggtgggcggagacttgccggctgaacgtctcagtgtttcccacttctgccccaaggtttggaatccgcgtggtgctgggaacccgggggagaaccggatcggctgtgctggtctcttgttgatcaagcagagctgctgattccagaaaactctgttctccacttacctcatcccgtgtagatagtggtagtgcatggcttatgtcctcagtttctcttttgactttcacccatttgaaaagctgtctgatcccctatggtgtgggaggaggcttgcaaccagctgaggacacctgcatctcttgttggtgatgctggtgccaccacccttgtgtgcaaagggcaaccagctgaggacacctgcatctcttgttggtgatgctggtgccaccacccttgtgtgcaaaggtttcactgaaccatactcctcagtccttccttccttccttccttccttccttccttccttccttccttccttccttccttccttcctatcttccttccttccttccttctttccttccttccttcttctctcactcttttattccgtttctttcagtctctgtccccttcttccctctctttctctccttttctctccctctttgttttttctttccttttctctcagtctccctccctccctcattcctcctctccctctctcagtctctctctctgactcacccctgcttgtgtccaccactgggccacgctcctgtgtggatccatctttccttgaagaaaatctcccagatgacgccctgcataagaaggacatttccatcagtgaagaccatgcgtactgcggtggctgtgcgattagaacagacctgaaagatccccatcccagtgtggctgtcgtagctgctcagcttgaagctttagtctcacgtgtttagtgacgatggtgtgggtgaacccactgtgctgcctggagtgtgaacgtccagcacatacagtcatgcatggacatgatgctcgatgataataaatgactatgttactggcttatggatttactgtaacttttatcatgattttagagtgtattgtttctacttattaaacaaaagtgagctgtggaacagcctccggcaggtccttcaggagggatccgacagcaggcatggccatcgtgggaggcgacggcacaccttgtgttattcccctggagacctcccagcgggacaggacgtgcaggtggaaggcggtgatgtgatgatgctggccccggggaggcctaggtgaacgtgtgtgtttatgtcttagcttttaacagcaaagtttaaaaagcaaacaaacaaaaaaatcaaatagggaaaagcaaatagatgaggatataaagaaagaaattatttttgtacagctgtacaatgtgtgttttaagctaagtattattacaaaagagtccaaaaggtaaaaaattaagaaatgtataaggcaacgaagtaagctgagggcagttatggaagaaagaagaatatttttgtataaatttagcgtagtctaaacgtgcagcctctgtagggtctacagacacgtacaggaatgcctgggccctcacgtccactcctcactcactcactcacccacccagagtcacttccagtcccgcaagctccattcatgctaagcgccctatacaggtgcaccatgctttatcttttagatcttacttccgctgcctctcttctatgattagatgcagaagtactcaccattgtgtggcagtggcctacagtactcagtacagtcacgggctgcacagctgtgaaaccggaagcaatgggcttgcccatcgagccagggcgtggaggaggctgtgcggcccgggcgtgtgtgcagtgtacctgtgtgtgaggtgcgctcagtgacgaaatcacctaatgaggcatttctccgaacgcatccttgttaagcaaggcgtgactgcatttatctttgaacaagccagtcacactgtactagggtttgtggggttagaagtattcatttatgaggtgggtccctgaaaagtaacatttaatctaaatctattttaacttttttgtggttattttcatatgtgtgagaagcaaatgcatctgtaatgagaaaccttcacacaatataaactttaagtccaaatgacgtcctaagtaaatcactccaaatagcatcttcaaaaaatggagaaaaaagacaaagcacactcattttaaaagcccagaataatcttgatacaaaaccccagtgaggccatcagaaggaagaacatgtgctggccaaactctcatggtcacagacaccacattctaagtcaagtattagtaaattagaaaatggaatccagcaaaacgtgaaaagggtaatagacatttcttaatttttccctggacaaggaacctcagaaaatggaggaaattggggcttctctggatttgtgagaggctggatagcttctttttttttcttttgagacagagtcttgctctgtcacccaggctggaatgcagtgtcatgatctcagctcactgcagcctccgcctcctgggctcaagcgattctcctgcctcagcctcctgagtagctaggattacaggcgtgggctaccacgcccggctaagttttgtatttttaatagagatgggattacgccatgttgaccaggctggtcttgaactcctgacctcaggcgatttgcccaccttggcctcccaaaatgctaggattacaggcatgagccactgtgcctggtcagatagcctcttcttaatgctcacctacacgagaaagggaggtggctgtcagggctccatgggaccccacgtgtgacgtgcggggcctgtgaggattgggagcagtggggcttgtggaggagcaggtagagcagggagaggcctgaagacgtccatttgggatattctcatttgttggtgttttgtggtctgtcattagtaggtgctggataagcacttgctggagagacccagtgtgggagatgaggggggctctctccttggcctagctgtgtggacaggtccttcctgttggtgctgagcctggggcgggggaggtgcagcacctgccacttctctatctgtgtgggacccaggaaggcagggcatgacctattcattcagcaaacctttaagcacctgctaaatactgactcacattttaggtgagcagtgaacaagctagaggagggtgctgccctcatggggagcacacatgtgtgtgtgtacgtgtgtgtgtgtatgtgtgtgtgtgcgcctgcgtgtatgtgtgtgtgtgcatgtgtaagacaacgggcaagtgaatgaataatcactacaccagagacagctgccctgatggagtgcccagcagagggttccaatggctgatgtcaggggccgcacctggatgatctgggagggtctcagggaggaggtggcgttgaagctgagacaggaccctgagaaggagccagaggtgcagacacctgggagagaggttcaggccccgagggcagagggaggaatggatctgcgagctgctcggtggctttgattctcataggtatgtgcagaaattgctccttgggtgtttttggagcagctgggaccacaggggctgcagagccaacccctctcctggagaccctcggtgtccacccgtgagctcccagggatacccggaaaccagggggccagtggtgtactttttgtcatttccatccatggggagttggtcatggtgtccctttgggtggaaggtcctccttgcccctcctatgcctcttaccgcgctccttcccctgcctccctcctgcccagtgctaccaaaaagaaagcccatttggccattttggcagcaggggcctcctgagggggcctgggggtgcgttggtacaggttcctctgattaaacgctcctggtgccacacccagtgtgtgtccgcgatgggaatgtcaggaacgggccgctgggttgggtgggaagggggggggtttcctcaaggcattcttcatgcttattaccgacgtggtttccaagagcaggaacacaccccatcacgctgcccctgtacctccttggacggagatattgggacgggggcaacaggcagctttgtttccgactcttccttccctctccctgagaggggagccccaaaatcttgggaaacgtgccttgactcagctccaggtctgtaaagcgctccatgttcaagggccaagggctcgagctgcgtgttgactccttagcctggagctgccccgcaggctgcgggtgccagagctctgctgtcgggcgtcacgcccagagacctgccccagccccagctgtggtgtgggttctgcgtcttcagcctgtggctgagtccccagtgcccagcgagtggctgagacctggctggggctcaataattgtctctgtgggaagggtggatgcagcgaatggcagttggggccccgggagggccatgcctctgtccagacagttccccagcttccttcctgcttgtccccaagcccaccagccctggtgactgcctcctgcatcgtggcttctggatcgtgagaattaaagatgggaagttgtgtaaacagcttttccagctcaaatgcagcaatgcatcggactgctgttgccggcacgttgctgggtgccttcctcggttacatgcatgacacagcccttctgcggcaggccctgttgctcatgtagacccattttacagatgagacaatagtctttgagagatggaggggctctctgaagatcacacagctggggagagatgggcccagtttcaaacccgggctgcctgaccgcgaagctgggttgggactacagcgctgcaggacctgtgagatcccagagaagctggggcggagccggttctgggtcagatgcagtcccagggagctctgaaacacgcctgtgtccagggcccacgcgagcctcttagagaaggtgcagtgagctggggcgcaggtataacagtattttcaaagcagctttatttcactaatttggtttttttgagacagggtctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctagcatcagagttgaaagctgaaatgcagaggaagtatctatctgaccttcgataagtcgaaatcatcccagagcaacgttagcaatactccctctcttctaaataatatttagagttcagcaacgttcgtgatccatctcatgttcaacgatcatcaactccgagtccattgaaaaagcctaagagatactggccaggtcaacgtcatgtatagctacatcttcaccagcatgctaaactcggtgcatacattaaatccttcagacacacgagcatggtttgctgagggaaatgcgctgttagcatggaccaagcgcaggaaggggcagcataagcatcagagacatatgacacagtagcaagtggataggatgtcacagactatgcacgggcttaccaaaaggattcaagattccacccgactagcaagagagacgatatgatcattaaggataatacatctctgactcaatcatatgtgcctaatttatatgcatacgatgatggacgacaagcagcaacagagactctccctggtcatctctggaggaccccagggaactgacctatgaaaattataccagagagagagagagtccaacgctgatcctctctgtcctccatgatctgtgacccagaatgtgctttggctcccttggttggagaagccaggtcattcgtcctacagaacctgccacactgcacattttgctgatttcaccctgcaacacattcagtaagctctgctgtcctctgtatttactgtgggctcatagttaaattctccaaactacccaattcaagagttgaaggggaaaggtttctttttaactattccagcaactaaacaaagaaggaagaataaaatcaggatattcatgcttgtaatcccagcactttgggaggctgagactggcggatcatttgaggtcaggagtttgagaccagcctggctaacatggcgaaaacccatctctacaaaaaatacaaaaattagccaggtgtggtagcaggcacctgtaatcccagctacacaggaggctgaagcaggagaatcacttgaacccgggaggcagaggttgcagtgagctgagatcgcaccactgcactccaacctgggcgacagagcaagactctgtcttgggggaaaaaaaatactcagccgggcgcggtggctcatgcctataatcccagcgctttgggaggccgaggcaggcagatcacgaggtcaagagaccgagaccatcctgaccaacatggtacatcgtgaaaccccgcctctactaaaaattcaaaaattaggtgggtatggtggcgtgcgcctgtagtcccagctactcaggaggctgaagcaggagaatgccagaactcgggaggtggagattgcagtgagccaagatcatgccagtgcactccagcctggcaacagagagagattctgtctcaaaaaaaccaaaaaaaaactctgcaaaaagtgtcaaggtcatgaaagataaagaaaggctgaaggacttgtagatggaaatagactaaggaggctgacaagcaaacgttccatgcaatcccggactggatcctaaaccaggcaaatggtgttagtgagacatctgacagttaagggtcgagattagataatcaaattagagcaatgttaactgcctgattttgataagtgtacagtggttatgtaacagaatgtccttggttttaagaactgcacatcaaagggcatcctgtttgccacttacctcaaacatttcagagaaaaaaagtcatatatatacacacacacctaattacgtctttataaaatcacatataggtatataggtgagatcagctggggcaacatagtgagaccccattgctacaataaaataaataaaaaattagctgggcctggtggcacatgcctgtagtcccagctactaagcaggctgaggtgggaggatcacttgagcccaggagttccaggctgcagtaagccactatgctccagcctgtgtgacagagaccctgtctcccacccccacactagagactaaggaggcctgagaaacaagttaaaagcgtaacatgcaatcctcgactggattcttgtaggggaaaaaacgccaaaaggtataaacactgatgttctcatcacccagaattatacaaatggttaatatattgtcaccttgctttgattaccatttttaaaattaattttctttcttgttttttttttagagacatgggtttcaccatgttgcccaggctggtcctaaactcctgagctcaagtgatccatctgccttggcctcccaaagtgctcggattacaggcgtgagtcactgcacccagcctgattagatggagttttgctctgtcgcccacgctggagtgcagtggtgcgatctctgctcactgtaagctccacctcccgggttcacgccattctcctgcctcagcctcccgagtagctgggactacaggcacccgccaccacgcccagctaattttttgtatttttagtagagacggggtttcaccggtttagccaggatggtctcgatctcctgacctcgtgatctgcccgccttggcctcccaaagtgctgggattacaggcgtgagccaccgtgcccggccctgattaccattttttaaaaaagaaatggaacattgcaggtaaggttaaactcttctatgacctctctccgcagttcctgggtgacaagagcgagaatctgtctcaaaaaaaaaaaaaaaaaaaaaagaagaagaaaaaaaattgtcatccttgcgcaggggccatgctaatcttctccgtatcattccaattttggtatacgtgctgccaaagtgaccactcgattacctattccaatataatgaaaccctgtttctactaaaaataaaaataagataaaaataaaaaaaatagctgggtgttgtggcgcatgcctgtaatcccagctactcaggaggctgaggcaggagaatcacttgaacctgggaggcggaagttgcaatgagccgagatcgcaccactgcactccagcctgagcgagagtgaggctgtctcaaaaaaaaaaaaaaaaggaaatagaacattgcaggtaaagttaaagtcttctttgactcctcttctcagttccatcacactcctttctaccctttcttgaagcaataaccatcaggatatggtatatagatccttgcagtcaattaaaaaaaacaacaaaatacatatatccaatagccaatatgcttttgttttatgtgtatttgtaaaaaatatacataaatgacattatactatatatataatccctctagataaagttacatatagtgttaggttttatgtattaatttttgaaaacagggtcttgctctgtctcccaggctggagtgcaatggtgagatcattgcccattgcagcctgtaactcctgggtttaagggatcctcctacctcggactcccaaagtgctgggattacaggtggcctagactttataaagctgttatcacctctttcttcttttctcaacactatccttttgacatctatctaaccctgttgaaacagatgaccgtcattccttttaaatgttatacagtattaaatgttgtgcacatgcgtgaggcatgagtttaactctggggcctctccctagaaatggaaatccggggtcacaagcaatgggcattcccgttttactgttagattctgctctcccgccagcagcgtctgagaggtgcttggggttcccctgagggttctgggggagctcggacttgcgttcccagcaggccggttgtcgcctgctttgtgcctaatttgcgtcactggggttcctagcggactcgcctgcaagtgtgctcaggactgcagggaggactcttcggtcactgcggctctctccccatggtggactcttctgaggcgcttgactgcgctgatttgggcctttatctgtctgcatgtcggcaggggcgcccaggaagtcgggtccctctagctcaagcttgtttgggctcttacagcttcaggccaacagggggctgggaagctgagcacttactcattccgtccccgttggtaactagggctggtagacgcgtccagactgcaaacagtatttcatcattttgtctgtagcatgcagcggccaaagctgccaacctatgaaacgctttgagaagccggacgctttgggaggccgaggcgggtggatcccctgaggccagcctgggagacatagttagattctgtctctcaaaaaaatttttaaaaaattacccctgatgtggtgcgcgcctgtagtcccagctactcgggaggctgaggcgggaggatcgcccgagcctgagagttcgagaccagcctgggcaacgtagcgagactccgtctcttaaaaaaaataagtagccgtttttctgggtgggtgcatccctctctggttcctcgctctccaactggccctggtcctgggggcgtgaaggctacgatctggagagacagaacagcgggctgcctctggaggacgggcctagaccccattcattcattcattcgttctgtcacccacccgtcctgcgcgcacgcgagccaccctaagccccaggacctcaagaacccccaccccacggggcacagacaaggacaggctggccagcgcctggaagccgcgtgcctgaccacgtctgcccgagcgagtaccgcctcccacccgggaggcaggagagccgcgaccgtcgggccgcgcccaacgtctcccgctcaggggcgcgccgcctcgctttcagcgcatgcgcgcccgggagcccgcccggggcgtcggcgcacgcggtccccaccggccggcttgcgtacgcgctcccggctcgccctcccacgcggtccaccgcgcctcccgccccaccctaagcgcagcgaccgcccgagcggccgaccgaaccgcgttgcgtgcgtgcgcgcacgcgcgggccacgtgggcgggcgccgcgccgttgccccgccccttgcaaccccgccccgcgccggccccgcccctgctctcgcgccggcgtcggctgcgtctccggcgtttgaattgcgcttccgccatctttccagcctcagtcggacgggcgcggagacgcttctggaaggtatcgcgacccggcgggcccggcacggccgggcggggacaggggtggcggcggcgggataggggtcggagccggggccagggccggggcgggtggcggacccaggggcagcgggcggctgagtaggtgggtggtgcgggcccggccgggccggggcaggagacgggcgtggggtcggcgctagcccccgcgaacccccgtttcatcctccgctctcatccccgtcccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtccagttcaaagtaggtaaccctgcggggcgggaggcggccgagcccgaccgcgtgcgactcgcgggtccctcctcctggggccacgatggctgtaatggggccccgcatccacattctttgttttaagtgagcctgtggtggttaaagttccgtgactctgggatcttgagaggtgaagtgtttagggtttacttccaaaatgtgtttttcaacagcttgtattggttggtgatggtggtactggaaaaacgaccttcgtgaaacgtcatttgactggtgaatttgagaagaagtatgtaggtatgtgctggaaaaccttgcttgtggaaatatgtgagaaatgggtaagttcatccactcaatcgcatcgtttccgtttcagccaccttgggtgttgaggttcatcccctagtgttccacaccaacagaggacctattaagttcaatgtatgggacacagccggccaggagaaattcggtggactgagagatggctattatatccaaggtaggcatttgtaacttgctgaacggtttttgagaggttttgtgtacttcagtcttcaaggttatagaaaatcaggtctgttccaacaaatagtgtcatttttgggttaaaaaaagacaagtggacttcggggagttgaccaccattttggtggcagagaaaattttattaaagttgtgtcatttgcatgctgtgtcatgctaggcatgctttagaaaaaactatgacttacactgggacttataagtcatatttaaaacaataataggctgttaacagcagtttcagtatttggaaacttaggttcatgtatgtattttggtgtggtgatcaatgaatgtttttactgtattagaaaacaataaacaccagatactagaccagaggagataggagatcttaacaagtgttatacaagactagctgatttcttgttaaattgtttgtactaagttgtgcagagtatttttctcaaatagtttgatttaaaaattgcaaggaaaatgttcattgtaccaaaaagaggaatcaagaaaatactcatctctcttggaacctcacgttgccgataacacattatctggaatcattccatgccttttgctttccttgagcatgtacaaataaacacaagaatttcccccaaaagaatcctttaaccaaaaagttgtggtttcttgccttgctaactgtaccatagttattcctgcaggtgaatatataggctttatctgggttatttatttatttaatttttttttgagacagggtttcgctctgttgcccaacctggagtgcagcttccgcctcctaagctcaagccatcctcttacctcagcatcctgagtagcttggactataggcacgtgccactatgcctgactaatttttgtatttttttgtagagatggggattcaccatgttgcccatgctggtctggaactcatgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatctcatttagcattaattacttcagatacttttttgggatgaggggagtattaatggtgaagtatatcagggagatttgatagggtcagctcatctctcttaggaggaattgtgtattaacatttttagaattgacagagaccttgaaagtgaggggagagatacaggtgactcgttgaggtctaagactataactagttgaatcctagtctctggttcttagcattcttcacttgtgcagtaaactgagtgtactaattcccacaaatgtttcttcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcaggtgtgtaaaattaaaacttcctgagttatttctcttagcggagattatatgtaagaccatgaaattaaccagtgtctattatatatggaaatgatttttttttccccaagacggagtcttcctctgtcccccatgctggagtgcagtgtcgcaatcttggctcactgcgacctccgcctcccgggttcaagcagttttgtctcagctcccctagtagctggattacaggtgtgtaccaccacgcctggctaatttttgtacttttttttctagtagagacggggtttccaccatgttggtcaggctgatctccaactcctgacctcaagtgatccacttgccttggcctcctaaagggctgggattacaggcatgagccactgtgcccggccggaaataattttgtcttttttatactactgtttttaaagaatgatagagattgggtttcactgttggcccggttggtcagctgaaatgtttgtgtatttatatatttgttgttcgagacagggtcttgctctgttgcccaggcaggagtgcagtggcatgaacatagctcactgtagccctgaactcctgggctcaagcaatcctcccacctcagccttctgagtagctgggctcacaggcactcaccaccatgcccacctaatttgtttttttgtggagttggggtcttgctctgttgcccaggcctgatcgtgtactattggcctcaggcaatcccacctcagcccccgaaagtgctgggattacaggcatgagccaccatgccttgccaagaatcttaacattttcttatcttgcaatgtcctagaaaaatcgtcatcttaataatgaattttaaaaagtaattttacctttcttttaaacagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctggattttttgaatcatctctagtatttgctttaggaaatgctgaagagttagcagagattattatcttttgggggggcggcggggaaggggtcagttctctccagattgtacaaatgggaaaagtctgctctccattttttgaaatctcgtgtctaatgggggaagccttgaaagctttatatgaagttactgcaaaccagtaatagcttattagagcaaagtcattaagaaaaagcatagttagtgcataggtcttgtgtggatataatgtgaaactggtaaattagtagtttcaatttgtgtgagagccagtttttttaaaaaaccacatagaatgggattttttaaaaaattgtatcaatcataaaatgtctagaaaagatgagactccaaaatagcctccaaagaggactggtttcctggctaactgttcacctgaaggaactcaagtacagagaatttctggtttcttttgcaaaaacagatcagaaacacaaaaaattacctgctgagcaaatgggatgagggttggattcagcttttcttgccagcaaactgacggacatcgtgtatgatgttttctgccactcgggctgtacagggctatcctgcccagcaagattacgtgagactaagctttccctgtatgaggcagaccctgtactaggacagcacctatcctaactccttgcagcaccttttacccttgaagccgagggcatggtggggagaaacggcacctaaccatggaaaccttatctttagttaaggggtcagagtcctattcaaaaaacatctgatgcatctcgcctgctccacatttcctacaaggtcttgcaggctctggtcacacgtgcatcttgagatctgtgtgcatgctgctttccagaactcccccttccctctcctgaagtcggtcctaccagttaatgctttagttcctttagagttcactctgctttttaccttgagttggatgtccgactacagacattacaagattgccttcagccctagtcagcatggcaaatttgcgatagcgactttcccttcctagactaattgccacgagggcgagggccatgtcgctgctctctcatgtccctagtgtttattaaatgttctatgggaacctcgaggaacagagaacttgggggttagagatagggtgggattgatggaggtgggtggagaggagccgggagaactttatacaccattaggtctgactattctgaagtcatgctggtattttcttcctgaggtttgtagcctacactatctttttaattttatttatttatttatttaatttatttatttattttttagagtctcgctctgtctcccaggctggagtgcagtggcgccgtctcggctcactgcaacctctgcctcccgggttcaagcggttctcatgcctcagcctcctgggtagctgggacaggcatgcgcatacactgtcttttatccatttattctggcttgtttctttggtgcacaggagtagagagagccagtgtggacagtcgggaagcttgcgggatggacctcagttaaaatggtgccatcagcaggtgttggggctgtgatgcttgaagtttagttacaggcgttggaagaggcaccttggatttagttgggtttcagttcccctccttgaagaagcaaaacagaaaccattccgtatacctcagtcttcggtaatgtggacagttgagtccttctgtcaagtcagctgtgctcagagatacaccgtgcgatgctgcagtggctttgctcatgaagccttcgcctggggagacaggcagtcaggttcctgggatgaggctgagcgccacagtgagtgtgaggacggacagctgaggctttgggagcatcgcaggggcctggtctgaggcctgagaaggagggcagtggagtccaggaaagaccctcagggggaagcgcccctggagagcaggagggacggtggagtgcgcaggtggaggctctcaagcaggtgtgtgggttttttataagccgctttacaggtttggtatttagaacacagtgggaagccacagaaggctcaagcgtcataagattttggcaacaggagtgggtgcccagagtccaggggcacccagcctttcccccccaaagcctgtgctccaggaaagggagggtcgcaccgtggccaccacaaagcctcgtcgtccaacccctcagcggactcatcccttgagtgagtagccactgcgaatgccaggtgccagccccacccacgcagtgggcttcttaatgaggcaggagaaaaggattcggggcttctccagtagttagtaagtgtgaggtgtgagctgcagtgcctaaagccaccaatacccgcggtcaaggtcagtttccggtgacaaaactatgggtcaggcaggtggtcgagtggctgtgacaaggtggtagcactgtgaccaccccccaggcatgaaggatgggaaccaaattgcagggaatggcagctggaagccggcgggcaggggagccgggtggggcagagctgcaggtcttggggagaagcatttgctttttgcttcctccctcccctcatgtctgacctccttttcccctaccaagggaagaagtcatacatgctgggtattgacagtgtggggattggagcagttaaaacagacacagtcggcacagttcccccgactagaggtaacttgctgacattttgtcatctatcctttcaaatgttttctaaaaagaggggattatactatcgtgcagtttcctaaccatttttcactttgtgtgacggccttttctgtcagtgagttttacagccctgttcataattatctagtgatgcggagcgcagccaggtcgtcatttagtgtgacagcctctgtggttcctgtcggattgtgttgctgtgtagtcccactcctctgcatgccgcttggcagagtgggtttaactcttgcagggaagttgatttccagctgtgtagaccatccgtggtctctttcttccacgtgcttctcaggctgttgtgtttgttactttctttttctcttttgagtcagagtcacactctgtcacccaggctggagtgcagtggtgggatctcggctcactgcagcctcaacctcccagcctcaagccatcctcccacctcagcctctggagtagctgggactacaggtgtgtgccaccacacccagctaattttaaattttttttgtagagacagggtttcaccacgttgcccatgctggtcttgaactcctgggctcaagcaatcctcccacctcagtctcccaaagtgctgggattacagacgtgagccactgtgctggccacatgtttgttactttaaacttatgagggtgtgtcctgctttataaactccgaatagatggaaaaccaaacttacttttaaaataaactctctgggtgtgtgtgtgtgtgtgtgtctgtgtgtgtgtctttgtgcatgtgtctttgtgtatctgtctctgtgtgtgtctctctctctgtgtgtctgtgtctctgggtgtgtgtgtgtgtgtctctgggtatgtctgtgtgtgtgtgtgtgtgtctctgggtgtgtgtgtgtgaatgtgtgtgcgtctctgggtgtgtgtgtctgcatgtgtgtctctgtgtgtgtctgtgtgtctctgtgtgtgtgtgtctgtgcgtgtcagtgtgtgtgtgtgtttgttgattttcgccatgtgagcttccactttgcatccccagcactggacatgggcgagaggtggaagtcctaacacatactgaattacacacattttattacatggttcccttcatgcgatttattctataaattcacatttatggccatgcccagtggctcacgcctgtattcccagcagcactttgggaggctgaggcaggaggattacttaaacccaggagtttgagaccagcctgggcaacatagtgagaccccccatctctaattttttagaagtaaaaaatatatatttttattaaaaaaattcacacttaatttttcagagatgtgcaaggtcagcatatgctcttatcccttctcacatattcatattctgtgatgctccaatttggagctcagaaaatattgattgatggtgttggatttggacttataagaacaaaatctggggaaaaatagtgttaaccaaaggaaaatgtcataacaggaggaaactgaaagcttaaattgcaaaaataaaaagcacataatggtccagatcccaggaggcccaaatatgagaatacattagagatcagttgattagagatggggtctgactccgtcgtccaggctggagagccatggcgtcgtgatcgtagctcactgcagcctcgacctcctgggctcaagccatcctccagcctcccgagtagctgggactacaggtgtgcactgccacacctgtctttcttgctttcctttttatacggatttctcacctctaggtactcccgagagcgcctcctctatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctctgtctgtggatctgcgtggtctccatcactgatctcacctctaggtatttccgagagagagcgcctcctccgtcactgtggatctgcgtagccggcatcactgatgtcacctctaggtactcctgagaactcctcctccgtctgtggatctgcgtggtctccatcactgatcttacctctaggtattcccgagagagagcgcctcctccgtcactgtggatctgcgtagcccgcatcactgatgtcacctctaggtactcctgagaacgtctcctccatcactgtggatccacgtagtctgcatcactgagatgtgtcgcgtcatttctgtcttcctgttgtgcgttgctttggctgaagtatagaaattgcatcaatccactgcctttcacccccgcgaatagcttcctagggccactgtaataaattactacacagtgggtggcttagaacaattttattcctcagcctcctggaggccacacgtctgaaatcagggtgtcagcagggcagtgctccctgtgaaggatccagcgagaaactgttccatggtgttctcttaggtcctggtgttgccgacaacccttgctgaccctcggctggcagaggcatcactcccacctctgcctccgtcatcacagggccctctccctatgttgcgtgtctgtctctgtgtcgcctctcctcttctaataagaacaccaggaatacccacccacatgccggcacggtgctccatgcctgtaatcctagctctttgggaggccaaggcaggcagatcacttgaggccagaagtttgagaccagcctaggcaacctggcaacacctcctctctacaaaaaacaaaaaaattagccaggtgtggtgacttgcacctgtagtcccagctactcaggaggctgaggtgggaggatcgcttgagccctggaggtcaaggcttcagtgagccatgattgcaccactgcactcccgcctgggtgacaaagcaagaccctgtctcaaacaaaacaaaacaaaacaaaaaaactgaaccacactactccagtatggcctcgtcttaaccaattatatctacaatgaccgtctttccaaataaagtcacattttgagattaaaggggttgggacttgaacatgtccttttgggggacacagttgaacctacagctgtggtgagtaagtgtctccaggcttttgatctccagaagcgtgttactacattctcctttccatctcgtgttgtacatgtgcaagagtttctcttggctggacacacacacgcatacacagaattgaatggctggatcaaaaagacatttacaacacatgctcaccaaaggaatgttgcaaaatgttccccagtttgtaacgtctcttttcacttaaagtcttcctgattcacaaaagttgttaattttaatatggttcaacttattgatacttctttcagttcatgtttaaaatatcctttcctatcccatagttgaaaagatattcacttacattttattttattttattttttgtggtggagtttcgctctgttgctcaggctggagtgcaatggcccgatctctgctcaccacaacctccgcctcctgggttcaagcaattctcctgcctcagcctcccgagtagctgggattacaggcatgcactaccacacccggctaattttgtatttttagaagagacgaggtttctccatgttggccaaggctggtctcgaactcccaaactcaggtgatccgcccaccttggcctcccaaagtgctgggattataggctgggccactgagcccagcctttcacttacactttatactaggaatttttaagttttgtttttgacagatgaaccttgatccatcaggagttgctttttgcatatagtgtaagatagggattttctttttcttttcttttctttttctttctttcttttttttttttttttttttgagacagaatttcactctgtcacccaggctggagtgcagtggcacgatcaaggctcactgcagccttgcccctgcagtctcaagcaatcttcctgcctcagtctcccaagtagctgggactacaggtgtgcaccaccatgcctggctaatttttttttttttttttttttttttttttggtagagatggggtttcaccatgttgtcaggctgggctcaagtgatctgctcaccccggcctcccaaagtactgggattacaggtgtgagccaccatgcccagctgtagataggggtttgattttgtctttttttttgtggatgaccagtttttccagttccagctaatgaatggttccttctgtgctgatctgacatgccgtccatcccatgctcacatccataatatgactgtgttgctggcctccctgttctcttccattggtcagcatgccttttcctgggccagtatcacactgtcttaaataattactataggctgggctcagtggctcacgcctgtaatcccggcactttgggaggccaaggtaggtgaatcacttgaggtcaggagtttgagaccagcctggccaatgtggtgaaaccctgtctctactaaaaatacaaaaacaagccgggcatggtggcacatgcctgtaatcccagctacttgggaggctgaggcagaagaatcacttgaacccgggagacggaggttgcagtgagccaatactgtgccattgcactccaggctaggcaacaagaaagaaactctgtctcaaaaaaaaaaaaaaatttactgtagtttggtaagtgcttatatttgataaaccaagtcctatctctctgttcttaagaagagttttggctatgttcgatgcttccatgaaaattccacaaaaaacactgggaattttgattgaaatcacactgaatatacagctatttttgggaagtgtacatatttcctaggatgaattttgaggagctgaattgcaggtcaaagactgtatgaacacagagacttttgacaaacatcatccagttgcttttcactggctgtactaagctacatataggcaagaacttggccggctcacctttatgtcttgagctcctagctcagtgcctgaaacacttatcaaaccagcaatgtctcttatgccagctgcaccccaacttctccagtataattttgttttatttcttatttttatttttatttttttgagatggagtcccgctctgtcgcccaggctggagtgcagtggtgcgatctcagctcactacaacctccacctcccaggttcaagcgattctcctgcctcagcctcctgagtagctgggattacaggtgggcaccaccacgcccagctaatttttgtatttttagtagagacgggtttcactctgttggtcaggctggtctcgaactcctgacctcaggtgattctctcaccttgacctcccaaaatgcttccaagctttggcatttatgaagaaagcagctataaacatccaggtggaggttttgtcaggacctaagctttcagctcatttgggtaaataccaaggaacaggatggaggaatcatatggtaagatactgtttagttttgtaagaaactgccaaactgtcttccaaagtggctgtaccgtttgcattcccaccagcgatgaaggaacgttcctgttgctccacaacctcgccagcctttggtgttgtccgtgtcctgaattttcaccattccaatagaaggtgctgttttctgctggttatgtttagagatattcatgataaaaagtagttacacttttcaaaattctactagaggccgtgtagaaaaagcttggaagcacccatgatgtcctccagcaggtgaaaggataagctgtggtgcatccagaaatggaatattattcagcactgaaaagaactcgaccatcaagccatggaaagacatgggagaaaaatgcactttactaagtgaaataacctgaaaaggccgcaataccaactatatgacattccagaaaagccaaaccacggagacactataaagatcagtagtgagggtgtgggtaggatgagtgggtttcatgcggagggtttttagggcagtgtataacgttatcacagggatacatgtcctttcacatttgtcaaaacccacgaaatgtgcaccagcagactgaaccccagtgtgaactgtgggcgataatggtgtgtcactgtaggttcatccgttgtaacaaatggaccactctagggggatgctgatatgggggaggctgtgcatatgtggggagtagggggtgtgctagaatcctctatactttgcacccaattttgctgtgaacctaaaactgctctaaaaaagtctatttaaagtaaagcaacaacagaataagattttagtataaataagtctgttataaaatagagaacacccatcaatggataaaagtcaagatttttatgttgatcaatttataagtgaagtgacttacaaaactttttttttgaggtcaggttaaagccatctcagcaacaagtaatggagttgccagtctccgaaataagccacgtgggtagagagcaaaccgttaataacttcagcatttctgtgcacagaaccagggaagtaatgtctttaaatacagctgcatcttgaaatatctgccactaattcaggcacattgaaattgctgcattaaactactgaactataatagaagcctctgcaacctttattctgagtttactggtcctatttatagcagaggatcagaaaaaaaatgtattgctatctggtgtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgactatgagtgatgtgtgtctggtgtaatagtcgaccatgatggtgataggtgatggtgacagtgatgtggtctggtgtaacaggtgaccgtgatggtaatagatgaccgtgacaatgacatatgtctgatgtaatagttgaccgtgagggttacaggagaaagttgtaccgtctgtttccacgggaacatctgtagagcatgtttggctaatgtttctcttagtgcacattggaaccatgccattctgttttccctgcccccacctgacagcacagtgcccagcacatgtacatgtacggtattaacattgtcagaacacatagctgtgacatggtatcactctctcccctacaggcattcgtcctaattctgcaaggagatgtatattccatgctaaccagcagtccctggtgtctctccagtcatttagatggtctgaagcaacatgggcttagccatttgggattaattttcctggatattgtgcccttccaatacctaatttcaaggtttttttgatttcaggaaacagttctcaaaatatacttttttttttgagacagagtctcactctgtccccaggctggagtgcaatggggtgatctcagctcactgcaaactccgcctcccagattcaagcgattctcctgcctcggcctcccgagtagctgggattacaggcacgcaccaccacacctggctaatttgtgtgtgtgtgtttcagtagagacggggtttcactatgttggccagtctggtttcgaactcctgacctcaagggatccacctgccttggcccctcaaagtgctgggattacgggtgtgagccaccacgccaggcccaaatatacgttttaatattattttgtattactgccttggttttcctcttcagcaactcctattaaatttatattagatctttttttctgatcttctatacttattcctcattttgaattggtttcatcttgtcatttatttttaatttcaactttatggaggtataattgaagtacactaaaacacagatattgatggtgtaacctttgtttttgaggtgcatgtggagtttcacatccattacactcaaggtagcagctatttctatgacccccaaaagtttctagtgcccatctatatccatccctacctccaccccatccccaggatgtggtttctgtcattatatgctagttttcatgttccagaaattcagacaaatagaattatacagtatattctatttttcttttcttttctttcttttttatttttatttattttttttgagacgaagtctcactgtcacccaggctgaaatgcagtggcatgatcttggctcactgcaacctctgcctcccaggttcaagccattctcctgcctcagcctccagagtagctgggattacaggtgcccaccaccacaaccggctaaattttttatttttagtacagacagggttttgccatgttgcccagactggtcttgaactcccgacctcaggcgatccgcccgcctcggcctcccaaagtgctgggattacaggcgtgagccgccgcgcccagccgtgattctgtttggcttcttttacgctgtgtacttctgaggttcaactgtgctatcacttgtgtcagtagcttccttttttaattgctgaataacatcccaccgtatggatacatcacccttcctttgtccatgaagtgcccgcccacttcatttcatgggtatttcagttgtttccagcttttggctattggaaatacagctgtgaaggatatctgtataccagtgcttatgtgggcatgtactttttttcccctggagcaagtctgaaatggttgggtcatatggtggtgtatgtttactgtttcaagaaagaaagtcctattttttctaggatttatcccatcttataccgccaccagcagtgcgtgagacaatgcctgttgtttacaagtgtgtggcagtgtctccttgtggttttcatttgtgtttccctgatgatggaggggaacatttcttcttcttccttcttctttttcttcttttttttcttttttctttttttcttttttttttttttgtttgagacgagtcttgctctgtcacctgggctagagttcagtggtaggatctcggctcactgcaacctccgcctcccgggttcaagtgattctgctgcctcaacctcccgagtagctggattactggcgcacaccacaacgcctggctaatttttgtatttttagtagagctggggtttcgccatgttggccaggctggtctcaaactcctgacctcaggtgatctgcctgccttggcctcccaaagtgctgggattacaggtgtgagccaccacgcctggcatggggcacattttttcatgtgcttattggttattttaaatattattctatgaaatgtctgttgcctatttttttaaaagtgggttatttgttttctggttattggcttttaagagtaagttctggatgtaagtcctttgtctggcatgtgtggtgcaaatgttttcttcaatggatggcttgcctttctgtttttaaaaatgggttatttcaaagagcaagatattttattctatttcatttttattgtttattttttgagaccgagtcttgctctgttgcctaggctgggtgcagtggcacgatctcggctcactgcaatctctgccatccaggttcaagcaattcttgtgcctcagcctcccgagtagctgggaccacaggcaagcaccaccatgtccagctaatttttgtatgtttagtagagacagggtttcaccatgttggccaggctggtctcgaacccccgacctcaagtgatcctcctgccttggcctcccaaagggctgggatgacaggcgtgagccactgtgcccagccagagcaagatattttacttttgatgaagtctagttaatttttttctcttgtggtctatgccatatcactaagattttcttcctgttctagagactcatcgtttggaattttacatatacctctgtgacatattttggattaaacttgcatatggcgtgaggtgttaagagttatttttcttccccgcgtgagtatccagttgatacagcaccattcattgaaaagaatttcctttctgtgttaaattacctggacatcttgttgaatcaattgacaaaagatgtgtgggtctgttcctaaacttgcagattctgtgtcattgatctctgtgactatttttctgacaaggtattttgatttatgtagttttgttattgttgtttgtttgtttgtttgtttgagatagggcctcactttgtctcccaggctggagtgcagtggcgcaatcttggctcactgcagccttgatcttccaggctcacatgatcgtcccacatcagcctcccaagtagctgggactacaggcgtgtaccaccccacctggctaatttttgtattttttggcctcccnaaagtgctaggattacaggtgtgagccaccacacttggccttgatttatgtaattttaagccttgaagttaggtaggttaagtatttcagttttttttttttaatgattgattttagttgggcacggtggataatacctgtaaccccagcaactcaggaggctgaggtgggaggatcacttgaggccaggagtttgagaccagcttgggtaacatagggagaccccacctctactaaaaataaaaatatggtcgggggtggtggctcacgcctgtaatcccatcactttgggaggccaatgtgggcggatcacttgagctcacaagttccagaccagcctgggtgacatggcaaaagcctgtctctacaaaaaaatacaaaaattaaccaggcatggtagtgggtgcctgtagtcccagctacttgggaggctgaggtgggaggatggcatgagcctgggagggcggaggttgcagtgagtcgagatcgcgccatcgcactccagcctgggcaatagagccagaccttgtcttgaaaaataaataaataaataaaaataaatgagggatttgagtcccgcccctagaccttatggaaccttaattcctgccttactccaaatacaaccacactgggagttcaggctccagcataggaatcttggtgacagagacattcagtgcgtagcagctgctcggaggtacagacgccccggcacctgcagcgctccctggactcctcacagcagcctcccactttgctcttagcctccgcggagaagcttgttgacttgttgggattctgctttcaggaactgcagatgccctgttgcctttttatgcctttcttaccaagatgctggtgctgaaaatgccacctgcaaaatttcattccaaaacgttgaatccagcttttaaactacagtttcataggaatacaggatgcaaaagattaggttaaattacactacacaaaatcagcaaaatccagaatgtgtggaactcaacagaacagtgattttcctagaaaaactacaacaaagaccaagggatggaattgtaaaattgtagtttaaaagagacttaagagcctcgtgaattgaaggccatctctggatctagtttggatcttgattttaacagtgaaaaaaaatatttgctagataaataaatttgaggactctatatttgatgattctaaggaattgttaattttttgtgtgataataagtttttaaaaggtctactttggtgtatgtaagaaaacgtctgtaataaaaaaactcattgaccagcctgggcagcatggtgagacccagtctctacaaaaaatacaaaagttagcttggtgtggttgtgtgtgcctatagtcccagctacttgggaggctgaggtgggaggatcacctgagcccaggaggcagaggttgcagtgagctatagttgcaccactgcactccagcctgagtgacagagtgagaccctgtctcaaaacaaacaaacagcaacaaaaactcattgaaaaagtttcacagcattgaaacttttatctattttatccacctttttatctatcaatgactgcaatcattgatgattaatagatccactatttcatctattaatcaatgattgtgatgcgttactttgcttatcctattacacctgcatttgtcaggtgtgactgtcttgtgcagaatggtttttcttcggccgggcgcggtggctcacgcctgtaatcccagcactttgggaggcaaaggcaggcggatcacgaggtcaggagatcgagaccatcctggctaacacagtgaaaccccgtctctactaaaaatacaaaaaattagctgggcgtggtggtgggcgcctgtagtcccagctactcgggaggctgaggcaggagaatggcgtgaacccaggaggcggagcttgcagtgagccgagattgcgccactgcactccagcctgggtgacagagcgagactctgtctcaaaaaaaaaaaaaaaaaaagaaaaaagaatggcttttcttcatcaacaatttggttatcctaaaatacagttcatgtagaacacacagaattaatacttgatttttttccttatcaattttctggatactgatttggtgccctggtcacttgcagaagtagctgatagtatttccctttgcagtctcacgtgggcgtagatttttatgtatttggtgtggttccacatattgcagtcattattttctttttcttttctttctttctttcttttttttttgagatggagtctcactctcttgcctaggctggagtgcagtggcaaggtctcggctcactgcaacttccatttcccgggctcaagtgattctcatgcctcagcttcccgaatagctggaattacaggcttgcaccaccatacccagctaatttttttgtatttttagtggagatggggtttcaccatgttggccaggctggtcttgaactcctgacctcaagtgatccgcctgcctccttggcctcccaaagtgctgggattacaggcatgagccaccacgcctggtcattattttctcttttgatggtcaaattacactatctttggcatcactgcagtatgacacttttcccgtttaataacgtttttgctttcagtcatgacaaaatgtcctgggatgatcgtacatatttctggctccagactaagtatcagagtttccccagcaagccctgagtcttgttaacgagaaatgctctgcagagacctgggtctaggggctcaagatgtttgctgttaccagtttgtcattgctactcgactattttggggacacaactaggaaacaattttttttgaaagggaaaaatattaataaatccctggatcttttgaattcacttttacaacagcataggtattacatcacatcatattgtattccaggatatgttcaattagaccctcttgaaaaacatgtaggtgatttccagtcttttgtaatgaaagttgatatggtgtagctctgtgtccccacccaaatctcaccttgacttataataattcctatgggtcaagggccggaccaggtagacgtaattgaatcacaagggcagtttcccccatgctgtactcgtgataatgagtgagtctcacaagatctgatggttttctaagtgtctggcatttcctcctttgctcggcactcattctctctcctgccgccctgtgaagaggtgtcttctgtcatgattgtaagtttcctgaggccttcccagccatgcagaactgtgagtcaattaaacctcgtttctttataaattacccggtcttgggtatttcttcatagcagcatgagaacggatgaatacaaagtcttgcgtacttataatttcatatagttgtgccagaacatctttgtagcagaagtgagactggggtcaaagggtaaaggcatattcaatttggctaaatactgccaacttcttccctttaggggtcataaccattttcattcccaccagcaatgtattctgttttagccaaggtcattttaaaaaatttatacaacttaaaacttttcaggaccagatggaatgactcacgcctataattccagcactttgggagacagagctgggaaaatctcttgaggccaggagttccaggctggcctgggcaacaaagcaaggcctcgtctctaaaatcaaaacaaaattatcatgaaagcatggatttccattttctctcgagaaacgagatgatctggccatgcccgttcctgtgtggagggacagagttcagcagatcaccaggactccggcttctggaaaatgcaggcctgcttgctcacacttggtgtaggtgctagtttacaggcatttgaatttcagagttcttgttataagctggactttgccatttacctgtgaatgagacacacatgtctctgctctaatggtgcttacgtgtgtgtgtgtgtgcatgcatgtgtgtgtgtgtacatgcatgtgtgtccacatgtgtgaatatagagggggctcagcatgctttataacatgtttatataacatagaaattgtcagcctgggcaacatggtgaaaccacgtctctactaaaaatacaaaaattagccaggtatggtggcactcacctgtaatcccagctacttaggaggctgaggtgggaggattgcttgagccctggaggtcgaggctgcagtgagccgtgatggcaccactgcagtttggcctgggcaacagagtgagactctgtctcaaaaagaaaaaaaaaaaagaaatcaacctatggttaaatttgtaatgccttcctcagaattttataaattattttcattgcagagaaattgggttgaatttgaaatagtgggagtacttgcccttcatcttaatgaggccagcacagaaggaaaggcgggagtgtgtggagtctacagcctggcctcgaaggctgagggcacctggaattttgtgtctaacaaccgaggattactgcaggggctgaggagggcagggccgacggtgctcatcggaggcaacatcactgctgagatgttgagaaagatggaaattgtgctggcttgggattctcctatgattaaatcacccaatatttaatcctattaaatcctcacagtgctctagtttaataaaactctttaatatatgtcataggaaggccttgttatccgaagataattggtattaaaagtaaccacttgaaaagagtctacttaacacaaggacaggaatcttacagtgacagtgtgacaagttttggatttgatgctatggatttcataattgaaattgtatgctgattcttggaacaaagcaaaaaacgagctgcgttcatttgggaggaacgtcatttgtatggtagaattatagtttattcttcaattcgcacttggttttcacagcataatcataagaacagatttctatgaaaatacttcagggcttcatcagcttcccggaggcccttcctttgtcttctgtcctcagaatattctcttatggacatcgattgtcctcgggacatttggacagttctcccaagggaccttctgtttttttctttcctttttttgaggcagggtctcactctgaggcccaggctggagtgcagtggcgcaatctcacctcactgcaacctccgcctcctgggctcaagccatcctcccacctcagcctcccaagtagctgggattacaggggctcgccaccacacctggctaatttctgtagtttttgtagaagtgggatttcgccatgtggcccaggctggtcttgaactcctgagctgaaggaatccacctgccttggcctcccaaaatgctgggattacaggcatgtgccaccgcacctggccccgggtgatcttctgttgcaggatttgcaatgtctcttttaactggtttaactccaattccgttcatcagagagggccaggacgaccaaggccagggattttgactccctgacttggatgataggtgccaacatgaggcagggggagttgtcgaggagccattttgtaagtgatcaatagtgaataacgtcgggtgttgatgactttcgcctcctcttgcaacctcgatgaggatatttggataatgagaagctgttgtgtttcattggattcttatgataatcctgataaccagccaaggtcccacagccaggacacacaggatgtcatccaccccgtacctatgagcctctgtgacaccattaggcccagaactgctgtaggtactgtgaaaagagggatatttctaggtctatcaacaatgttaacatatgcatatatttaaaaagtcttaaattattattatccgccgggctcggtggctcccgcctataatcccagcatttgggaggccaaggcgggtagatcacctgaggtcaggagttcaagaccagcctggccaacatggcgaaaccccgtctccactaaagacacacacacacacacacacacacacacacacacaaaattagccgggtgtggggcgggcacctgtaatcccagctactagagaggctgagatccaccatgtctggccactttctttttgtatttttgtagagacagggtttcatgatactggctgttgttaaactcctgacctcaggtgatctgcctgcctcggcctcccaaagtgctggcattacaggcgtgagccactgcgcccagctaggaaaagaaaattaccattttgttttattacacgagtggatgttaattataaaaatattcagacactatatagaaatagcacagccatccacagtcctgcactttgagacaagcttctgtgtgttatggcacaagtcattgtttgtgaccggtttctcatagacttttaaaaagcacggtcgtttcattttccttccatcttctctcaccaggtaacagcctggtggtctatccttccatgctttctccgttgtcacagtgtgtgtgtgtgcttgtgtgtgttgtgtgtgtgtgtgcacagatttgatggtgtcttagggttctccagagggacagaaccaacaggatgtatgtatacatgaaaggatcttattagggaaaattggctcacacgatcacaagacgaggtcccaggataggccgtctgcaagctgggcaagagagaagccggtagtggctcagtccgtgtccaaaagcctcaaaccaagaaagtcgacagtgccaccttctctctgtggcagaaggcttgagaccttccagaagccacagatgcaagtcccagagtccaaaggcaggagaacctggaggctgatgtccaagggcagaaggagagggaggaagcatccagcacaggagaaagaaggaagccgggagacccagcaagccaggtcatcccatcttcctcctgccttgtcccagccgcgctggcagcccactggatggtgcccacccacatcgagggtatgtttcctctcccagtccaccaactcaaatgtccatctcctctggcaacatcctcacacccaagaaccatacttcaccagccatctaggcctcttcagtccaaacaagttgacgtctaatatttaccatcacagatgaatttcaatacttttgattatttgaacagggaacacgcagacactcacatgatccacagcccacgaagtgctgacaggcacactggtgggaagtctctccccatccatgcaatctttgtctcaccccgatagacactggctggtattggcttcctgtatgtcctgtcataatttgtttatgctcaaacacataagaatatagacttttattcttccaccagttataaaagcaaacaaaagctagtttgtttagacaatatgcgtttggctttttcacagaagagcatatcttggagataatttcacagtgagtattgagatccctctaagtagctgtataccatcgaggctggatggatgcatcaaaattgaataaccagccccctattgaggacatttgggttggttatcatattattacaaacactactgtgaatatattcttgcacacttgttattttgcatatgtgcaaatacatctgcaggatcaacccctagaagtggaattgttgggtcacagatgaatgtcgctagctgctgcttaacggcctgcactattgtgctgctcacattcccattagcagagtgggagcgctctcgttctcccgtagctttgataccagcctgtgttattaaacttttggaactctgccattctgataagtgaaaaatgtaattccgcgtggctttaatttgcatttatcttatcacaggtgagatttaacctcttcacttgtgtaacagctattcctagttctttgtaaattgcatgctcatagccttcctttctctattttctttgttagttgcctctcctttttgaaaatgcatttctaggagctctttattatgaagaacatcccttgtaatgagatgcaaacattttttcccagttcatcatttgccttttgcttttgcatttttatttattttaattttttttgagacagaatcttgcactgtcccccaggctggagtgcagtgtcgtgatctcggctcactgcaatctccgcctcccggttcttgtgcttcagcctcccgagtagctggggttacaggcgcactccaccatgcccagctaatttttgtatttttagtagagatggggtttcatcatgttggccaggctggtctcaaactcctgacctcaactgatccacccgccttggcctcccaaagtgctgggatgacaggcctgagccactgtgcccggccttattttctttttcaagatagttatgcctatgtttcaacaccattactgaagagttacccataatttctctgagatgtcaaacttatcatatgttatattctcatttgtactgaggcgtgttcctgtgcttttgatagcattacaatgatctatttttgtgccaaggccaccagggttaattattgtaacttcataatccatcctcttcatatatatatgaaaatatatatatatatacactttatatatatatatacactttatatatatatacactttatatatatatatacactttatatatatatatacatatatatatatatatacactttatatatatatacactttttttctggttactcttgcttgtttatttttcctcttaacctagttccaacaaaacagaacccaatgcaagcaaagaatctagttatagtatttgtgttagcaacacttcatatttataaattaacatagagacaaggacactttattatattgagtccttgttcagggctgaattatgtgccttcacaccctgaaactcatgtgttgaagccttaacccctggtcctcagaatgtgattgtgtttggagatagtctttaaaaaggtgattaaattaaaacgaggcccttagggtggatcctgttctaatctgacttatgtccttgtaagaagaggagagtcagacatgcaaggagataccagggatggacgaacaccgagaaaaataccctatgaggacacgggcaagaaggcagccgtctgcaagccaaggagagagcccccaggagaaactcgccctgctgactccttggccttgaacctgcaagctccggaactgtgagagaatacattttacacattttgttgtttaaggcaaaaggtctggggaactttattatggcagtcctagctaactaattcagtcctctctccaagaatataatatttctttctatttcttcatactaaaaaattaatacattaagggttttcttcactcagttcttgtagagttcttaagcttattttgaggtattttaaattttttttggtgggatgcttttttaagtatatagagtcattttttcttataccttttaagcgatacttctttgtatatatgaaagttcattaaatttgcctttgtagtgtctttccattgtttgttttacaaaaaatgggacttatctactcacccacactgaactttttttacttagcaatacatagtggaactaccttcaatttgttcaagtcaacaaattccccccaactctcatatacccaccacctagaacctaccattcacattttactatgcttgttttgtcactcatttatctgtctgtctgtctgtctatcttttttttttttgagacagagtttcattcttgttgcccaggctggcacagtctctgctcattgcaacctctgcctccctggttcaagcgattctcctgcctcagcctcccaagtagctgggattacaggcacccgccactatgttgggctaatttttgtatttttagtagaggcagggtttcaccgtgttggccaggctggtgttcaactcttgacctcaggtgattcacccaccttggcctcccaaagtgctgggattacagatgtgagccaccgtgcctggccctatctgtctgtctgtctatctatctatctatctacctatctatcatctatctatctatctttctatctatatctatctattcctttctatttccataaacccattctttttaatgggagcataatatttgccctttataaaatactacagtttgttaaactgatagtttgttactccatttctagtctttcctcctaactacaaatatttctgcaatatatattcttacttatgtgttgatgcttttatttctgtaagatagattcccagatggaatggaaataatttaatagatattgccaggttgctctcccaaatggataactcacatttctaggcttgtttaagaacaccttctttcttccttgcatccttccagctaatatcactcttttacattttgaagatttactgggtataaaatgatatttcattattatttgaatttgcccttccctgactccaaggaagtgggagcatccttcatttgtataaagaccattttactttgtatgtttcttctttgtattttttgattctttaaaaaagtaggtttttggccgggcatggtggctcatgcctataatcccagcactttggaaggctgaggttggaggatagcttgagcccaggagtttgagaccagtctgggcaacatggcgaaaccccgtctctaaaattgaaaggagaaaaaagaaaaaaaaattaggttgtttgtcttttggtcattatttggtattgatttgtaagataatgtttggcatttcgtatgctgtgcaaatattttctttctttctttcttccttttttttttttgagacggagtcttgttctgtcacccaggctggagtgcagtggcatgatctcagctcactgcaacctccgcctcctgggttcaagcgattctcctgcctcagcctcccaagtagctgggattacaggcacccaccaccacgcccggctaatttttgtattttttagtagaggtggggtttcgccatgttggccaggctggtctcgaactcctgacctcaggtgatccacccgcctcagcctcccaaagtgctgggattacaggcatgagccattgcacctggtctaatattttcttaatttttcatttgtctactgatatttttgacatttttttggtcatgcaattacaattatggctgaatattttttatctttctatcatggtttctggatttctgttggccctgaataggttcctctaatctaagttgtatggatagtcttgtaaatgattttggcattttaattttatttgtttgcatgaaagtgttactctttctggaaattattctgtgtctagagatccaggtccggtttggcttttcttctcccatactgaagacgtgtttgcctgcagtggcatttattaagtagcccctccgcccaacctccccggggcagggacaccgtgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggaaggggagaccggggtacggggggggggaaggagggggggggcagggggggacacgggcgggcgtaaaggtggaaagggggggggaggggaaagggagaacgggggaaacagggcgaacgaggcgcgaggggacgggccggggggaggcggaaagggggggggggaaagaagggggggaggtgcgcgggcgggtggccgggaagaacggcgctgggggggccagggggcgggaagaagggggaagaatgcgggatggtgagggcgaaagccggcaggtagaggcggggatcgaccagaggctcgaccctcctctcccatggtgaccgtcccatgctgcgcgatgcaccccccacagtggcgtggcgtcaatcctccaaaactctgaacccacggcacgggcggatttttgttccaagtcataaactgctggtaaacaatttgtttctctccctgtagaccaggaaagatccacatgactggaatatgtttcctctattgttcttatttcttattcttaagccttgacttatatgtcttatttctacctggaagtctcaaaactgattagataacaggaaacagacccaataaatctgtcttgcttttccattcaaaaaaacaaaacaaaaacaaaatgaccaaagcaatctttttggctttatccctaagctacattattcttgtcttcaatgaatgtccatgttcagtctttcaggctgagatagtgcaacagctgtacaacagccatgattatgagagggtatttattgtaaataaccaaactgctagtggcaaacatttactaaaagccagggaatactctctatatgacatacttgatttcccaagtgtcgaagtacaggataaacatttaaatatcaacattccatttcggttaaatgttaacagaagtctccttaaaagtagcattatagtaaaatcacaactctccctgtgtgaatactattgtcagaaacaggtagcaggtagcttcctggtttagagactatttaacagagaagagtaatttgccattggaacgatcatcatttataattcaatagaagctgaactaccacaaatggcagaatccaaagctggacagaatcctggctttcttctgcctgttgttcacacacacatgctaaggaccttccatacaaataataattgtgggcaaataaattataaaccttgacatatacacagtggttttagtactttgttgctagaatactttgacttacttttcacaattaaatcacttgggtaaaaaaagaaaagaatacttgtaattaaacataggtaaaagctggccgggtgcggcagctcatgcctgtaatcccagcactttgggaggcttaactgggaggatcacttaagctccagagtttgagaccagcctgggcaacatggtgataccccatttttggtacaaaaaatacaaaaattagccaggcgtggtggctcacacttgtgaggatcccttgagccaggagactgaggctgtagtgagcagtgatggtgccactccagcctggcgatagagagggactttgtctcaaaaaacaaataaataaatatgtaaatgctgactctgggccagtttgtaaatatggtgctaaacgtaacctactttctcatattttgtatggtgaattacacttttatacctataataaaatgttatacttttttatttttttgtatttttactaacacttgtttccattattattatataaatactttttaacaggcatttagactttatgtaaatagtattacacttctgcaatttttttttttttttttttttggaatcagggtcttgctctgtcacccaggctggagtgcagtagcgtgatcacagttcacaacagcttcaacctcctgggctcaggtgatccctttgcctcagcctcctgagtaactgggactacaggcacacatatttttttagagatgaggtctggccatgtggcccaggctggccttgaacttcttggcccaaccaatcctcccaccttggtctccccacgtgctggtattacaggcatgagcgactacacccggcctgcctctgcaatttaatcatttttttttttcctctcagctatacattcatatttctccactcagcatatattgctctagtgttaggtgaaaccacaccatatggttcaacctcatacattcatcttactgctgcatacactccattatataaacagccatgaggtagccatccaggctcctattgtgcctaatatttttccattaccaacaatataacgaaccacagttacaaggctgcacatgcatgtcaggatggttttctggaacatacacacacatgcagagagaggaccaccgagccatggggtttaagcgtcttcagcttcactaaacaatgccaaattgctctccaaagcacttgcaataaattggatgcccccagcatggcacatggacatgagacactgccaggctaatcttgagctaccaagggcccaccacatgatctcgccccaggaatgaggatcagaactgacatgatgaagcctagagagcgtgaactagagagcatttaaacttgggggcgggggcagccccttacaccaggccgtggagacgaagagaaaccctcaggatctcgctccagccaacctcctcagctcactcacgtctcacctccgcccactgctgaccatccactcactaccgacagcatctttctgtcccttgcatgacttcgttcccaactctgggcctctggacttgctgtgccttctacccagggcaccctcccccagccctgtccacagccgctttcttatccacagctcagctcacggggtggccccctgacccacccggccaaggcagccacacccacaccctcgccctgcttattccttcacagcaaggattgcgaaagacacttgattcatctgctcagctgctgtctatctcccagctgcaggttccacaagagcaaggacttctgtcttttcacaacccaggcattctgcccacagcagtgcctggcacccagccgccagtcagtgatgaccaggtcaacaaacgagtgaatgaatgaatgaagagcaagagaagggcagacacagacaagggggaggagagtgggaaagtacacacaaatgacaaacgtcaacaaacggaaacagagacacacacacagactaagaccccgcaagcacaaaacggccacgacacaaggacaggaaggacctcagtggctcgctccgtcctaactccatccctcatgagggctgatggtactacgtgccctcaaagcctgggagaaatcactctaccttttttttttttttttttgagatggattcccactctgttagccaggctagagtgcagtggcaggatcttggcttactgcaacctccacttcccaggttccagctattctctcacctcagcttcccaaatagcagagattacaggcacctaccaccacccccaattaatttttgcatctttagtagagacgaggtttccccctgttggccaggctgatctagaactcctgacctcaagtgatccttccaccttggactcccaaagtagtgggattacaggcgtgagccaccccacccagcccattctgccttttaataaatctcccttttctgctttagctgatgggtttctgtcccttttaaccaaaaggccttgaagacaacagattccagtggcatctacatttttcttaccatgggcattttcaaatggaaacagactgattcaataaatacctggcaggtgctctggatcaggcaccatgcagaatactgaggcttcagagcacaaatgacagtatgcatctgtcctgaaaaggctgaagcactgggggaagggtgcaggaaaaaacaggactgcatctgtgtccagaatgccccaagacaagatgggccatctgtgggaacatgcgaggaaagggaggcaggaaggcttcccagtgatgcctaacctgagactaaaaaaggtgcaaggctacatgtggtggctcacgcctgtaatcccagcactttgggaggccgaggcgggtggatcacctgaggtcgggagttcgagaccagcctggccaatgtggtgaaactccacttctactaaaaatacaaaaatcagctgggtgtcatgggaggctgaggcgggagaattccttgaaccctagaggcggaggatgcagtgaactgagattgcaccattgcactccaccctgggcaagaaagcgacactctgtctcaaaaaaaaaaaaaaaaaaaaaggtacaaggcaagagagaaggcgcagagggagaagtccagtggttcagacaaagggagcagcacctgcaagggcagggaggaggggcgtatcagtccggaggcaggagcaaatcctgccaccacaaggcgatagatctgggctcctagggagctcttctatggatcagttatttcttacagttgctactccttaaattcagaatagacctcaagttaaaaacaagaagtgattaatctgtaaaaacatatagattttgctcttcaaactaaaggacatgtttagatatacaaatgagtaaacctattataattaagaatagagaaactatagactccaactgtaggaactgtttgtatgagaacacacaaaatataaaaatttggcaggattgcataagttatgacattctaaactataaatatatgcatatataaaattatgttcatatattaaactcttagtattttaagttccagtgaagttttttaatcttcttattttatgaattggaacctgcatcttcactatacaacattctgcactacgtggacaaacatgagctgtcaaaaaataacttttaaaaatatctgagcagtgttttccgccctttaagaaattatatttgcaggccaggcacggtggctcacgcctgaaatcccagcactttgggagcctaaggtgggcagattgcttgagctcaagagttgaagaccagcctgggcaacacagcgcaaccccatctctataaaaaatacagaagtttgctgggtgcagcggcacgcgcctgtggtcctagctactcaggaagctgaggcgggaggatggcttgcgcctgggaggtcaagggtgcaatgagtaatgatcgtgcccctgcactccagcctgggcgacacagtgagatcctgtctcaaagaaaaaaaaaagagatttgcaattcatcaccttgaaaccaggatgaaaaataacgttctcatttcttttaggtctactaagaacaccacacagctactgtgtatttattgtttattatcatgcaaacaattcccacagatgaaatgtgtggtttctctattcttcactataataaatagatatatcatatatatgtatcaaatataaatacatcaatgttcataaactttttttaaaaagtaatcaaaatacgtttggggtggttatcttatagaatagctattccattttgcttacgtcctacagtgaatttcattacacctcggtcactcttccttcccaggctgcatgcatccccacccacgctcagttcactgctgtgtctctctgcacccagcacatgatctgctagaggcctgacattcaagtacctgctggatgggcgagtcttttactttctgtaaatcagaaatatctttctggatttagagtgtcagagatctggaccaagtcacgcaaactttctatgcccaaatgactggttgctcaaaaacagcatcactggttagaaactacatctgtcagtacagattgtattgagcagattactctttaagccctgtccacgtaactgtcagaggcacgttcttcacaggaacaagcatcagcagctaagaaaagaaacttcatggaagcatcacaaatactttgttaatcagacattgttgatgaggcattttaaccaacaaaatattcaactttacctagaaaaaaacaccagccatttacaagcacggttgtgagtacacattcaactactctaagaactactgggaaaggacacatttcctggggcggggcgggggaggggaattaaacttgtatctggtaactttaagatgggtttttaaatattaaaagttattaaacttcaaattcagttttaacttactattttatactagggagaaggttgttcttttctctttttttgagacagggtctcaatctgtctgttgcccaggctggagggcagtggcaaaatcttggctcactgcaacctccgcctcctggactcaagcaatcttcccacctcagcctcctgagtagctggaaccacaggcatgcaccactacacctggctgagtttttgtatgttttttgtaaagacagggttttgccatgttgcccaggctggtcttgaactcctgagctcaaatgatctgcccacctcagcctcccaaagtgctgggactacaagtgaaagccactgtgcccagccagaaggctgctttttataactccctaaaaacaaaaaatctggtaaacattaatcacacttataattacatagcacttgctccctcccaccttctcccagagcttcacacattagataattttatgcttcataactccctctatgaggtggacaagagagataccactgtccccatttcacgtacaagaaaaagttttgagagatttaaaaattatttgcccaagatgagaaactccatgagtggaaacttccacggatatactctctgactgctcagctgctgtgtctaaagcaggatggtattgaagtagatgagctgacttctagctctgccgttctagaacaaaactgattgacatgttctactgtttcaggaagggtttggatatatagaaactgagtgacaaataattgccttatttgctttttgctattcaagccaagaaaacgtactttctcacgattccccaacatataaatttggctgtattttgccaaaatagtcacagctctcacgttcaatgacattgagctttttttttttttttttatgagacaatgtctcactctgtcacccaggcgggagtgcagtggcatggcacaatcatggctcactgcagcctctatctcctgggctcaaggaatcctcctagcttagcctcctgagtaccaaggactacaggtgcgagtcacacctggatagtttttttgtgcgtgctttgttttgttggtttttctgaaacagagtctctttctgttgcccagactggagtacagtggcacaatctcggctttctgcaacctccgcctcctggattcaagcgatgctcctgccgcagcctccagagtagctgggactacaggtgtgcgccatgacatccggctattttagtagaaacggggttttgccatgttggccaggctagtctccaactcctgacctcaagtggtccacccaactcggcctcccaaagtgctgggattacaggcatgagccactgcgactggcctcctgctaattttttaatttttttcgagaaacagtgtctccctgtgttgcccaagctggtctccaatacctgggctcaagtgatgcccccaccctgatctcccagactgctgggattacaggagtgagccacagcttttcttcattaaataaatacctgagctcctactacacggcactgaaagataatccatcgggcaagacaacacaactataatttgctgtgtttaagatgatattgatctgcggaacacagggaatatttgtccattaataaaaaaggaaaaatcaccgtgaagaaacttccttggaatgaatataaagcataatttccatgatcctaaggatgaaatcattgcctttctcaaccagagctcctcatctgaaccacagaacacagataatgatttaagtggctcttttctctattctcccactcgggggtacataacagctccattctagcagcagaggagagagaataattcattacatgcagtgggtgtcgtagggctgtgggccttagcacccctgttctgaggctgccaacaatttagagaccagaggctctatctgtgcacacacgtagcatgaattagtacctgtattgtaaagggaaaaagtcataactacttctgctggcctaagccgtcctgggttagacaagcttggaaagtgcacgaccatcactatcattccgctgtcactgcaccatgcacagtcctgtcacctttacacgtgtagaatgcatcgaaatccttccaaaatttttagtgacctgcttttcccttgctaaagtaaacagtaacttgctgtgtgcccggctgctgggcgcgtaaggtgcgttcagagtcaacacacggtcccagtttccaaagcaaactactgggagatcagacacaagctgctgttcgcgctcgccccaccccaagcacccagcactctaaggtgcccacatttcacacccatctgttgcctcccgcttggtgcacagtcctttgtgaagccccagggataaagcagcgaccaagaggacccggcctgctccccggggctgacgccagctgcggggaccccgtggggcggaccacagttaggccagtgggctccggctgggtaagcgccagatacaatccgccaagcggagtgacggacagggagccacgctcgaagagggggtcgaggccgggaccttccccgctccctcctcctgccccaacccgccctgaggactccgcccaggaagccctggggaccccgcccggagcccccaccctaggactcccgggacccccgccctggggaccccaccagcagtccccgctcaggactccctgagaccctgcccgcagcccccgccccagaacgccggagatccccgccctggggaccctcccggagccccgcccaagacgccccgagcccccgcccgccctccagacgccgccccggccgggcctgaaccgctacccgcggctgccgctcaccgccgtcaggtctggcagccggtcccgcatccccgccggccgggcagcgcgccccgccgctcaagcctgtcccgagctgcctccggccgggcctcgggctctccggtctccgcctcaggccccgcggtcccggcccggcgccagcagccctccctggagccggcgctgccacggcaaccgcgccccgcgcgctctgcgcatgcccggcccgcgccgcgccccgcacccacccacacggcggcagcgctttccagcgggagcccggaggggcggggcctgggggcggggcctaggcggggaggggcggggtccggccgagccccaggctggcagttccgctacacgtgctgtttgtcccttgatctgcttttatgctttcacactcattgttttatttatcaaaatatagagcattcaacgaatagtgacaaaagagcaaagctcccggaatgtgctgggtgcagctttgggtaatacatatgccgaaccttctctttaagggtccacgcgcagcctcgggtgtgaatgaaggagaagagatcgtgtaccacacatgatgcttacggagcataacacggcagggggcggtaacgggaagagcgtccgcaggcccagccctgggataccattctggcaggagaaacaggcaatacagacacagacaaataaatgatagatgagaaaagaaagtaagggcatgggcacggaactggcagagaggtcgtcatgaaggtgcaggagcttaggtgaactacccaggttgggggaacagtccccaagaccattatcacctctgacaccaacggcaaattctggcggtttccaaaaccaccttcaagttccataatttgctagaaggaatcacagaatacactaaaaactactgtactcacaactatggtttcttagcaggaaaatgatacggattaacatcagccaaggaagaagggcagagggggagtctggggattacggcgtgcagcttcaaggtcctcccgtggtcctctccctgtgtagtcaggcctcattacttgccctgcactgatgtgtggccttacacacgaagtactgccagccagggaagctcacttgagccacagtgtgcagaacgtttactgggctccattgcatgtgcatgattgattgattgtttgattgctttcatgcttgatctcagcctcttggttaagtgatatccatgtaaccctaagcccccaccataaatcacactgttactctctggctagccgaagactcccaggcaaacaaagattgccttccaggaggagaaggcaaggccagatttgtttttaaacaaggttaaagtctttactgcctcctggaggaggtggctttggtctgaccagaaggcagcgctaagaaatctgcttgagagcaacaggctacacattaaaaaacaggacgttttggacttggttctaggtgtgatgtggttctgttacccgatggaaggtcttgacagccagttgtccaggtgagtgtggtggcgggcacctgtaatcccagctactcaggaggctgatgcatgagaattgcttgaacccgggaggtggagcttgcagtgagccaagatcgcaccactgcactccagcctggacagtaaagcgagactccgtctccaaaaaaaaaaaaaagatatgttttttctctccatatcctgaacttccccaccagaatgcctcctggaccccgcaacaggcaagtgcttttctttcggccttcttgcctctgccaccaccattttaattctccctctctggtaaatactgggccctccctcgtttctccctctctcccagtggatttttcaaaaacatatgataatattggcagcagctggatggtgttgaattggcaaccaaaactttttgtttgtttgtttgtttgtttgagacagagtcttattctgtctcccagactggagtgcagtggcatggtcatagtccactgccgccttgaactcctgggctcaagtaatcctcccacctcagcctccaaaagcacagggaccacagacatgagcccaccatgcccaacctcaaaactttccttatcctgccagagaaaaaaaatgaagttgtgaataatcgttgtgggaattcagggaccctgaatggagggaccggctgaagccatggaagaagaacataaattatgaagatttcatggacatttattagttccccaaattaatacttttataatttcttatgcctgtctttactgtaatctctgaacataaattgtgaagatttcatggacacttatcacttccccagtcaatacccttgtgatttcctaggcctgtctttactttaatctcttaatcccatcatcttcgtaagctgaggaggatgtatgtcgcctcaggaccctgtgatgattttgttaactgcacaaattgtttgtagagcatgtgtgtttgaacaatatgaaatctgggcacctagaaaaaagaacaggataacagcaatgttcagggaacaagagagataaccttaaactctgactgccggtgagccaggcggaacagagccgtatttctcttctttcaaaagcaaatgggagaaatattgctgaattctttttctcagcaaggaacatccctgagaaagagaaagcatccctgagggtaggcctctgaaatggccgctttgggggtggctgggcatggtggcatgtgcctgtagactactcaggaggctgaggcaggaggattgcttgagcccaggaggttaaggctgaagtgagctgtgactgtgccactgcactccagcctgggcaacagagtgagaccctgtctaaaaaaatatatatatacacatacacacatgcactataaatatatagtatatacatactatacacacacatatagtgtatacatgctatatacacacatatagtacatacaagctatatgtatatacagatcgcagctgtagggatgaaataagccccagtctcctgtagccctcccaggcttattaggacgaggaaattcccgcctaataaattttggtcagaccagttgtctgctctcaaaccctgtttcctgataagatgttatcaatgacagtgcctgcccgaaacttcattagcaattctaatttctccccggtcctgtggtcctgtgatctcgccctgcctccatttaccttgtgatattctattaccttgtgaagcatgtgatctctgtgacccacaccctatttgtacactccctccccttttgaaaatcgcttataaaaacttgctagttttatggctcagggggcatcacggaacctgccgacatgtgatgtctcccccagacacccagctttaaaatttctctcttttgtactctgtccctttatttctcagaccggccaacacttaggggaaatagaaaataacctacgtgaaatattggggatgaattttgcccaatatctggctgaatttcccctgataaataataatgtgtaatttatcatttttgttcatattacatacatacatatgcagtcaaggtgtttttggggtcaaaacatcaaccagatcacaacagtgcgttcaaaacaccatcataacagccaaacactaaaattgaatgaaatctacatggaggctgaggtgggaggattgcttgagcccaggagttggaggctgcagtaagctgtgatcatgcaactgctctccagccgggtccacagagcaagaccctgtttctaaaaaataaataaataaataaataaatgtttaaaaaacttaaagaagaaaacgcgaaagaggcagaggaagaggaagaaggaaaaaagagaggaagaaggaaaaaagaaggaagaaagaaaaaaggaaggaaggagaaaaaaggaaaaagaaaggaaggaaggaaggagaaaggaaatatggaagaaagaaagaaagaagaaggaaggaaggaaggaaggaagaaagaaagaaagaaagaaagaaagaaagaaagaaagaaagaaagaaagaaagaaagaaagaaaagagaaacaaagggctaagttacattcccgagaaaatctgactggagcctgggcaacatagcaaaacactgtctctgcaaaaaatttttaaaaattagctgggcatggtggcatgtgcctgtaggttactcaggaggctgacgcaggaggattgcttgagcccaggaggtcaaggctgaagtgagctgtgattgtgccactgcactccagcctgggcaacagaatgagaccctgtctaaatatatatataatatatattacatatatatataatttatatatatattatatatattatatatacattatatatataatatatataatttatatatatatattatatattatatatacattatatatataatatatataatatatatatacacacacatccactgtaaatatatagtatatacatactatatgcacacatatagtatatacatgctatatacacacatatagtacatataagctatatacacccatatagtacatacaagtggtatacacacacatataggatatacatgctatatatactcatatagtacgtgctacatatacacatatatagtatatactatatagtatgtatatgctacatagtatatagtatatacacacatatgtatatagtatatacatgtagtatatatacacatatgtatgtatgtatatatgtatatatagtatatattgtatatatactacgtatatatagtatatattgtatgtatactacgtatatatagtatatattgtatgtatactacgtatatatagtatatattgtatgtatactacgtatatatagtatatgtcgtatatatcatatatatactatgtatatatagtatatatcgtatatatcatatatatactatgtatatatagtatatatcgtatatatgctacgtatatatcttatatatgctacgtatatatagtatatattgtgtatatactactgtatatatggtatatgttgtgtatatactactgtatatagtacatatacaatatatactatatatgtatatacagaatatatacatatatgtatatacacaatatatacatatatgtgtatacacagcatatattttatatgtatatacacagtatatactgtatatgtatatatatacacacagtatgtactgtatatgtatatatacagtatatactatatatgtatatatactgtatatactatatactgtatattctataatacagtatgtacatgctatttatcgtatgtatatactataatacagtgtatacatgctatttatcgtatgtatatactataatacagtgtatacatgctatttattgtatgtatatactataatacagtatatacatgctatttatcatatgtatatactatatttgtgtatagtatgtatatactatatgtgtgtatagtatgtatatactatatgtgtgtatagtatgtatatactatatgtgtgtatagtatgtatatactatatatgtatagtgtgcatgtgtgtgtgcatgtgtgtgtgtatatatgtatgttttttttagccagggtctctgttgcctaggctggagtgcagtggcacaatcacagctcacttcagccttgacctcctgggctcaagcaatcctcctgcctcagcctcctgagtagcttacaggcacatgccaccatgcccagcatatacatatagtatgtatattctgtatgtataatatgtatatactatatatgtatgtataacgggtcaagtgctccgtttaactgtgattctaggactttctatgctggcccaactctggcatcttgcaccactttcccatgattcttcccttagggtggcctgcccgcatgtgtagtgctttcttcatgctggggaagtgagcatgtgcagtatgtttagcaagctgtacgcatgcccatctgagactttcttccctttcctagcagagagccccacaggaggtcatactccgccattttgtctcttaatgcaaatgctcagactcccttgcccaatacctgagattttattagaatccctttctgcttctcctggcacttgccttcaattaacactctaatataaccgctgcagaccatcaggagattgtctctcgctggcgccagctgctgaattatcattttgagagaggcagtgtgatcattgttgaaccagcacctgatggtctcctgacattcctggtgggtcaggggagagccctctcctgccccactcatgcctgtctacctgtaacaggctgaagaatggaccccaacagaagtacaccctaatcctcagaatttgtactatgtcaccttagatggcaaagtctataatcacaggtcatagactttcctggagtattgggagttagctcagtctaatcacacaagccctcaaaagcagagcactttccccagctggaataaaagatgtagcagagggggaagtcagaccccaagtgtaaggatttgatgtactcttgctagctctgaaatgtaggggccccatgcaagggcccaagagagacctctaggagctatggatggacctcagtacacagccagcaaagaaatgggaacctcagttcttgagctgtgaagaactgcattctgccagcaataggagtgggcttggaagtgaattctcccttgtgcctcccaacaagagcccaggggctgcaccttgatttcagccttgtgaaacccagagtagagagccagtggagcccactcaggcttctgacctactgaattgggagctaacaaatgtgccttatttaaagttgctacgtctttttttgttttgtttcattttgtatgagacagagtctggctttgttgcccaggctggagtgcagtggcatgatctttgctcactgcaacctctgtctcccaggttcaagcgattctctgattctcctgcctcagcctcctgagtagctgggattacaggcgcccaccatcatgcccggctaatttttgtattttaagtaaagatggggtttcaccatgttggccacgctgacctcgagctcctgacttcaagtgacccgcctgcctggcctcccaaagtgctgagattacagacatgagccattgtgcctggccctagagttgctacatctttatcattgttacagcagcaacagaaaactagcagtcatttagtaaaattaggtatttagctcctgaagaatagggaatataggctggaggatagataatatattatgtaccccttgtcaagaaatgttacaagtgaatgaatgaacagggcaaggaaggtgatttattgatcttggtagccttccctaccccacacagctatgtttctggtggacatgaactgaataaatcaaatattcagttagtccccagggaatgagaagggcatatatagagttagaacagagctgaatgcattctgaaatcacaataggaaacagatgtgagagtttacaggctgcagactcatgggcaatatacacatcttctattcagtctaacataccccagcttttctctgtacagtctagggttttcctctgcaccattggttttatttctcctacttgactcacccatcagaaatggttgttggccagtggttcatgcctgtaatgccagtactttgggaggccagctgatcagttgaggtcaggagttcgagaccagcctgagcaacatgatgaaaccccgtctctactaaaaatacaaaaattagccgggcatggtggcgggtgcctgtaatcccagcgacttgggagtctgagacaggagaatagcttgaacccaggacttggaggttgtggtgagctgggatcacaccactgcactccaacctggacagagcaagactctgtttcaaagaaaaaaagaaaagaaaagaaatgaaatttttttttttttacttttaagttcaggggtgcacgtgccagtttgttatataggtaaacttgtgtcatggggggttgttgtacagattagtacattaccaaggtactaagcctagtagccattagttatttttcctgatcctctccctcctcctaccctctaccctccaaaaggccacagtgtgtgttgtttccctctatgtgtccatgtgttctcaccatttagctcctacttctaagagagaacacgtggttatttggtgtctgttcctgcgttcctttgctaaggacagtggcctccagttccacccacgttgctgcaaaggacatgatctcgttctttttttatagccgtgattcataagcacactgaagtttgagcccacactctaaagattagagcacattggcaacatggcctgcagatgtatgggattcttagattcatattcgtagtgtttgtgttcctcggtgtacaagcctggctgaacacctcgactatacagaataaggtttccagcaaataggcagagaagccggcagaaagggagatgggggaacaggggggcttagcatcgtgtttttgtttttgtttttgttttgaggcagggtctcactctgtggcccaggctggatgcagtggccccatctcacctcactgtagcctctacctccctggctcaagcaatcctcccatctcagcctcccaggtagctgggactacggttgtgtgtcaccacgacccactaattttgtttattttttctgcagacagggtctccctatgttgcctaggctggtcctgaattcctgggctgaagtgatccaccctcctcagcctcccaaagtgctgggattacaggcatgagccaccatgcgtgacccctggcctgttgttttaaaagcactgaaaccttaagaacataagcccttcattataaggaatgatgttgccttataaaagatgatgacaaatttgcttcataaaatgaagaaaagatttaaaaatactctttactgcttcctacaggaaatctgagaaagttaataaacactgagcaagggaggccagcatggtggcttacacctgtaatcccagcactttgggaggcagaggtgggaggatcgcttaagtccaggagttcaagaccagcctgagcaacatagcaagaccctgtctctataaaaaataaaaaattagcaaggcgtggtggtgcagacctgtgggcccaggtacttgggagactgaagtgggaggatcgcttgagcccaagaggtcaaggctgcagtgagctgtgattgtgacactgcattccaccctgggcaacagagtgaggccctgtctctattaaaaacaaaaaacagggccaggcacagaggctcacacctataatcccagcactttgggaggctgaggcgggtggatcatgaggtcaggagcttgagaccgtcctggctaacacggtaaatccccatctctactaaaaatacaaaaaaacgagcctgtagtcccagctactcaggagactgagggaggagaattgtttgaacgcaggaggcagaggttgcagtgagctgagaccgcactactgcactccagcctgggtgacagagtgagactccatctcaaaaagaaaaacaggctgggcatggtggctcatgcctgtaatcccagcactttgggaggctaaggcaggcaaatcacttgaggttaggagttcaagaccagcctggccaacatggtgaaacccatctctactaaataaaataaaaaaaaatcagccaggtatggtggtgggtactgtacttccagctactcaggaggctgaggcaggagaattgcttgtaactggtgaggcagaggttgcagtgagctgagatcatgctactgcactccagcctggcgtgacagagcaagactccatctcaaaaaataaataaataaataaataaataaataaataaataaaattaaaataaaaaacaaaagcactggtgagtgaagccattttgggcattctactgcaacccagctgccagcttaatgtagcaagtgagtggaccccaaccaacaccacctggagcagaagaaccaacaagctgagccctgcccatattcgtgaccctcagaattgtaaaccaaaaagtatctgagacaggtctcaatcaatgtaggttaaggacatgcctggaaaaaataaacacagactcacagaagcaatcatctgtggcctctgcctttctccaaagatgattttgagggcttcagtgtttaaaggggaaaagcaggcttcaggcgaaaagggagggtgtggtcatccacatgctgcgagagaaaaggagcaggtaggggaatcatcaattatgtattcatctagtgcccagtaaatcagcactttattttttatttttgtatatatattttaggcagggtctcactccatcacccaggctagagtgcagtggtgtgaactcagctcactgcaacctccgccctccaggttcaagtgattctcttgcctcagcctcccaagtagctggaatcataggcacccaccaccacacccagctaatttttgtatttttaggagagacggggtttttgccatgttgcccgggctggtctcgaactcctgagctcaaggcatctgcccaccttggcctcccaaggtgttaggattacaggtgtgagccactgcactttatgtagataaggtgaatgcagagtagcaacctgaggaggtgtttaacctttgatctgtagctgtctgcttcagaacaaaaggaaagacagtttcattcatgactcagctttcagcttaatgtttttcttttggcagagtgaattggggtccgagtatttatttttccttcacagaatcatgagaaattataaatcattgttgtattatgccattaagttttggggtagtcgattatgcagtagataactggagcaaataattaaagagaatcttgttcatttatgtagaaatgtgtatttagtacccactgtaaaccaaaaataaaattctaagccccccaaccatctgaatggacccctcttctcagccaagggcattccaaagtaacctgaaaaaccagttcaggccatgatgggaagtggggttggacatgcctcatgatgccctcctccctttggaattcaggaaaagcggaacagcattaacatcaacacagaccttaggtctgttgaaacatttacaatctattctctctgaagtctgctacttggaggcttcatctgcataataaactttggtctccacaaccgcttattgtaacacagacatttctttctatggacagtaactctttcaaccaattgccaatcaaaaaagtcttaaatctacataggacctagaagcctccccctccaccacttcaagttgtcccacccttccagatcgaagcgacgtaactcttacatgtattgattgatgccttatgtctcccaaaaatgtataaaagcaagctgtgccacaaccaccttgggcataagtcatcaggacctcctgaggctgtcatgggtgcattcttaagctcagcaaaataaactttctaaactgattgagatctgtgtctcagagacttttgggttcacatcagtatgtgccatataccgttctatgctctaggaatatagaattgtatagcatatagaatataaaatccgtgccttcacagagcttctattcaagggtggaagtgtgtgtgtattcatgtgcgtgtgtgtgagaatgtgtgtgcatttgcgtgtgcacacgtgtgtgtgcacgtgtgtgtgtgcttctattcaagggtggaagtgtgcgtgtattcatgtgcgtgtgtgtgagcatgtgtgtgcatttgtgtgtgtgcatatgtgtgtgcacgcatgtgtgtgtgtgtgtgtgtaagaaacaaacaagataaaagagaaaggccaggcactgtggctacacctgtaactgctgtgttttgggaggccaaggtgggaggatcacttgaggccaggtgttccaggccagcctgagcaacatagctgggatctacaaaaaatctttttaggctgggcgcggtggctcacgcccgtaatcccagcactttgggaggccgaggccggcggatcacgaggtcaggagatcgagaccatcctggctaacacggtgaaaccccgtctctaccaaaaatacaaaaaattagcctggcgtggtggcgggcacctgcagtcccagctacttgggaggctgaggcaggagaatggcgtgaacccgggaggcggagctttcagtgagccaagatcgcgccactgcactccagcctgggcgacagagcaagactctgtccaaaaaaaaaaaaaaaaacaaaaaaaactttttaaattagccaggtgcggtggcatgtgcctgtagtcccagctactcaggaggctgaggcaggagtattgcttaagcccaggagtccaggaggctgtactgagatctgatcacatcactgcactccagcctggacaacagagcaaggacccatctcccaaaaaaacaaaacaaaacaaaacaaaacaaacaaacaaaaaaacaaaacatataataagttctgggtgtgaagtgctccagagaaaaatgacgcaggaaaaggggacagagggtgtcggggcaggtgcagtttcaggcaggtcgactgggaaaagcatcactgagatgatgccatggagatgccactgtgggcctcccagatccttctggggcctcagggactccctgctcactgctccgcgtgttgccggagccacggcgttcacctgagtccctggctaagcactgcttcctgggggtggctgcatgccgcgatgcccactgctgtgaagtgggagaactccagcggcagcgcggatgtcagagctcagggcaggagcacctcagtgaggccttggtggtcaaacccacttcccaatcccactttcttctctcctccctgagtgtcaaccctcccaataacttcctgtttcccaggaactggacccaagacagatgggaatgggggaaggagactagccatgctttccacgcagggagaacggagaagggcaagggcggagcagagggctcagggagcccgcagagggttaggtggctcctccgcgccaacctccaagcaaaaccctgacagcggccgggcgcggtggctcacacctgtaatcccagcactttgggaggccgaggcgggtggatcacgaggtcaggagatcgagaccatcctggctaacacggtgaaaccccgtctctagcaaaaatacaaaaaattagccgggcgtggtggcggccgcctgtagtcccagctactcgggaggccgaggcaggagaatggcgtgaacccgggaggcggagcttgcagtgagccgagatcgcgcccctgcactccagcctgggcgacatagcgagactccgtctcaaaaaaaaaacaaaacaaaaaaaacaaaaaacaacaaaaccctgacagcagcagcggggcctgcgcactccgagctcagccagcgcctctcaggcctcatccctgctaccctggcatcctctgcaggaattgctctgtccccacagggaccagctctgtcccgtgccttcttcggggttttggttccatgacgtttctgtgaggcttcttcagacccatccggttaaaaattgccaccccctttgaactgctctatgcacagcacttcagacaagagactcgcaggcttttctaccccagcaacccagtctccagctctccagaccccagcagagtgtccaacggttccattccattctgccctgaactacctggaattggtccagaccccacaggtcagggactcagcccacaagacggccccgcacttcagatgccaatcacagatcggggcctccagtgcgtctgactgactggccattaatagaaggctcctacagcccctccctcctcaagtttgataatttgctagaatgcgtcacagaacacagggaagtgctttacttactattactactttattacaaaggcttcaactcaggaacagccacaaagaagaggtgcacagggccaggtaaggatgggaggggcgtgcagggggtctcaggaccagactaggcagcacctcttggcctactgaaatgctaaatctgaaaatgatcttgaagatgaatccttgtgtgtgtgtgtgtgtgtgtgtgtgtgtgtgtgtgtgtgacaaggtctcattctgtcacccaggctggagtgcagtggtgcaatcgtggttcactgcagcctcaacctcctgggctcaagcgatcctcccacctcagcctcccaggtagctgggactacaggctcatgccaccagccctagctaattttgtttttctgtagagatggggtctcactgtgttgcccaggcaacaatgcattgtccaggccttctccctaccagctgctcctctcactgcctcctggcgttcaccaacccagaagctcgcagagccccgtcattcagggttttatggagagcccattcgggagacatgattgctgtcattggccagtggtgattaatgcaatctgcaaccaccagagatcgagggtggagctgaaagtcccaaccctctaatcccaaggttggttcccctggcaaccagtccccatctaggggcaacctgggaccctccaggagtcacctcattagcataaacactagaacgggtgaaagggcctgttctgaataacaaaagccgctattgccccatcacttggaaattccaaggatttcagaagccctgttttgggaacccagaggaagaccgaaggcacgttattgcccacctgggagaccctcaccatcccctcccctgtgcgcttttcccgctgcacctgcagcctcctcaggctctgctcaacacatggacgtctgctgtttcttacctgccttcctcctcaaaaacctacgggcagggatttttgtctgctttgttcacaaattatcttccatacctagaatggtgcctggcacacttaaggttttttgtttgtctgttttttgttttctggttttttgtttgtttgttttttgtttgtttgtttttgacaaagtatcactctgtcacccagactggagtgcggtggtgcacgatcttggctcactgcaacctctgcctcccaagttcaagtgtttctcctgcttcagcctcctgagtagctaggattacaggcgcccgccaccacacaggctgatttttgtatttttagtagagacacggttccgccatgttgcccaggctggtcttgaactcctgacttcaggtgagccacacacagcctcccaaagtgctgagattacaggtgtgagccaccatacccgacacacatgaggtttttaatatttgctgagtgaatgaataaagaaaaaggttacactgcaaaatttgcttagtacgtttatccattcaaaagtaaatgggtgagtaaatgtggtgggtgagttatggcaaattacaagtttgtgaacttcacagccttcatttgcagagtgaatactttggttccgatcacattcgtggcttaatttaataagcgctcaccctgtgtgggtatcacaggctgcggattcttcttgcctgctgtcctggaggagccaatgagaacagcaggtgccacagcaaagaacgagttaatcatcagagggccagccacacaaggggaactgggagaaacttctcaagctcctctccctgcgacttggaggctcagatttttaaaagatactttgacaggcaggggtctggggaactggaacaactgactggctgggtatgaaatcccaggagtgtgtttgcacaggtgagtccgttcccaggaggggaaggggattctcaggactaggtggcatctcttggtctaccaaaatgcaaaatctgaaaacgatctcgaagaccaattctcttttttttttttttttttttttgagacagagtcttggtctgtggcccaggctggagtgcagtggcatgatctcggctcactgcaacctctgcctcctgggttcaaacaattctcctgtctcagcctcccaagtagctggaattataggcacccaccatcacgcccagctaattttttgtatttttagtagagatggggtttcaccgtgttggccaggctagtctcaaactcctgacctcaggtgatccgcccacctcagcctcccaaagtgctgggattacaggcgtgagccactgcacctggctgtcttttttctttttcttttcttttctttttttttaaagatatgttctcactctgttacccaggctggagtggagtggtgcaatcatggctcactgcagtctctacctcctgggctcaagtggtcctcccccatcagcctcccaagtagctgggactacaggcgcatgccactacacctggctaattttgttgtttatagagatggggatctcactctgttgcccaggctggtctcaaactcctgagctcaagagatccttctgcctcagcctcccaaagtgctggaattacaggcatgagccaccgcatccggcctcaaagaccagttctttaggattcacaatagtgctgttatctataggagcagttggggaagttacaaattttgtgacaccccacccccagttatgtgaccagggcagtcagcaacttctaggaaaagacgtcaagcagtcggaggtcatcctttaactctgcctattctttttttttttttttttttgagacaaagtcttgctctctctcccagtctggagtgcagtggtgtgatctcagctcactgcaagctccgcctcccaggttcacaccattctcctgcctcagcctcccaagtagctgggactacaggcgactgccaccacacccagctaatgttttgtatttttagtagagacggggtttcaccgtgttagccaggatggtctcgagctcctgacctcgtgatctacccgcctcggcctcccaaagtgctgggattacaggcatgagccaccacacccagccaactgtgcctattctttagcaaagtccaagccactaccataatttttaactttgcctcatgaatgaggcttcaatctccggacaagagggtgtcagtttcccttgcctccaagtttcataaactaaatccctttcatagttatcatggcctctgtgctagaataagaaataaaaaatatttagcctgtgaggttagaagcaagatggagtccgtcatgttaggtttctcttgttgtttataattctgcaaaggcagtttctctatacagcattctaacccattcaatctcctgtcacccctaggaggaggcttctgttcagcagcaatttggatacaaacccagcaaggttcctattttaaaatcctggctgagagtagcggctcgtgcctgcaatcccagcactttggagtctgaattggaaggatctcttgaggacaggagttcaagaccagcctgggcaacatggagaaacccctgtgtctacaaaaatgtttttagttaaaaataaataaataaaattctgtgatttcaaagtattgcatttttctggacttatgaaataatagggaaaatttaaaattcatccccattcccccatttacagtcctaaagaattgacaatatcagtcaaccatagcagtgtttcttctgcttgtaagttcaaggctggcttagaattcattgtgtcttctcctcatcctggatacagaatgtaaatttaagtgggtatgaagctttaatgatatctgaaaatccaatcgccttgcttatcattattgtagaatataataaattcctctttaaaggttttagcctgtacattgtttagtacaatgagttctgagatcctctccaaagaaccaatgtatccgtatgttcagctccctcgttctttgttcttcattttaaagtttaacttcctcgttctcttcatctgcttgcccctagtttcaataaacaaccccctcctagcctctatcacctgctctgaccttagtcacccttgtcccctgctctgaccttagtcatccttggtgacctgctctgttcttagtcatcctgagtcacctgttctgtaaccatccttctcaccaaactactcccctgccactccgactcgtacccctgctgtctttaaaatagccaatcagaattagcttagactgtgcagtccaaccctagccaacaggagaaccacacagcagtaggggctacctgtgtcagggataagaactccttcccctcccttgtccaggtgtgctttcaccattgctccatccgtgagacacacccttctatagtagtaaattgccttgctgagaaaatttatgctcgagtgctatttcttttgcagcaccaaaaatttatttctaacaattatgcaaagtttaagtttagaaataagctatcctaggctgggcgcagtggctcacacctgtaatcccagcactttgggaggccaagtcgggtggatcacgaggtcaggagttcaagaccagcctggccaagatggtgaaaccccgtctctactaaaaatacaaaaattagccgggtgcggtggcaggtgcctgtaatcccagctactcgggaggctgaggcaggagaattgcttgaacccaagtggcagaggttgcagtgagcagagattgcaccattgcactccagcctgggcaacaaagtaagactccatctcaaaaaaagaaataagctatcctttttaaagatgaggccgaatatgttatctggaaatagctttcaaaatacgatgtcacttgctgtatcaggttcatatgcctgctgtcagaaattgctgtaaagttagtggcctaaagcaacacagatttgccatcttgcagttgtggggatcagacatcaggtgcaggcatccgtggagtgacgggggctgctttctgccagctcccaagaagaatccatttcctcgcctttcctggcctccagaggtacccacatgtcctagctcctgacccatcctccatcttcagtgccagcaacgtggcaccgctctgacccttctccatgcatctttttctctgaccaccatcagaaataggctccacttttgaggagtcaactgattagacagagtagagttgcacaatccaggatcatctccccatctgaaaatctgtacctttcatgcaaatacaaattctctctcgccatggaaggggacattgacactttccagcgaccagggcagggacctccttgtggccattattggctaccacagttttcagagaattatttcatgtatcagtttatgtgaatgagaaggaaacagcatgaacttcttcacacatcttgacttttgtttaacttgtttatttatttacttacttatttatagaggctggtctcgaactcctgggctcaagtgatcctcccaccttggcctcccaaagtactgggattacacgcgtgagccaccacacccagggactttccacattaaccaatcaaatattttctatttattttaaatagaatttaaaaattgaaaccacggtgtgacaccattttcccaacttctagtgaaaacagaaatagaaaacacacactttcagttgggcatggtgactcatgcctgtaattccagctactcaggagtctgaggtgggagggtcccctggtcccagtagtttcagggacacctgggcaacatagtgagacccgatctctattaaaaaaaaagaaaaaaaggccaggcactgtggctcacgcctgtaatcccagcactttgggaggccaaggcaagaggatcacttgaggtcaggagttcaagaccagcctggccaacatggcaaaaccctgtctctattaaaaatacaaaaagattagccaggcatggtggtgggtgcctgtaatcccagctacttgggaggctgaggcaggagaattgcttgaacccaggaggcagaggttgcagtgagccaagattgcaccactgcactctagcctgggtgacagagctagactacatcttacaaaaaaaaaaaaaaaatacacacctctttggcctagcaattcccttttaggaatctaaagatccataaaataaaagccccagtgtgcaagcacatatgtttaaggctattaactgctgcattgttttcgtgggaaagcgagctagaaaagcctgaaggtctattggtagtggaaggtctgaataacttgggcttcagcaatgcagtgactcttgtgtacagcagagagtcatatcagatgagccagcagtgctgcggctgccccacctccacccaggtgaggtcatgtaccaggctcctgaaacacactgtggggacccacaggggaaagcggccacccggctagccttcaactcgtgccctggttctgaactattctaccaaagtatattctgaatttatatataagcaaatataatatatttacatgtgtatgtaaatacacatatatgtatttcattttgttttgttttttgaggtggagtctccctctatcacccaggccagagtgcagtggcacaatctcggctcactgcaacctcctcctcctgggttcaaacgattctcttgcctcagcctcctgagtagctgggactacaggaacatgccacaacatctggctaatttttgtatttttagtagagatggagtttcaccatgttggccaggctggtctcaaactcctgacctcaggtggtctgcccacctaggcctcccaaactgctgtgattacaagtgtgatccactgtgcccgaccaatatacaagtgtttatttatttatttttatttttttgaggtggggtctcgctctgttgcccaggctggagtgcagtggtgcaaccttgggtcactgcaacctctgcttcccattctcaagcaattctcctgactcagcctcgcgagtagctgggattacaggcgcgcaccatcacacccagctaatttttatattttagtacagacggggtttcgccatgttggccaggatggtctcgaactcctgacctcaagtgatccacccgcctcggcctcccaaagtgctgggattacaggcgtgagccaccatgtgcctggccagtatacacatatttctaaaacctgtgctgtgggttgaattgtgtctctcaaagatgtgttgaagttcttctcccctgtacccatgaatgtggcctgttttggaaatagggtctttacagaggtaatggagttaagatgaggtcatcagggtgggccctaatctggtgactggagtccttctaaggaaagacagagacggagatacacagagacagagacgcctcacattcacaggcgacagggagacactcagggaaaagactgccacgtgactggagtgatatgtctacaagccaaggagaaccaagggttgcccgcaatgccagaggctaagagaaaggcacaggacggagtctcccctcgagacgccagagggccacggccctgcccacacctcaatttcaggcttctaccctcctgaactgtgaaagaataaatttctgttattgtaagttactggtgtgtggtgttttgttatggcagccctgggaagctgatggtaccctataattatcttatgaatagcacagttatgtggcactgggtgttggtatgtcttagaagagtcagtaaaagcaagaattcaaaatggtccacaatttttgaaaccctaaaaataatactgaaaatttaactatatagtggaagatgtaataggtacattttgaaactctatgtctgtgaagtgccccaggcatctctcaacctttgagaagttctgttatattcttatgctttcctacatttttttctgtcctccttaattagactagattctcctaaagtgacaggtaacactgaatgaaagatgttactggctgggtgccatggctcacgcctgtaatcccagcactttgggaggctgaggaggtcgaattacctgaggttaggagttcgagatcagcctggccaacatggtgaaaccccatctctactaaaaatacaaaaattagccaagcatggtaggatacctgtaatcccagctactcaggaggctgaggcaagtaaatcgcttgaacccaggatggggaggttgcagtgaactgagattgtgccactgcactccagcctgggtaacaaagcgatactccatctcaaaataaaaaataaaaaacacattactgttggccctaacgggggcagttgtcttattccatttaggctgttataacagaataccatacattgagtggcttataaacaatagaaactcctttctcatagttctggaggctgggaagtccaagatcaaggcaccagcacatagggtgtctgctgaggacccactgtcttgttcaaagatggtgccttctggttcatagacttttcactgctatagtctccattggatttgataaattgaaaaaagtgaattatagattatataattcataaatgtattgttaaatatactttaaaagattaccaaaaacagcgatatgtggaaatagtcaaagaacccagaaaaatacacccaataagtgaattaataatagagttcatttaacaacaacatatacagaaataaaagtactagcaatgaaaacacacaaagttgtaaattatattgtgccatgcacaaaattaagaatttttttttttttttttttgagacagagtcttgctctgtcacccaggctggagtgcagtggtgtaatctcggctaactacaaccttcacctcccgggttcaagtgattcccctgcctcagcctcccaagtagctaggactacagccatgcaccacctcacccagctaatttttgtatttttagtagagacgggtttttaccatgttggccaagatggtctcgatctcttgaccttgtgatctgcccaccgcagcctcccaaagtgctgggattacaggcgtgagccactgtgcccagccaaaattaagaatttttaacattcattcattggcagcgttttgccatattgcccaggctggtcttgaactcaggtggtggaatgggtgagggagctccctggtgtccctttgttaaaggcactaatcctattcgtgagggccccaccctcttgacctaatcacctttcaaaggccccacctcctaataccatcaccttcagggttaggatcagaacagatgagttttgggggaggaaacattcagaccacagcagaggctccttgccctcaccctaaccccgagcttccacaataacaaagccagcatgttcgcctctctgcacctggctgagccctcctccttctctcctgtgctcacctgcctcagccagctgggttccttgctgtcccaggacagctccaggcagtctcccgccttggggcctttgcacttgcccctcccttttgctggaattctcttcctccaaatatctgcatggctccttccttcaccttctgtgggtctctgctcaaacattaccatcttagggaaggtctcttgggcacccgacctgcacaaccacctccttccttcgaccgtctgtatgttttttgtttgtttgtttgtttgttttgagatggagtctccctctgttgcccaggctggagtgcagtggtgcaatctcggctcactgcaacctccgcctcctggattcaagcaattctcctgcctcagcctcctgagtagctgggattacaggtgctcgccaccacacctgggtaatttttgtatttttagtagagatggggttccaccatgttggccaggctggtcttgaactcctgacctcagattatccacccgcctcggcctcccaaagtgctggattacaggggtgagccacggcgcccggcctgtatgttcttttttacacagagtctcactctctgtcacccaggctagagtgcagtggcgggatctcagttcactgcaacctctgccttgcaggctcaagcagctttcctgtctcagcctcccgagtaatcaggactacaggtacacaccaccatgcccagctaatttttgtatatactgtaaagatggagtgtcaccagcccaggctggtcataaactcctggcctcaagtgatccacccacctgagcttcccaaagtgctgggattacagttgtgagaccggcctgtattttctttaactactttatttttcaccttagtaattatcactatttcatagatgttacttaattctcaggttcgttttctgtctgttttactgaatgtcccagtccctggagagtgcctggtacacagcagatgctcaataaatattaggtgggtgaactaatacatctgtgcatttttcatccctcttagactcagtagagtttcgcaactcaaacagttcagggctcaggcaggtaagcaaacatgcagaacaggctgagcaccagatgacaaggggcaaatggcttgaggcctgcgtctgagatttaacagggaatggcgggctaggggcaatggcagctggcagcatttgccccgtctgtagggggcagtggctatatacctccagaaggttgtagccacacaagaaaggaggctcaatgccttccaatcttattatgattttcaaaggaatccagatacctggattttatgtgaaatatccttttctttcatattagttatctattactgtgtaacaaagtactcagtacattaacaaagtacattaacaaagttaatggcttgaaacaacaatcaaccctttttatctcacacagtttctatgtgacttaactggatccaggtctcatgaaatttgcaggtaaaatgtcagctaaggctacagtcacctgaaggctggaccagcgctggaagattttatttcaggatggcgcgctcatgtggctggcaggttttccagtgttttgctttgtttttttgagaccaggtctctctctgttgctcaggctggagggcagtggcaggatcatagctcactgcagccttgatgtcctgggcccaagcaatactctggcctcagcctcctgagtagctgggactacaggcgcagaccatcacgcttagctaaatttttttatttttattttttgtagagacagggtctcactatgttgccctggctggactcaaactcctgggttcaagtaattctcctgctttggcctcccaaagtgctggggttacagggatgagccaccgcacctggctggctggcgggtttatatgggctctttgcagtggacttcagatttttgtcacaagaacctgtccatagggctgtgtttgtcctcacaatacggtgaccaggtccacacagagtgagtgattctagccacagagcccctgtgacctactttccaaagtaacacactgtcaattatgacatattccacttgttataaataagttgctaagtccagcccacactcaaggagacattaattagaatcaaccttttcaatggagggggatcaaagaatttccagacataaaaccatccaatcttaaaacgctgtcaatgagttcagatggaaagcatgttgttactcaccccagcacaggtcagatgacgcccttgaaggttctgtttcgtatgggccaccaaagagtacactcagcactattttcatctttatttattttttattttttaaatatttatttaaattttttttttattttttaaattaaaaaaaaaaatacaggctggacacggtgactcatgcctgtaatcccagcactttgggaggctgaggtgggtggatcacctgaggtcaggagttcaagaccagcctggccaacatggtgaaaccccgtctctactaaaaatacaaaaattagccaggcatggtggcacatgcctgtagtcctaactattccagaggctgaggcaggagaatcgcttgaacccaggaggcagaggttgcagtgagctgagctgagatcatgccactatacaccagcctgggtgacagagtgagactctgtctaaaaaaaaaaaagataaaataaaattttaaaagattttaaacaattctatttaaacattttattaaaaccttaagggccgggcaaggtggctcacacccgtaatcccagcactttgggaggctgaggcgggcggatcatgaggtcaggagatcgagaccatcctggctaacacggtgaaaccctgtctctactaaaaatacaaaaaaattagccgggtgtggtggtgggcacctgtagtcccagctacacgggaggctgaggcaggagaatggcgtgaacctgggaggcagggcttgcagtgagcccagatcgcactattgcactccagcctgggcaacagaacgagactccatctcaaaaaaaaaccttaaaaaatatagagacgaggtctcactatgttgcccaagctggtcttgacctcctggattcaagtgatcctcccacctcagcctcccaaagtgctgggattacaggcataagccactgtgtccagcctttatttttaaattaaaaaaaaattttgagtcagggtcacgctctgtcacccaggctggagtgcagtgtatgcaaagattagtctttgccatgaagtaccattattaacattcaataggcctgcatatttattattattattatttttttttgataagagtcttgctctgttgcgaggctggagtgcagtggctcaatctcagctcactgcaacctccgcctcccgggtgtctcatgggttcaagcaattctcctgcctcagcctcccgagtaactgggattacaggcacccgccaccatgcctggctaattttttgtatttttggtagagatggggtttcgccttgttggccaggctggtctcgaacctctggcctcaggtagtccacctgcctcagcctcccaaagtgctaggattacaggcgtgagccaccatgcctggcctattattttcattagaatataatgctgctgtgtctcattcctctttctgtattcagaaggggtcaagagtcattcattcacctagaaggcacacacctgtaatccaagctacttgggaagctaagagaagaggttcatttgagcccaggagttcgaggctgcagtgagctatgatcatgccactgtactccagcccgggcaacagagcaagactgtgtctctaaaaaacaaaacaaaaaaagagtaatttattcaatatttcaataaatattgtttaagcatacgttatgtgacaggctctgcgctagatactttgaatgtcatgacatggtatgccacttattttagtgaagaaaagaaagattgaaaaacgagcacgtaaataattaagcaatatgttctcaataatgtgctctgaagaaaagaaagtgggtgctgaagtggagaaagcctaggggtggtcaggggactgaaaggtgagaaggagccagccaggctaagatatgtggagaagagcatcttgtttatttgtttatttgagacagggtcttgctttgttgcccaggctggagggcagtggctcgattatggctcactgcagcctccaactctcaggctgaaatgattctcctgcctcagcctcccaagtagctgggattacaggcatgtgccactacacgtggctaatttttgtatttttagtagagacggggtttcaccatattggccaggctggtttgaactcctaacctcaagtgatctgcccgccttggcctcccaaagtgctggcattacaggcatgagccaccgtgcccagccaagggaagatacttttaaacagagggaccagtaagtgcaaaggccctgtggcaggaataaatttggctggggtaagatacagaaagtcttgtgaggttacagggagagaggcaggagacgaggtgggagaggtaggcatgagctagagcccatagtacctccctggctacagatttcatggatctaagtgagacagatagaaaactactgcaggttttaccagtggaggaggatgatctgattttttttttttttgacagagtctcgctctgtcacccaggctggagtgtagtggcgcaatctcggctcactgcaagcttcgcctcccgggttcacgccattctcctgcctcagcctcccgagtaactgggactacagtcacccaccaccatgcccggctaattttttgtatttttagtagagacggggtttcaccatgttagccaggatggtcttgatctcctgacctcatgatccgccaacctcggcctcccaaagtgctgggattacaggtgtgagccaccacaccctgcctctgatatggttttaaaagatcactctgggtcacatgcagtggctcatgcctgttatctcaatactttgagaagttaaggcaggaaaattgtttgtggccagaagtttgagataagcctgggcaatgtagcaagaccccatctctacaaaaaagaaaataaattgctgggtgtggtggtgcctgcctgtattcccagctactcggggggctgaggtgagtggatcatttgaccccaggagctcaaggttgcagtgagtcatgatctcgccactgcactccaaccctggtgacagagaaataccctgtcactacaaaacaaaatccaccctgtgcctcctgatctgagacactaagaaggacacaacatcacttttgtggttttcctacccaaactgcataacctgtatctaatcatgagctagtatcagagaaatccaaatgaaaggacagtctacaaaatacctggcctctaaaatactctgcaaggccaggcgtggtggctcacgcctgtaatcccagcactttagggggcccaggtgggtggatcccctgaggtcaggagtttgagaccagcctggctaacatggtgaaaacccatctctacaaaaaatacaaaaattagccaggtgtggtagcaggcacctgtaatcccagctacacaggaggctgaagcaggagaatcacttgaacccgggaggcagaggttgcagtgagctgagatcgcaccactgcactccaacctgggcgccagagcaagactctgtcttgggggaaaaaaaatactcagccgggcgcggtggctcatgcctataatcccagctactcaggaggctgaggcaggagaatcacttgaacctgggaggcggaagttgcaatgagccgagatcgcaccactgcactccagcctgagcgagagtgaggctgtctcaaaaaaaaaaaaaaaaggaaatagaacattgcaggtaaagttaaagtcttctttgactcctcttctcagttccatcacactccttctacccttctgaagcaataacctgcggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatggggtttcatcatgttggccaggctggtctcaaactcctgacctcaactgatccacccgccttggcctcccaaagtgctgggattacaggcatgagccattgcacctggtctaatattttcttaatttttcatttgtctactgatatttttgacatttttttggtcatgcaattacaattatggctgaatattttttatctttctatcatggtttctggatttctgttggccctgaataggttcctctaatctaagttgtatggatagtcttgtaaatgattttggcattttaattttatttgtttgcatgaaagtgttactctttctggaaattattctgtgtctagagatccaggtccggtttgtctttccttctcccatactgatgacgtgtttgctgcagtggcatttattaagtagcccctccgcccacctcccccgtggcagtgacaaccgtgccctgtgctaatcctcaggcagcagggctccattctgagcgtctgtgctaccttcaacttctccagccctagatccccaggattctgagtggattttgactccgttgtcctctctggtgtgtaatccccctttatttcccaccatttccttggctattcttgaattttttttttttttttttttttttttttttttttttttttttttttttttttttagacaagtcttgctctgttgctcaggctggagtgcagcggtgtggtcttggctcactgcagcctctacctccagggttcaagagattctcctgccccagccactcaagtagctgggactacaggcatgcaccaccaccatgcccggctaacattttctgtatttttagtagagacagggtttcaccatgttgaccaggctggtctcaaactcctgacttcaagtgatccacctgccctggcctcccaaagttctgggattacaggcatgagccatcgcacctgtggaacatttcttatactgtatgtattaaaaccattttatccaattgaaaatgtgattcaattacaatcttaaaaaatatttagaataatgagaggagaatcagtcttctacagttagttttttcatccagggatacagtatctttttccatttgtgtagatcttgtttcacatcctccaatactccaataagatactatgttttaaaattcatcttattctgttattttaacttaaaaaactgtattttgacaaatgaaactttttttttttttgagacagagcctcacttcgttaccaggctggagtgcagtggcgcgatctcggctcgctgcaacctcctcttcccgggctcaagcaattcttctgcctcagcctcccgagtagctgggactacaggcacacgccaccatgccagctaatttttgtatttttagtagagatgaggtttcgccatgttggtcaggctggtctcgatcttgtgacctcgtgatctgcctgcctcagcctcccaaagtgctgagattacaggcatgagccaccgtgcctggccaatttttcttcatttttaagtgttatctggttattgctaacttacagaaaaaaatttaaagactgtatttatctttaatccaagtgtcttcacacactcttgtttcttttgttcattagtttatttttcaggtattttgctttttcaaggtatgtaatcatagagagcaaaagagattatattatcacatttctaatgtttatactgattattttattttctcatattcttaagtatgctgaaattgctaattgataataaatgaaaaggtattagtatttactgttttttaaaaaaattatttgatagagatagggtctcactatgttgcccaggctggggtcaaactcctaggctcaaacgatcctcctgcctcagcctcctgaactgctgggattacagatgtgagccactgtgcctggccagtattcgctgttttaaattatctgtattcttggggtttgacaggtaatttttaacctttaagaaatttatttagaaagactttgttagaaatagttactcaactttatcaactgccttttcagcatctcttcctatgaaatttgttctcccttccttagttatttgatgtaacttttaaatgttgacagattcctgaacatcagtcattcttgaatttctgagaaaaagccctgcttcagtttcatgcttggtcacagtgtttatctgatttatttctgttctctttgttcatttttgtgcctgtatttctatgggtgattgatccacacttttctagttttcaatgaccattgtcaggttctggtgtaaagcccaggcgcggtggcatcacacaggctgagccacagaggctttgggagccggccacctgggcacgggctgaaccacacgggatctgggagccggccgcctgggcacgggctgatccacatgggctctgggagccggccgcctgggcacgggctgaaccacccgggctctgggagccggccgcctgggcacgggctgaaccacccgggatctgggagccggccgcctgggcacgggctgaaccacccgggatctgggagccggccgcctgggcacgggctgaaccacccgggctctgggagccggccgcctgggcacgggctgaaccacccgggatctgggagccggccgcctgggcacgggctgatccacatgggctctgggagccggccgcctgggcacgggctgaaccacccgggatctgggagccggccgcctgggcacgggctgatccacatgggctctgggagccggccgcctgggcacgggctgaaccacacgggatctgggagccggccgcctgggcacgggctgatccacgtgggctctgggagccggccgcctgggcacgggctgatccacgtgggctctgggagccggccgcttgggttcggccccaccccctgcctcttaccagctgtgtgcccaggacacttgctctcttcctttgattgttttgcctgtaaaatgagaatatggtaacatttcctccacatgacttctgtgaggattaaggaagttagaagactggtgtgtagaacactagtacatgttagaaaaatttgcccttttttttgtgtgtgtgagacagggtcttgctctgtcgcccaggctggagtgcagtgtcgtgatcatagctcattgcagacttgaactcaggggctcaagggatcctccacctcagcctcctgagtagctggggccacaggcgtgtgccaccatgcctggctaatttttctgttttcaaaaatacagatggggtctcactgtgttgcccaggttagtctcaaactcctggactcaagcgatccacctgctttggcctcccaaagtgctgagattacaggtgtgagtcaccaggcctggtggccctgtcattttaaaaggaaatgagggcccagcacagtgggaggccgaggtgggcagattacctgaggtcaggagtttgagagctgtctggccaacatggtgataccccgtctctactaaaaatacaaaaattagccagatgtggtggtgcaggcctgtaatcccagttactcaggaggctgaggcaggagaatcacttgaacccgggagacagaggttgcagtgagctgagatggcgtcactgcactccagcctgggcaacagagcgagactgtctcaaaaaaaaaaaaaagtaaatgaggatctgtctgtattctgtattttctatagtctggaattatttaaggaatttatctactgacttcaaccttgtacctgaggcataaactatttgtatcaagtgggcttgaaatgatgagaacagcagatgatgggaaagaaaggtctgtactcagtgttcccacagaagaaaagtcatcagtgtctggtctttgatgttctctaagcagatgggcaaatctccaaggttctgaagtttgttggggaggaaaaataatgctgtttccttctctcggaaaaagtcagcaaggagcgtgagggttcaatgtggtaacgtagctgcatgttcctctctgaagctctcagcttctccccaaaaacgttggacacaccatatctctcatctttgaaaaccccattctcaatgtgggccttttaatgatgggttgttaaataacaatttatgccagaaatttctttctttagtgaagaaagagaagaaagataaactccttgggagcagagttgtgctttgaaaatgtctcacactaagacagttttttttttccttttttttttgagacagggtctcactctgtcatccaggctggagtgcagtggcatgatcttggctcactgtagcctcaacttcctgggctcaaacaatcctcctgcctcagcctcctgagtagctgggactacaggtgcaggccactggacctagctaattttttaaaaattaatttttggtagagacagggtctcactatgttgcccaagctggtcttgaattgctggccttggttggtccaaaagtagtgcgttatctcaattgattgttcaaggtcagttacagatcaaagtcctcgttcttcccttccctccttctcactactgcacttgactagtcttaaaaatatattaaatatatatatattttaaaaaagacctgacttcaagtaatccttctgcctgggccttctaaggtgccaggattacaagcatgagccaccaggcctggcctaagacaacctaaaatgtaagggtgtgtttaaataggaaagtgaaaagtgggggattaagttcctagatgagtccatgaatatattattgaagcagggggtagagttagtttttaaagaggtaggccaaatcatgtcacttcttcactcctaatggcatctgagagcacttagaataaaacagaaacccatctcaacatttcagattcttcctgtcagactccacattgctccagccacatcctcattctgtctaccttttttttttttttttttgagacggagtctcgttctgtcacccaggctggagtgcagtggcacgatcttggctcactgcaaccttcgcctcccgggttcaagcgattctcctgcctcagcttcctgagtagctgtgactacaggcaccctccaccatgcccggctaattttttgtatttttagtagagacggggtttcactgtgttagccaggatggtctccatctcctgacctcgtgatccacccgcctcggcctcccaaagcactgggattacaggtgtgagccaccgcacccggcccattctatttcttaaatatgcccggctcatacccttcttggtatcttaacattttttaatccatctgcctagaagggttttgctccaggtttttgagtggctggttcctgctgaatgttcggctctctgttcagatgccttttactggccaccctccctttagtattgccatgggctccaccagaatcctttgggcttgttgactgccttatccctaatgtcaggatcatggttgaataaacaaatccactcacaggatggctggtgcataccagccagtgttgtacaccctggaagcaaggtgctttgagtgggttagccagctcattgcaaaatggtgaaaacagcatttcatgaaactatatgaaattaccaatattttaatattttgatctacaaaatagcatgtcttagtctatctgagctactataaatttaatggtataagtaccattaaactgggtggcttataagcaacagaaatttatttctcgtagttctagaggctgggaagttcaagaacaaggcactggcagattcagtgtctggggaggggccacttcctgcttcatagatgatgccttcttgctgtgtcctcaggtggtggcagagtgaggcagctctgtggggtccctttcatgagggcactaattccattcgtgacagttccacccttatgacctactcacttcctaaacactccacctcctgataccatcatcttgggggtcaggatttcaacagatgaattttggggggaatgccaatattcaggctgtagcatggcggtttcccatgtttgatcctgatgatctggcatcttcctggatctttgccaaaatgtctctcactaatagtctcacttggaacacagctcttcccacttcccacccaagtatatgattctaccaaagcttactctacctcctcccccaatttttgaatttttctttttttcccctcagctaaacttatcatttttagtttggtcaatctcagctagctatgatgaggaaagcaaccagaaacaaattcatctgagtaggtgaaactattgatagcacttagctcctatttcctatggaaatattggcatttaagaaagattcttggcacccctatattcatgtttaattgacataatttatgacactttaataaagtgaaatgaaatagttcagattggatggctgtatttttcaggttttttttttaaattacacatgacagaaaatctaaattaatgtggcttaaatacaaaaaagtattttagacagatgtggtggctcatgcctgtaatccaagcactttgggaggctgaagtaaaagatcacttgagcccaggagtttgagaccggtgtgggaaatatagtgggaccccatctctaccaagtcaatagaaataaagaaatacacacataaagacaaaaaagagtatttatttacatagagtgaaaagtctagacttgcttctagccacaagggagcaaaagggattggatttactttctcacctgatacaagtgaaaaatggacagaataggtaaaacaatggttttcaaagactggactttaagcaatgaaagtagtgatccctgagggatggaaaactcatggatgagcccttcaaatactccagcttactgcctggagagggttttcaggccaaggcccagcgtgggtggcccaggtggagcccggccgtcccaaattgagacttgggggtcaagagaggtaattgagttttcagggagggtacagggagggagttgcacagagagaacttcatagacctgcagagggccctccttgtgttttttaccggagtactgataagtgcatgtgaggaaattatctgaggccagggaaagaaccacccaaatggattaaggaggacaaatcttagagcacacacagggctgggaagagtttctgttcttgccagcatgaaaaacttcctatttatgggcattaggtaaagtcctcagaaggctttttttgaaaccttagaaatgctgtaaaattggactttagacctaaaagctgccctcaccttgcctcaaaccttaaaatcaagacctaaagggattaaattgtttccaagtaacttgtatcccagggcaaaataacatcccagtacaaagctcaagaatatttatagggatacacaaatatccagccaccaacaacgtaaaatttacactgcttgacaaccaatgaaaacaatacaaggaatgcaaagaagatgggaaatgtgatgctttttgttgttgttgttttgtgtttttgttttgtttatttgtttgtttgtttgagacagagtcttgctctgtcgcccaagccggagtgcactggcgcaatctcagctcactgcaacctccacctcctgggtttaaggaattctcctgcctcagcctcccaaatagctgggactacagatgtgtgccaccacgcctggctaattttttgtatttttagtagagatggggtttcaccatgttggccaggatggtctcgatctcctgaccttgtgatccgcctccttgacctcccaaagtgctgggattacaggcgtgagacaccatgcctggccatgtgatgcatgttaaggagaaacatcaatcaaccaaaaaaaaaaaaaaagagtccagaaatgacaagagatgatagaactggtagtaaaggacattcagttattgtaaatatgttctacatgttcaagaggctaggggaaagactgatcgtggtaagcagtgatatagagaatattataaagacccatacaatgtctcaagatgaaaactataattcaattaaaaaaatacaggccaggtgtagtggctcatgcatgtaatcccagaactttgggaggccaaggttgcaggatcccttgagcccaggagttcaataccagcctgggaaacatagtaaaaccctgtctcttcaaaagataaaaaaaattatctgggtatgctggcacatgcctgtggtcccagctacttaaaaggctaaatcaggagaatcacttgagtccaggaggtcaaggctgcagtgagctgggtttgtgccactgttctccacctgggtgatggagggagaccttgtctctaaaagaaacacacacacacatttgataggattaatggcagaaaaaaatattagtgaacttgatgacatagcaatacaaaatattcaaaatgaaataaataaaaaggacaaaataaaaataatcatagcattggtaatctgtggaattactgcaagtgtccagatgcttctcaaattacaatagggccacgtcctgataaacccatcataagtaaaaaatattgtaagttgaaaattcattcaatatcacaataaacccatcttaaagtcaaaaagtcataagttgaaccactgttaaatccagataacctcaatatatgatgtggttatgtcccaacaagcccatcataaagttgaaaaatgttaagtccaccattgtaagtcagggaccatctgtagatataaaaggagcggggtagacagacaaaacatttgagaagataattgctgaaaaagttctatattttatgagagctatgaactcacaggtccaagaagctcaataaaccccaaacataaaagacctgaataaaaccacagcaatgtgtattataattaaaatgcttaaaactagtaatcaagagaaaatctgcaaagcagccaaggaatggcaggaaagggagaaagaaagatacattttgttgagaggaaaaaatataaggaagacagcagattttgcatcagaaacaatgttaatggaaaagacagtggagcagcatctttaaggcactgatcatgaaataaaccccccaaatgccaatttagaattctacagccagaaaaaatatctttcataaacaaaggcgaaagaaggttttagaccaacacatgctgaaagaattaattgccaggagacctgtactacaagaaatgcaaaaggatacagatggaaacctgtatctatacaagggaaaaaaaactggttatggtcactctgtgggtatataaacattttacctacttttaaaatttcttcatatcataatcgattgtttaaagcaatgtcatatgaggtttatgacatatgtagaggtgaaatgtataatggtaatagtacaaaggccaataagggagaaatggaagtgtatttttataaggcttttataccatacatgaagtgatgtaatgttacctcaaggtggagtgcagtaggtgtaagatgaatgtggtacattctaatgcagctactaaaataatacagtaaagaattatagccaataagcaaagcatggaaatacaatagaatcatttaaaacatttaatctaatagaaggcagaaaaagaagaaggaacaaagaatagataggataaatagaaaataaatggcaagataatagatttagatctaaccataccagtaatcacattaaatgtaaatggtataaatacctcaaattgaaagaaagagatgccaaattggacaatctagtatgctgcctacaggaaactcacttcaaatttaaaggctcaagtaagttaaaagtaaaagaatagaaaaagttacagtatgctaatactaatagcaaggaagcttattgactatattaacattagagatagtagactttgtagcagaaaaaccaggaattaagaggatcattacaaaattataaaggggataaattcatcaagaaatcttaattatcataaacattcatgcacctaataaaagagcatcaaaatatgcacagcaaaaactgatagatgtgcaagaagtagaaaaactacaaatattgtcagagattttaacaccctcactcaacaactgatagaccaagtggacaaatactcagtaaagatgaacatcatcatgaacaacatgaacatcatcatccaagttgacacttttaaaacgatctactcaacaatggtagaatacacgttcttttcaagtgcgcacagaacgcttaccaaggaaaaccatattctggccataagaaaagtcccagtaaatttaaaagacttcaagtcacacaaaatacataaatacatacacatatatatatacatatatatatacacatatatatatacatatatatatacacatatatatacacatatatatatacatatatatacatatatatatacatatatatatacatatatatatatatatatatttttttttttttgagacagagtctctttccgttgcccaggctggagagcagtggtgtgcttttggctcactgcaacccccacctcctgggttcaagcaattttgcctcagcatcccaagtagctgggagtacaggcgcccgcaaccacgcccggctaatttttgtatttttagtagagacagggtttcaccatatcggccaggctgggtttcaaactcctgaccttgtgatccgccctccttggcctcccaaagtgctgggattacagttgtgagccaccgcacctggccctttttttttttttttttttttttttttttttttttttttacaaaatatattttttggtcatgtggaataaaaagttggaaaaattggaaatcaataaaaaaaactcagcaaaatctctaagtatttggaaactcaataacacatgtctacccataagtcaaaaaaggaaccaaaagaaaaattagcattttgaagtaaatgagaatgaaaacacagcatgtcaaaacttatgagatgagttaaagtggctttagggggaaatttatagcattacattcttagagggaaagttatagcactgaacatcaatatttgagtaaaattcttaaaatattagcaaatccaaattaacatatatataaaggataatacatcatgagcaagtaggcattaccccagaaatgtaagattaacttgacatttaaaaattaatcaatataattaaacatatcaggagctacattacacgatcatctcaatagaagcctagtgagcatttgacagacttcaacatccatttctgattaaaactgtctgcaaactataattagaaggtagcttccccatcataatgaaagaaatctatggaaaatttacagttaatatatatttatacttaagcagctaaaaagactttctcctatgatcagggcaaggcacgggtgagtgcctgttctcattgtgtctactcgatgttgtctggaggtgcagtgcaatgtgcaattgctcttgcaataaggcaagaaaaagaaataaaagggaactggattgggaaggaaagtgtaaaggcattatttatttgcagatggtatattgtatatgtagaaaattctatatgatctacaaaaaagctgctataattgaaaagtgggccaggcacggtggatcacacctgtaatcccagcactttgggaggccgaggtgggcagattgcctgagctcaggagttcaaggccagcctgggtaacacagtgaaaccctatctctgctaaaatacaaaaaagtagctgggtatggtggcatgcacctgtaatcctagatactggggaggctgaggcaggagaatcattggaacccaggaggcagaagttgcagtgagctgagatcgcaccactgcattccagcctgggtgacagagcaagactctgtctcaaaaaaaaaaaaaaaaaaggatataaaatctatatacaacatgtattgaatttctgtaatcataatgaacaagcagaaattgaaatagaaatataacttacaaaggcataaaaatgatgtagacacaaaagatgtaaaggacactgcactacaacccactactaagagaaagaaggtctaaatgaatgggccatagactgtgctcttggtctgaaagtttcagtattattatgatgtcaattctccccaaattgatctatcaattcaatgccattccaataaaaatctcagcagattttgaagaaattgacatggcgattataaaatttaaatggtagtacaaaggacctagaagaaccaaaacaacttagaaaaagatcagtacagttggtagacttacattacccgactttagaattactacaaagttatcataattaagacagtgtggtattggcataaagacaggcaaaaagatcaatggaacagagtagagagtccagaaatgaactcataggcatatggttaattgatttttggcaaagctgcaaaagaaattcaacggagaaaagataatctttccaacaaattatgctgtagaaattggacatccataggcagaaaaagcaagcctcaattaatattttgtatcatctataaaattaactcaaaaaaggtaatagaattagctgtaacacctaaaactgctaaaattcaggaagacaacataggagaaaatctttgttatcttgggtgaggtaaataattcctagatatgacacaagtatgatctataaataaaaaaagattataaattgtactttatcaaaatcaagaatttcttctcttcaaatgatgctaagagaatgaaaatgtatgtatatcccagaatgggcaaaaatacttgaaagtcacatatctgatacaggacttgtatccagaatataccagaactcttcaaactcaagaagaaaaacatgcaaccactttttttttttttttttttttttttttttttttgaggcagagtctccctcagtggcccaggctggagtgcagaggctcgatctcggctcactgcaagctccgcctcctgggttcacgccattctcctgcctcagcctcccgagtagctgggattacaggccgccgccaccgcgcccagctactttttttgcatgtttttagtagagacggggtttcaccgtgttagccaggatggtcacgatttcctcacctcgtgatccgcccgcctcggcctcccaaagtgctgggattacaggcgtgagccaccgcgcccggcccatgcaaccacatttttaaaatgcataatttccttcttttttaatttttgaaatggggtcttgctctgtcacccaggctggagtgcagtggtgtgatcatagctcactacagtctcgacctcctgagctcaaaccatcctcctgcttcagcctcctgagtaaccgggactacgggcacgtgccaccatgcttggttaatttttattttttaattttttgtagagatggggtcttactatgttgcctaggctggtttcaaactcctggtctcaagacgaccttggcctcccacggcgccgggattacaggtgtgagccaacatgccttgcccaaaatgcgtaattgtctttttatttgtatttgttcattcgatacatatttattggtcacctgtgccaaaccctttctagacgctcagtgattcttggtaaaccaagcaagaggtccctgtcctctgggacttgtttgtggggcacacagatatttgctgtccagctgaaatatgtgctatggggtagggcgcctgactgtctaatgcacctccgcatccccggcacgcaggacccggccgggctgccgcctctcagaatcgctgtgcaattggcgattgcgacattcatggaataaattccccttcgcgacacatggggacgctcacgctccacgctgtggccacactcttacgcgcctttgttcaaatggtccgcggtaatcacccctccagctcaccttctcaaaaaggggacgtggatgaggctctcatgattaatgatcgcagtacggatttgtaacttattacggaagaaaagccacatcaagcaggtgtcgtttggaacaagagagattcggctgcctaagcagtaccaaaggacggtgtccttttctgggtcacattttaattttcttttcaggtcttgcagaacagcgattagttcattgctaatgaaatccttaagtgcttcagagcattacaacttaggggaggaaagactggtgtgtcttctgagacgccctgagcagcacagacgactagaaatgcgtttacgctcggctgcttgggctgattgcctttgcaaagaggcacatgaaaccgcagatatctgcatgcacagccagcaaaggaatcgtagaaataacaacgttattgggaagtcatattttaagccgaggcagacgctgtgccactgaatacctagggtagttcagatgcacctaatatccaggtttttaggggaactaatacgtgtgtgtggagctgtgtcttgaaataattcaatgttctaagcctcagtgaaatcgtgtctctggaaggtcaatcattgaaggtataacgtaaacactcaagaaaacagggagactttgtggcagctcttaacgtcgtgacgccagctgcagtagctctgtcaattgtgggggcatcagataaatcaatttaagctggaaaagtcctttgaggtatccaggtggttcgtaaggccacataagtctgtcaaatatcatcgctttagagatttctgagatttcagaggatatcaggtcttgatgcttggaaagaggcaatcggcaagattttagcaaagggactctgagacaaaagccacaggtttttgttcgtccatgcatgctttcctcagtttcactgtgcagcacctctcaaactttcatgagaaatttggggtgccctggcactctgtgtttttctaaccggctcccggccgacactgaggctagtggttcttgaaccacgcgtcggtattagggtgctgtgcagtacgtagctcgaggaaggcacttccacagaaggcagtagcctacctccaccctgtttaccacctgcaggattcatctcatctcttcactcaagaaaattgggcagccctgtgcgggaggcctgacttgcactagcggctggagacaaagggtgagtcagactcagcttggtacctctcctgttgaggcttattattttagtttgggagacaagcacagagactggtaattcctaacttttaaatgctgtcagcgaggaagcgcagcgggcagctgtgaacgtgtctaacgggggctgtgagcttcagaagtcggggaagtgctgaggttcaaggaagaaccggggttcattggccaagagagccacaggtggggtggggtggatcatattccagggaaagggggcgtgtgtgcaaagcctctgaggcaggagggatgcgggcttttggaggacccggctggtctgtgtggttggaacatggtgggcacacgctgggtgagcgtggagtatctggaggtgaggctagcgttggtgggatcctggtaatcccgctaggacaccgggtcatcctccgtcattagatgatggtaaagatagtggatatcaggggaaagtggggactgacggctccccttttcacgataagggtggcgtgtttccatttgacgaacggacccccttactaagtacctgttagcgcaggtgacacccacctgctccgcgagctcagtagacacccatctccacgaggggggcagcagagcagaacgctgaggctcggagtctgaaccttgagaaagatttcgtcgtggaattctagaattgatagttctgcatctagacatattctagacatctagacatattctagatgtctcgatagaagctgtgcgctaacagcggcccacacgcgcctgctcacttcaggggtcctgtttcagttccttcagggtggctggtgtctaggcgagaacggcatctggagagggaaaggtcacccctccctgacccgcgttgcactcgtcaggaacgtggcacaacctcccagtattaattcccaccgcgccctgtggcggggccctggcagacatgtagatttgccagacggccaacgtgattgcatccttcattagctatgaggtggtgcaggaggagccgtcgactccaggggtggcaggtggtttgggggccaggtggccaagtttatggagtgcctatggtttcaccccaccttgcaggcatcgggctggcggccctcgcctctgtgagcctcacaggctttctgcactcagagaagggagctggtggcaaacaggccttgaagaaggggagaaagtagctgtcaggtgcggctactcaatgctgccatcagcttagaattgtaaagggaactgtttgaaccagggcacgagaagagtggttttcttttattttcttttgtttgttttggttgaggctaagatttccccatgacctcagagcatcgagggccagcccatttccaaagggtctgccggtctaacgtctctgttgctcatacttagcacctaaaactcatgttcctccatgtcaaaatcatatttctctatttgaaatcatattccctcatgttgaaatcatattcccccatgttgaaatcatattcccccatgtttaaatcatatttccccatgtttaaatatttcctcatgttgaagttatatttctccatgttgaaatcatattccctcatgttgaaatctacttccccatgttgaaatcatatttccccatatttaaatcatattcccttatgctgaaatcatattccatgatgaaatcatacttccccatgtttaaatcatatttcctcacgttgaaatcacattccctcatgttgaaatcatatttccctatgtttaaatcatatttctccatgttgaaatcatatttccccatgttgaaatcatattcccccaggttgaagtcatatttccccatgtttaaatcatattccctcatgttgaaatcatatttccccatgtttaaatcatattccctcatgctgaaatcatattccatgatgaaatcatacttccccatgtttaaatcatatttcctcacattgaaatcacattccctcatgttgaaatcatatttccctatgtttaaatcatatttccccatgttgaaatcatatttccccatgttgaaatcatatttccccatgttgaaatcatattcccccatgttgaagtcatatttccctatgttgaaatcatattcctccatgttgaagtcatatttctccatgttgaaatcatattcccccatgttgaagtcatatttctccatgttggaatcatattctcccatgttgaaattggagcagttaattggggtcacacttttatcatcttgtcctggactttagttcccaggggcagaccaggcagtcatcagaaacacaaacctatttagagaactgccttctttcaatacacacctgccctgatcatttgggttggaatatggctgcttgtggtgttttctgcactttcagcctccaagttgagtctttgcgtggccgagtgtcagcacttgccacacatttcctcttcctgggcaaacgacctcactctctgggcatgtggttgaatgtcctggcctcacctcacagttagatgtggccgatgggatgtgaatagaagccgtacgtgacacttgcagtcgtgacccgcaaatatttccgccacacggccagccattccctttctctgctactggcttgaggtgactaacaaggcagcttcaatggccacacattacaaacagagccacggatggaagggaccatggtccctgagtcaccacgtgaaggacacagttgctggctacatggaagcaccctttggacttgtgagaatgagacagaaacatccatcacgtgtgagccattcggtgtttgggtttgtttgctgcagcagcggccacagcattagattttcattccgatctagggacgccaccgtaggaggaaagttaacagatccagaagttgtgtgaactgcctggtgagcccaggcattggtgagaccacagcagggctgaatggagggaacaaaactctgtcccctgagcattcactctggccatctctcctgttcttctctcttcagagtggaggtccatgtgctcagacagaggaggcattatcctgacctttctcctcccagaatcaagttttatcacttacgctcagaaatctgagcttgctcttggaattcagcactggcttcatggatccttctctgccaatgtgcattttatggccaacgaatgaccaggactggttggttggattgtcgtaaattcacaagacatgttcatggagatcttgccaagggtgtggccacttcagccattgcatcagagctagtggaggggagatcggggtggccagcttggccgaggatgtacgaagtatgtgtaaacattctttctccactgatatcaagtgtattagtcagggctctcgattgcaagcactctgactttcttaggcaaaaagggaatttttgaaaggacgtcaggggttcacagcatcattgtggagctagagggtctatcttggaaaatggaaccaaccaagggcacttcagaaggctggacagcaggaatcacagctgaggccaggatgcaggtacagactgttcattgctgctggagattcaaagtgccaggggagagggccatctgcatagagcctgagtcacaggcttgctcccagctgtgccaaggctggtgtattggtctgttctcacactgctgtaaagaaatacctgagacagggtaatttacaaagaagagaggtttaattggctcacagctctgcaggctctacagggagcctggcagcacctgcttctgggaaggcctcagggagcttttactcatggaggacggcaaagtgggagcagaaggaagggggtccatgccacatacttttaaacaaccagatctcatgagaactctatcatgaaaactgctcggaggagatggtgctaaactattcaagataagccacccccacgatccaatcacctcccaccaggccccacctccaacactggggattacaattcaacgtgagatttgggcagggacacagatccaaaccgtatcagtgtgagatttgggcagggacacagatccaaaccatatcagtcaggaaaggaaggattttacccacttcagctttcacagtaggtgtaaatgttccctcctactccatccacatgcaaattcctccaaacatttcaggggcttcagctgatacaagttcattttctgtgtcagagtctaatgcaggtgttcctagtgagtgtactcccttccatgcagtgactcagggatccaggctcttccaacctggggctccatttcagagtcctctgccttcaagcagaaaagaaggaggggagttacctccagtgcatcttaaatgccctggcttggatagagcaggggaggggatgaatgatatgctttacttttgctcatattcccataactcattacaaggctaacataattataagggatgatgggagagacatagaagcagaaggacattgggtggtgccaaccacttctgctataagcctttacaggaagagaggatgtttggtttctggacagataaaaaaagtaattgatatctgctcctagggctaaatatatgtggggatggggaacctgagaatatggtcctttcttgagctttgaggagagagggatgggtgctaatatttgttgaatggctactacgcataggaactttgcagatgtaagctcactcagtccttaggggtgctaatttaccctttggcgtaaatactattctttccactttacgaatgagaaaactcaattaacaggcggtggagggatttttttcagctaggcagtgacagagctaggattcacacgttccattcaccacccaaccttaagggtcgctgggctgcaaccttgacttgaaatatagtctactttgcactgggagggtttggaatgaaacgctacaatttggatcaagataaaccacaggcagtgaaagcaagctgcaggggccagaggctggaatttcccacagacagaattttgggaaaagctgtacagtttggaggggccgggtagggaggaagaagggaagggggataacctcatccaagcgagagaagttatggtcaccaaatatttctctaattacaaaaaaataagggacttagggatgccaaaaaaataaagtacaagtgtactaggcgttggcttttttggcaaagcagatttgtctgtaatcactcttaaaaagatataaaaggaattgcctcacacaatgtgatcacttaagcctggcttttatctgtttcttcagaaacattgcattttgaaggaaaccatattagctggagatggtgaatttgtctggtaattgctttctattataaatctaagtaacatttaacaccactagggaatgcaaaattatcaagcaagctgaaagaagaaaaagtcttcttctgagttgaaagttctgttttcctagttgaaaatagatgttttaaggttcacagaacaccattttgtatcattagcaagattatggggcagcgcttataaagttccaaaactccctgctggttaatagatcttagaaaaagcgtctgaggcagatcccttgaccggcagccatggtccacagtattcagctgtaataacaattatttaaaaatgggcgtgagatgggggacaatcgtgatgcctcttctggccttaaacacccgcgataatctttgctatggtccgaatgtttgttactgctctccctgcaaattcgtatgttgaaacctagtgccccaggtgatggtattaggaggtgggggcctgtgcgaggtgatgaggccacgagggtgaagccctcaagaaggggattagtgctcttattaaaggggatccagagagctgcctcgccccttccgccaggtgaaaacacagtgggaaggtgccctcgatgaaccaggaagggggtcctcaccggacatgaaatctgtcatgctttgatcctggacttccagccctcagaactgtgagaaacacatttctgcggtttataacctaccccactcgtggtattttgtatagcagtcaggatggactaaaacgatctttgacccacttgctattattttcgttgtcaaatccattttgtatgtaggtcagcttcactatctttatgaggtcagaggactggatgtccccaggacttacgtggctccaagacatccttttgtttgtttgtttgtttttgtttttgtttttttttgagacagagtcttgctttgttgcccaggctggagtgcagtggcgtgatctcggctcactgtaacctctgcctcctgggttcaagtgattctcctgcctcagactccgagaatagccgtgactacaggtggccgccaccacacccggctaatttttgtagttttagtagagacggggtttcaccatgttggccaggctggtctcaaactcccggtctcaggtgatccgcccacctcggcctcctgaagtgctgggattacaggcatgacccaccgtgcccggccccagtacatcttttcagggcacttgaatggtcagtgttgaaacatcaaaagattttaaacaaaattctgaattttcagcttctccaaaaaaccccacagaaatcagatgatcttaccaaactgagtcctcatttctgcctggcagaagggactatattcccaagatccccacacgtgtgcggtgcccctagagcagatactgatgactttttggcttccagagccaactgtcttctcttccggtgagcactccggagcagaaacgttcagggctcccagcaaccgagagagagttctgactcctccataccctcatcgacgtttggggtcctcggtctttatgttagccttgctcagagtgtgtgtgatgtgtccagtggaaaatcattgtgattttgttttcctaatgaccagtgacgttgagcaattgttcctgtgcttattggccatttggaattcttttccgtgaagtgtcattgtcccagaaacgggtcactatcctggtatgttcagcttcttcttgcctttatagaaccagtcttcttcttcttcttcttctttttttttttttttttttttttttttgagacggagtctcgctctgtcacccaggctggagtgcagtggtgtgaccttggctcactgcaacctccgcctcccaggttcaagctattctcctgcctcaagcctccctagtagctgggactataggcgcccaccaccacgcccggctaatttttgtattttgagtagagacggggtttcaccatgttggccaggctgctctcaaactcccaacctcaggtgatccgcccgcctctgcctcccaaagtgttggcattacaggcgcgagccaccgcgctcggctgaaccagtcttcttaacccccatctcagagagcccagccctggtgaggcaggccccactccctggaggtctgactccaagcagagccaaccagaagctagagggcaagagttccttgtcgacggcgttgggcgagatcagcctcctggtgcacagagtgcaggggagggcgcggcgtcacgtgtgtgagtctgatcttggcttccatcagctgatgtgagccttcgagtctgggctcggggcaggagtgagtgagtgaagatcctcacaccccaaatgaccgcttagatggaggggctaaaaagggaagccatgggaacaacacaccaacgaatgcctcaagcgtgacctcaccaaagcactgggctcacttggcagatgaaacccccactagactctcgtggatagagcagatgagaagacccagtgcccgtccccactgcctgtagatctgtcccgtttcctcctgcagataatttatagtgaggccgagatgccctccagctgacagctagtgcctgctgtggctgctcatcacacaccacatttgtgttcattcttaactggagtttcctgtgggtttgtgtttccagcaagattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacccacagtttgtgagccccgcgccccccccttttgtcttgaatgctgctttgcttagaattacgagtgtacaggctgggcgaagtggctcatgcctgtaatcccagcaatttgggagggtgaggcgggcggattgcatgagctcaggagttcgaaaccagcctggccaacatggtgaaatcctgtctctactaaaaatacaaaaaaaaaaaaaaaaaaaagccgggtgtggtggcaggtgcatgtaatcctagctattcaggaggttggggcataagcattacttgaacccagaaggcggaggttgcagtgagccgagatcctgccactgcacactccacactccagcctgggcgacagagtgagactttgtttccaaaaaaaaagagtagggactagaaataattttattaatagaagcctttattggtttatatattaatattacccatgaaagtagtgttaccttataaaacactgataaatatcttatccttagggtcttctgatggagatgggacaatactatctctatttcatggacaagaggcagagactgagacaagctaatgggctgctggggaggaggctggagcccaggtcttcagctcctgatcaatggtcgttcttctgggtggtgctggggtttgctttgttttgttttgtttttagagacagggtcactgcagccccaacctgccaggttcaggtagtcctcccacctcagcctcctaagtagctgggaccacaggcatgggccactaggcccagctaaacctgccaggttcaggtagtcctcccacctcagcctcctaagtagctgggaccacaggcatgggccactaggcccagctaattttttgtagagacaggttttcaccatgttgcccaggccggtcttgaattcctggacttaagcattctgcccccctcagcctcctaaagtgctgggattacaggcgtgagccactgcggctggccagtgtttttactgtttatggaaaatatgcaacaccagcagtttcacttcttgagggtaaaactggcctgtgttatattgacttacatagtgagaactaaatgattctaagcagcttagttctgagaaagccaccccttgtttctctccaggtcttccaccttctggctgcttcagccaggatctgttgtgttgaaaatgttgcggagttcagttggagtagatagtggtggctgctagtctgttacaatttggtgctgtagtgagttgagatcttgtgggtattgaactgtttttgtatttcagttcgctatttgtgcctacataaaaattttaaaaaactgaattttccatttttcattgtagtgtaggaagaatgatgatggagacacagttgttgtggttgagaaagatcatttcatggatgatttcttccatcaggtaagagcgtttaatgaaacccaatcatagcctgcctacctgtcctccctccctccccccacccctccctcctttcttccctccctctccctttcctcccctcccctccccacccctccctccctcccttcctttcttcctcccttctttctttttctttttccttttctttttcttgtttttggagacagagtcttgctctgttgcccaggctggagtgcagtggcacaatctcggctcactgcaacctctgcctcccaggttcaagtgattctcttgcgtcagcctcccaagtagctgggaccacaggtgtgtgccaccacacccagctaattcttttttttttgcacttttagtagagacggggtttcaccatgttgcctaggctggtttcaaactcctgagctcaggcaatccgcccgcctcagcttcccaaagtgctaggatgacaggtgtgagcccttgtgcctggtggctttcttctttaaagatttatatcaatatgattgtgcatttatcatatttgaaataatacttaagctaatatttttaaaagttgttgtttgaattacgtaagttctctggaatttttagtatgatcacaatgttaataatgagaaaaatgcaaatcatcgttctaatgcagtccgggagggaactgggtgtggatggtggagctgtgcacgtggcctccgcgtgggttggggccgggcctgcagcgccctctgctggtgggcggccacttctcccacccggtgctggctgctgcaggagcaccgcctccttgcaggctgccttttggaggtcctgcggcgccccttaagagagttttacaaaggccttcctgcaagactggcagtgtctcagaacgaggcctccttggttcttcaggaagtggtggttccggcagcagaggtggcgcctggctgtgggggcaggggtcaggtgtgcgtggctcccaccagcactgccatccgtccactggtgggtgtgagtcctgaggcaagtgcctagagcagagggctcagggtctgaaatcggtgacagatcagctgtatatgagctcaggtagaagactcagaggaaagtcacaggtgacccagtggctgatattttaaaatgtggcggcctggcggtgctgggatcctatctgaggtgtgaggcctccccctcctgcttatctccccagctcagctcttgggcttaggccctgctgaaattctcaaacctaagaattatctgatctaatgttgcttaatttcaaatttttgaaattgagtcacagaacaaatatattgaccttgtaaaacatgaagaaacgaaaacacacgtccagtgggttttttaatgacggaaccttcattgcaggactcgtcttgattatgctgagtctcatgggatagtttcactcagcagcctcatctggcctagcagtgcctggatttgaacattttaataggtttataaaagcatatggaaagttactagtttttcagattcagccagaatttcttgaatatctcacgtaagcctagtcactggttttctagtatttgttagttgctactgttatttaaaggaaaaaaccatgagattaaattgttagctacaaggaacttcctttaaggtatgaaggagttaagatgctgggatttcctgatttcacttcttggaaatgagactttttaaattgtctttagccttcctgccccctttgtcaaattactatttttctgattttattccttttacttggttgcttaactcttccatgtaagttctttgtaaaaatgtatttattttaaagaatctcctgccattaagtgttgcatttaatagaaaagtcacatagtgcaggccgggcccagtggctcatgcctgtgctcccagcactttgggagtccgaggtgggtggatcacctgaggtcaggagttccagaccagccaggccaatgtgccaaaaccctgtctctactaaaaatacaaaaattagccaggcatgatggcaagtgcctgtaatcccagctgcttgggaggctgtggtgggagaatcgctggaacctgggaggcggaggttgcagtgagctgagattgtgccactgcaccccggcttggggcaacagcttgggcgacaaaaaaaaaaaaaaaaaagaacagaaaagttacattgtgcaattcactgagtgccattaagctgtggtctttgtctatctggtgccagtctgtctttgctgctggcgtctcaggggcatgtgggaaacaggttactcgtactttaggaaggcttgcccggtgcttgcctcattgggttctaacttaagctcaagctttcatttgttaaatagtcaatttattttgcacttaatttctgtgaaatgacttcctagacaaatacagaagcaaataatgtttggtaatataaactcattctgatcttcaatatcacatagaagtttgcaagagaaatgaatttcacatggtgagtgtttggttaacactaaaacagtgctctgaagggtggccagggagtcttgtttctgtgaagatgatttataatggagccaaaggacccctgtgctatgttattcccggacataaaatggtagctggcaccattctctctcagtgcctgtctaggtacagggtgtatagccctgcggtctcctgttcctctggagccatacgggggcttggagttagcagcggtgtatattgcagaactctccaagagttaaaataatgtttttttcttttactttctaacatatgtgtattactttagaaatggtaatttttctttctttttttgagacggagcctcgctctgtcacccagggtagagtgcagtggtgtgatcttggctcactgcagcctcctccttctgggttcaagcaattctcttgtcagcctcctgagtagctggtgctacaggcacaccaccacgcccggctaattttgtatttttagtagagacggcattttgccacgctggccaggctggttttgaacttttgacctcaagtgatctgcccgccttggcctcccaaaatgctgggattacaggggtgagccactgctcctggcctgcatgattctttaatacttagacttttcaaatctggtccggggcttgggttaggagtccctggggtccctaagaccctttcaagaggattctgtggtcaaagctcttttcaaagtaatactaagatgatcattgccattttcattgtcttatgactgcacaatgatggagtttctcagagccaacacaccaaacccagaaatatctgtgatgatcagggtgctgtctattaagctggacattagatttacaaaaagtgcaaatcactgcctctgtttccaccgattttttggagatctatttttcacagaaatgtgttatttatgttgatccgtgtgtcagtttcctgctgctgctgtaacaaaatcaccgcaatcactgtgcttcaacaacacgtttatcacctcctcctagttccagggcctggagaagctcagatgctggcagggcagagccgcaagcctcctggagctgccttcctctccatcttccgcaggcggcctgtgttcttgggtttcctccctcttgaaagccatcactccagctgctgttttcacaatcaagtgtccttcttccaacgttggctcccttgcctcgtcttataaggaatcctgtggttacgttgggcccacccagataatccagggtagtctcccatctcaagactcaatttgatcacatctgcaaagttccctttgctatgcaaggtgacatattcacaggctctgggattagggtgtggattgtgccacaacatgtaatggttaataattacttcttcctttttttgtttttaagagcagggtcttgctctgttgcccaggctgtagtgtagtggtgcagtcacagctcactacagcctcaacttcctgggcccaagtgatcttcctgcctcagcctcctgagtggctgggactgcaggcatgcaccattgtgcccggctaattttctttttttttaaagtttttgtagagatgggggtctctctatgttgcccaggctagtcttgaactcttggccacaagtgatccttctgccttggctcccaaagtgctgggattacaggcatgagccactgtgcctggcctataattactattttaaaatgaggaaggaggtaggagctggcagcagagcatcttgctccagggctcaccttgctgcttctgtagctggatctccatctactgctgtcttctaagaacacttgcgactttaacccatttatgcgtagtgttccattattggaacgctaagcttttgcgagttatttatatcctactgctcagggtcatcaccaaggtctgatttttcacacacacacattgcagcctctggcataaatgggttaatgaggaccaaactggagaattcaggatcatttcccgtctccagatccttagtttcgtcacatctgcaaagtatcttttgccctataaggtaactcccaggcccagggatcaggacctgaacatctttggggtcattattcagcctgccgtagaggtttttgaagataatgttatgactccatctagataaatcttgctaatgatatgttacattttgaaacaaatattgaatttaaacatttagaggtcaaagataataattatgaagccttggctgtatgagctatagatacctcctcccataagagtattattattattattttcttcttttttttttgagacagagtcttgctctgttgcccacgctggagtgcagtggtgtgatcttggttcactgcaacctctgcctcccgattcaagcgattcttgagcctcagcttcctgagtagctgggatcacaggtgtgtgccacctcacttggctaatttttgtacgtttagtagagaagaggtttctctatgttggccaggctggtcctgaactcctggcctcaagtgatccgcctgccttggcctcccacagtgctgggattacaggtgtgagccactgtgcctgcatgttttatgggcttacttcctggttatactgagaatgggtattagtagtagtatgcttctaattggccccatctgtgtcatgcttgggacttgactagaaatttttacaacctgataggttttcccggtgaatgttgattggtactgctttaggtatgaaggtagaaatattcataggatatatctttattttttaaatttaacgataccagtgtgagaatgggagaggcttttatttcttatgtggtaattatttatttccctcctttattcttccccttttaggggatgaaaagtggtcacagatttgagtttgccatgctgtaatgactctctctctctcctaggtggaggagattagaaacagtattgataaaataactcaatatgttgaagaagtaaagaaaaaccacagcatcattctttctgcaccaaacccggaaggaagtaagttgttggttttcacaacaaaacgtttgtctgtctgtgtgtccctctggctgtctgcggcacaggcctcaactctggcctcacgggagattcaggggagtttgtatgaaatgctgacaccctagagagtctgaggcgtttggcctggggcgagccagggcatctgtatgttttttttttcttaaagctgcctgtatgattctagtggtcagccagggtgaggcccactgatggatcatgtcctaaagaatacacgaaagtggcttcacagaacttaggggccaagattagaccacagttcagcaagacagcattttctgttcagagggcagtgaatcagggattgatttggaaaacagtacttgtaagagcagagtgaaataggaagacgcactgaggcgactctgaaagtcttgaggagcttttgtatggactgtgctgcgctcagtggctgtgggggatggcacggaagaaacggttttctttctttacctgtttatccaaattctccctgcctcacatttgcttccttttgaatctgaggcacacaggagagtgaaaggagctcagtggaagcagctggagaacctggatttttgtctcaatttgcttccccgtggtatttgcatctcctcattgggagaaaagacatgattttaaattaactcagcgttaggggcgtgggagctatagagaagagagtttcattgctctggaatgataaatattgaaagctttacaggggacatggatctgagcaagccagagattacaaataggagtccacacatcatggtggggggagttactatgttaacaacgttgagtctttgaatccatgaaaatggcccctacctccacgacacaggccgcctttaatgccggtctgtgcggtgctgtgggttccgaggagggtcgcgcacatctttcgttgtatttattcctaggtagtcaatgttttgatgttaatgcaagtcgtatgtactttattttttatttatctatttttttttttattttgagacggagtctcactctgtcacacaggctggagtgcagtggcacagtctcggctcactgcaacttccgcctcccgggttcaagcgattcttctgccttggcctcctgagtagctgagactacaggtgcccaccaccacgcccagctaatttttgtatttttagtagacatgggatttcaccatattggccaggctggtcttgaactcttgacttttgtgatccacctgcctcggcctcccaaagtgctgggatttcaggcatgagccaccgtgcccagccgtatctactttaaatgtcattttctctgtttgttgttggtatatagaaatacaatgatttttgcatattggccttgtaccccttgcctaatcagttattaattctgatattctctgtagcttatgttggattgtctctgtacccagtcatgtaattgtgaataaatagtgaccgttttttccttgcagctcttatgcttgttagttttaactgatttatttagctgacctccagtacagtattgaatagaagtggtgatgggggcacatgtattcttggtcttggaggaaagttgccagcaaatacattttttgttggaatattacttagtgtagccgtacgttgaaaaaataagaaagtagtattaaattgaaaaagtgcattttaaaattttatgtatcttgtaaaataatattctgagcctctgtttatgccctctcagtgactcagaagtgtgtttcccaaaatgtttctggagccgccgtctcatgagctagtccgtgcagccagggtgctgcctgcggccagatctttccggggacctcttcgtgccgtcgcccagcccctcttgggaagttgcagtacccgtagaataatcaaggctctgagaaggcttcctagaaggaagcctgtttagctttgtttagtgtttcacacatttatttgcccgtaggaccttttatgtaacatctgttaacatcatgcttaatgcttagggaaattatatttgaataagtatccgcatttttttttgaataatttacctccaaaacatttttgctgccaagtcatagcagagagaactattttttgagtaaatttagaactgttactgtttcatgatagtcccttttgggctctaaagaaaaccattgcttttttgtgttttgttttgtgacagagtgtgaaccaaaatgtaggcagcagcctccagccgcttccttggtcagtctttaaaaagcaaaatgcagtgattcctctctcccagtgatgggcccggggtaacgcagagagggacaggctcttggccttcccgccttgttcctaaaggaagaggggagggtgggagggaggaagggggactactgtgctccgcctcccgcgtgtctccctattctcgggcaggcgctctgcttaggtcccggtgagcagggcgatccccgggctgctgccctcccggaggtcccccgtcaaccttaggacccggggcagggctgggcacggcggccgccaggtggcgccagaggcagccggtcctgggcgggtccccggtcccagcaccgcccgcgccgcgccacctgcagccgcggatcccagggcagagaggtggacgaaggaccttttacctgcatttttcttttttcactttctacttttgtattatttcttttttcttttgtattaaaagagcgtctttgcaaaacgtagaaatttcaggccctccaagacgcggatccagccctgcaggagcatgaagtgtgtgtgattctggtttgggttttagtgacgacgaggctgggattccccctgcaggacggcggggatttgattcgctcctgcagtcagccgtcagcctggcttgcaccctgtgttcgggtgcggtcgtccttgcggctgcgcacgctcccgttttctctgcttcctgttccctcagccgttccctggggctccgctccgaatgcgctggggcagcgtctgcaccgtctgcaccgtctccatcgtctccatctccagcgccgcctgctcccgtgcattctgtgcttttccgcgggaaatcagactcatggagacccggctccttgtgcggaggcccctgaggccctggaggaagccgcgcctctgtggctctggattcagatcctgtcccaccggttatccctgtgtggccttggacgcatcacttaacctctcccggggcagttcccacacgtgtgaaatgagctagtggtggcatctgccttccagtgctgttgtgattcttcctcccccgccctctcccccccaccctccagaggagtctcccatgtgtcgaccaggcgagagtgcagctgcgtgatctcagcccactgccactgcaggctcagcctcctgggctcagacagtcctcccactgcagcctcccgagtagctgggattacaggtttatgccaccacgcccagataattttatatatatatatatatatatatatatatatattttttttttttttttgtagaaacagcgtttctcactgtgttacccctctcctgtcccctcccctgcagggcatggggacagctcacggggccttctcccttcagaaacgaagccgcgcgtactccccgtaaggagctgcgtggccaggctccggcatcccctcccactgcagggccttcctggggagtcttggctccgggacccctgccctgcttcagcccagctgcccccaccacaggctgggaccaccccacccgaggccttcctgcccttgcggttcctctccccttccttcttacctccttcagtgaagattcgctattatctgaaattatcctcagtttagtattattctcgaaggatattttcactgagtagaagattctagtttagaagttgttttctttcaccactctgaagatttaaaacatatttttccagtgtcttttggctttactttttttttttgtcagctaattagagcttttaagatatttggtttttggtctttggttttagcagttttactgtgaagttttgagatgtggttttcgttttctttttccctcttcttataaggcttcttgagtctttggactgacgttttctggctgtgtttttgaaaaactttggccattacttcttcaagtagcatccttgctccgttttctgtcatctctctttgcggctggaattgtatgtctttagagcgtttcagtgtatcctttctgtctctcctcttttgttctctatttttcatcattttttctctatatattttattttgaaaatgttttccctgacttatcgtttgatttctcttcagcgattgtctttcaggtcagggaatctttcttcatctatggaattatttttggattggttttaactcctagaattccacttggttccttttaatactgtcctattctctgacaaaatttatgatcttacattttatctctttgaatgtaattgttttaacgtctgtgtcttgtaactttattagctggtgcctctgtggatgggttagtgttgtctctttttgttgggttttcattcatgtgtttttttttttctttgtttgcctggttatttttgattgagttttgagctttgtattggaattatttgcagtaataatttgagtcctgaatggtattttctttttaaagagatgatttatttttatttctggcagatggctagaagcaccagcaattctggatctaattttagggattgagatgatttagactgaggcttcagcccctgcgagggccagcttcccacctgactgttcctcctagggcattgtctctccaagtcagcacagttttctcagcttctctgcagctcagctgccttttatggagttggcacatgcccccaggtaaaagtggctgcaaaagtggggcccatgtctttgggttttcttcttctgagtcttctttcctgccttgttaggtttcttttgtttttatttctttttttaattattttattttatttattttcgcaccttgttaggtttctaatggctttacacagatttagaaagagtattgtgtctaccctttctaattgttctcagcagcaggattgagctgaatcacctaggccgctggaagaggaggttcctgatccccgtctggtctctgatttgaaataccacctttatcaaatgtgaccttatggcctgcgtctgcagcttgcaggatcagacaggcagtgcctcttttgttttgctgatgagttgctcaagccccgtgggcctgtagtggcagcaagttcactccgtcatgagtgccccccacccctgctgtgtaacggccaagggctttctttccccaggggagtgagtcctgctgtggcccgccagctcaagagggagactctcatccactggcaggcccagctctcagatcttgtggtttctgtggctgcgcggtggctcaagaccgtctcccgagtctagtcgtcctcagctgtgctcaggcgctggctgggccggacccctgcacaaatgcccttgctgtgtgtacgttttagcttcgactcctacactcagccctcattccccaggcacagtggccaggccttgggggtgtttgcatcagcctcacgcaccacaggagccagcacccctgccacaaactatggacctgccaccctctttattcatagcaagtctctctaattcctgtcaaatgccccattttataaggcattttgtgttccctttactattctaaaatgaagttcatagatgatatagcctacctacctccatgattttaaaaaaacatataatatccaaactaatatgaaggagacataaaatggaagtaacttacatattgaagtacaaattgtattgtgcaggctcaggcacaacaccagaaaacaaaattcaggcgcttgcccccctacaaacaagtgctgtgactgtcacagccaaggctgcaagctgatgaggtgctgtgattcagctgccgttagcaggcttccctgtgcttttcctgaggcagtaggtgtcactgaaatagactgaagtacagctttctcgccatgcagagcggtgacacggcagttgcattcctgaaaatccactggatattgaaacgatgcagatgaaaacagggcttatttgtaagctggagtcaggttctgggctcaggaaaacaggtcttttctcctgcctgagtgagcagcgtgcatctggcagttatgcaggccagtgggtgatgtgctgatgtaatgaggttcgagggtggcacatctcacacgcgcacgaacaccccgtcgtcacgctcaggaactacaggaggatggaggccagttctttgttgtgtggtgctggctggtgccattcctggcttatgtcttctggatgccagtggctctcccttttttatgatgactggaaataccccacaaatttcagaataccccttggggtggtagaaagattcccctgagaatctccctttagaaacatgttcacagaggagaatcacgaaatgacccctttgtgtctagtttctctttttttctagtttcatccattatcagaataatttttctttgttttttctttttctttccttttttaaatagagatggcatgttgctagttgcccaggttggccttaaagtcctaggcttaagtgatcctcctgcctcagcctctgaagtagctgggactacaggtgcacgccactgtgccttgcttaaaaataatctttttaggctggatgcagtggctcacgcctgtaatcccagcactttgggaggctgaggtgggcggatctcgaggtcaggagctcaagaccagcctggccaatatggcgaaaccccatctctactaaaaatacaaaaattagctgggtgtggtggcggaggcctgtaatcccagctacttgggaggctgaggcaggagaatcgcttgaacccaggaggcggaagttgcaacgagtcgagattgtgccactgcactccagcctgggtgacaagagcaagactctgtctcaaaaaaaaaaaaaaaaaaaaaaaaaagtctttctaatgcatctttgctgatgcctttctttgctgagaaaccttcagtgctgactggtgccctcagtaaaagccccaaactcagctgggcctgcacactcctgcccaggcagcctgtagttggcctcctcccacgccagtcactacagcccaccgtcccgctgctctgtgccatagacccttcttctgcctggaatggaagccaccagtctctccactcccaggtcagatgtcccctcctgtgggacagctgcagcagacgcttctcctcctcgctgcccatggcattttgtgaaccctgtctcgtccgttgttagtctctgcgtggcattggcgcttcctgggtttgtcttgtctgtttttaccgagttgttaggtccctggcggtcttgttagcctccttagatgacacgggcctgcacacagaaagtactcagtaggtgtcactggtgcgtgacctgtcacctctggagatcactcagtctctgatctggctctgaaaccctggacgagccaggctgcgtctgatgactgtagctgagcatggaaagaagacttagcacacgcttgtgtgcagtgggtactcggggcaccctgcgtatgctcagctgagggggtgtcaggaagagagtgggcatctctgaaagctttcattcttggccaagttgtctacggcagaaacgtttgccttttccccggctgatgcgtgtgagattgagtgagagaggcaagtgcaggactctctaaaacgacaacaggactccagagacggggcgggggccttcctgtttcagcaacttctgcccaaaggagagagaaacccccttcccttctggtcacttcagccactggactggcaaatgtgagtgtgcggcatggagcagacatcctgccaccctccctgggctctggggcagctaggcatgaaagcagaggctgctatgacgccctgggtggccttaggtctcagcactgccctggagtgtcagctcctgctctgctggcctccctccgtgttaggaggccggcccctgcctccatcgccccctgcttgcagccctgagtgtctgagaagccaggccagggcgaccggcccagcagccctgaagtggtggctgtgattattcgggcgttttggggagacagctgacagcacaagagaaaagcacacacacgggagactttgttgagatcatcgttacgtctccgttttcctttcccaggtctaggtgttagcagtggatttaggcagcagtttcattcatgggtatagagcagcaagtctcaaacttgtgtcacctggagggtttgctaactcagattgctgggccactgtccccacctcagtttctgagtaggtccagggtgggccccagggatttgtgtttctactaagctgccacctgatatttatgaaagctgctgtctagggacccaccttgagaaccactggtataagcggtagtttttcttacagaaaaaaagtgaatatttactaaggatactgtttcacttaaatttattggatatcatttatgttggatattatagctcagatgctgtattttattttttaattttaaatttttatagaaataaaagaagagcttgaagatctgaacaaagaaatcaagaaaactgcgaataaaattcgagccaagttaaagggtaagtttgaagttttatgtttaattattgatgttgggagtatgggtatttgttatttttttctttattggtttttgttcttttacatttttaaaaattaaaatagtgactgctttaaaataaattatttgtatgtaattcagagtactaattaatattcaaaaaggttatgtgtttgcttataaactgttatactgttacatttttgatgacatttcaggctaagttgcagatgtttgggaaggtgagttgccaggctcttcttgaatggaccctttaattgctcatttctttcaaactttctgtagaatttattcgatgatgtttggcattccactttagcagcagtagttttttgggaggcttatagctttgtcatgtaaaacaggggacttaaacagaggttgctttttctcgatttggtagaaaacatgttgtatttgatttttgcagaatggcatcaagatcaaaaacaatctctgtgcagatgataaaatacttttattacggcaggtttcagatgtgtgcagaagcagagagaggcgaccacaagccgaccccccagctccacagttctccatgagctcccacccgcacccgctcccagactattctgaagcccatcccaggcatctgagatttcatcagtgtgtatttcaaaaacagaagcttccccaaaagcacaaccacaattatatctaaacccaaattcattataattacttaatagtacagaatatccaggcagaatttccccagtggtcttacgattttttttttttaaacagtttgcttgaattgagtcccaaataaggaccaaaccctggcttttaaaaatgagattctcccttcatgatttttctctctgcactttttcctttggttggtgaaaccaggtcatttgtcctacagaatctgccatgctgcagattttgctgattttacctctgcagcacatttaataggctctgccgtcctctgaatttgctgtaggttggtagttaaattctccaagctttatctgattcaggtgttttttgtgggtttttaaaatgtaaagatgcagcatctgattacagattttatgtcctcatggttacgttaagatgttaatggtggcctggcacggtggctcacgcctataatcccagcactttgggaggccgaggcgggtggatcacaaggtcaggagatcgagacttatcctggctgtcacggtgaaaccccgtctctactaaaaatacaaaaaattagctgggcgcagtggcgggtgcctgtagtcccagctactcaggaggctgaggcaggagaatggcgtgaacccgggagacagagcttgcagtgagccgagatcacgccactgcactccagcctggtttctagaaaagattccatctcaaaaacaatttttttgaaaaactgcttgatgaactactgccctggatgggcgcggnggcgcgtaaaggcgggggccggtgtgtattaaaactcgcacctattcgctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggccagtgatgattcgagttcgactgcaagtagttcatcagaagttgtgtaaacagcttttccagctcaaatgcagcaatgcatcggactgctgttgccggcacgttgctgggtgccttcctcggttacatgcatgacacagcccttctgcggcaggccctgttgctcatgtagacccattttacagatgagacaatagtctttgagagatggaggggctctctgaagatcacacagctggggagagatgggcccagtttcaaacccgggctgcctgaccgcgaagctgggttgggactacagcgctgcaggacctgtgagatcccagagaagctggggcggagccggttctgggtcagatgcagtcccagggagctctgaaacacgcctgtgtccagggcccacgcgagcctcttagagaaggtgcagtgagctggggcgcaggtataacagtattttcaaagcagctttatttcactaatttgtttttttgagacagggtctcactgtgtcgcccaggctggagtgcagtggcataatcccggttcactgcagcctcgacctacaggctgaggtgatcctcccacctcagcatcctttgtatctgggactgcaggcgcgtgtcaccatgcctggctaattttttatattttgtagagacagggtcttgctatgttgcccaggctggtctcaaactcctggactcaagcgatcctcctgcctcagcctcctgaagtgctgagattataggcacgagccaccatgcccagctttaagactgctttactgagatataacttacctaccatccaattcatccatctaaagtacaagtcaggggttgtcagtatattcagagttgtgcaaccatcactgtcatcaatgttagaacattttcatcacctcaaaaagaaattgccattaagcaaccagtctcctctctcctctcctcccagccctggcaactgcgaatctgctgtctctatagatgtcccgccgtggacatcttacgtgaacagaatcatactacacatggtcctctgtggccggcttctttccctcagcacagcatcctcaaggttcacccgtgttgtggtgtgtgtcagagcgtcatctctttttatggctgaataatattccactgtgtggctggaccacatgtttacccacaggcatcagtactttctaaaaggcctgagattattgcaaatatagtcatgtgtaatgcgtatagtctctctctctctccctctctctcaatccccccatttcttggctaagcatttgctttgccaaacatgtcctcttcccagcctctatctagctgttgcctacatgtgatccactaatatccgccactttcccttcacatcctgattctgagctcttcttgctcgggccgcctcggtccccttggccagagacccctggtcttgtccctgggccacactgcctcagcgcccccaggcctcctgtgtccacctctgcctgcaagtcactctcacacagcagccagagggctcctgttggaaacggctcagtccacgcccactcttggaagcttctgattgcatttattctcacttagagcaagcgcaagggcctcctgatggccacaggcctgccagctcttcctccttcatgtctttgtctggaaggctcttctcccagctactcactcatcatgttgttcagggctctgctcaaaggtcaccgcctctgagaagccttccctgactgcctgccatgacagcagccatctggacctcctgtcctatcacctgttctgtttcttgatgtgcctccctccctccccatgggaggactcctgggcgtgggggggaccttgttccctgctcctcccagttgcctcccttcaggtgggcaccgttccattctgtgagggcacgaatcctctgcgtacctatgccagcatctgcagctggatacgactggcagttggaagttctgagtgtgtctgcgtctttccgggttgttctgtgaccccaccgctcttcctgctctcaggcctgggtgtcccctgggccactgtcctgtgtataccccggcctgcttcagctctcacgcccgggccctgctcaagaacaggaaagagaatcttgtcgcttgaggacacgttcagttacttgatgttttcttggtcatttcaggatttcacattgttaatttaggatttttctctcttccatggggtagggctgggaaggtgggtctctcagcagaggcacaagctagacctggcggagcttgtgggaaatgcccattctccatcaatctgcagaatgagcctgcggcatttgggaccactggcggctgccgaatcactgcatgataattttggtgataagtctgtttggagagcaatagcatgagccatgaaaacaagagccggcctcattgaatcctcaccgtaccccaggcctgttctgcactcttcccaccagctagctcatttaactgtcaaaaggcaccaacacccagaaaggttaagtcacttgcccaaatccttatggctcctgagtggagcagccaagattcactgggcactttcgccagagcgcctgcccctggccactacgccatgctgccatggggagcgcggacctgcctgtgccccacagcatctgtgcggggagctgctccgtgaacgtgtccctcggaagcagccttcactggtggaattagccacagtcacagggcagagtctggagccaggctggcaggccccgatctctgctctgctacttccggctgtgtgaccacaggctctcttctgaacctctctgcgctttcgttgtcttatccataaaatgcaggtaacaatagcatccgtcttctcctcgacggattgttattgaaggcattcactggggaaaagtgcttagtatcttgcaacactcaataaagattagcaattgcctttatttccattcagatggggacggcagaaggggtgctttgatgattaaatgacttcaatggcacagagcatttagaacagggcctggaatagtgtgagggttcaacaaacattagctattacgattcctgctattattattaaactccaaacagaccaatcattagcatgtgaatggaattagtagaataatacagatagtcccagaaacgggtcctctgaagcttgtgcagcccagatttcttgtagatgcttccgcagtgtatttatttttcctttctcatgagcagagctgtctaaagtgtgtgcgaagtgagccggtcacggtaggagggagacacttttgcacgaagtaaccatcagcatttttgtgaccttgcagggatgggtaggctgggaagagaacggcttctgcctccgttggtcccagccacacctggccaccccattggtgggcgtttgccttggggcactgggcctgccctgtctgtgttgggacgtttttgcaggctgggcgcctgtggccctgcagcagttcactcctgccatacccagtgtgctccagcgtcacagaaggagagaaagagcaggaaagcggtgtgcagcaggagaggcgtgagaaccgcagagaaacacagcaaacgcctgtgctgagttgttcgttagtgaggagctggtcaggaagagcgttttacagggaaccacgtgggctcctgtgtgggcctgggacagctgcgtcccttccctgccagcctctcccccaggaggcttctgtggcccacagtcacggacatgacaaatggggaaactgaacctccttttccccagaggtgaaagatgcgttaggaagcacagggcggtggtgcggcagccagggccccggtctttgttgcgtggtgactggccgggaggctccgggcggcttcatgagcctgtctagtcttggtctctgcttttcaccagtgggaatattaacatctcattggttctcctgggcttcgggtgtgcaggcatcttcttcctaactcatgcatcctccagtgtcattgatttgtgaaaaactcagtttcaggcacatccgtgtgactctgaaggcggaaccagagcaatgtggccacggagaggagcccccagaggcagccggtgctggcagaggcagggatcctcacgcagctttggagggagctggtcttgccaccccggcttctgggcttctggcctctagatctatgagagaagagatgtgtgttgttttgagcctcccagttttttgtcatttgtcatggcagcccaggaaacgagcacaggagggtatcactgtccccaccatcgtggagacagggacttggacgcacagacaggtgaagcagctagcccaagatcacatagctagagagcagcgatgccaggacctgaaccggtgaccctggtggtggagccccggagcctcggcccgtcttgcaggtgctctctggctggcagtctacgctttgggaaacagacctgtggaggcggtggtggcagggcgaggggttatgagtccacggagggaacacctttggaaagtgggttagaaaatgcggagtgccatctaattaatttgagatttaaaaacttccctttagaagccatttacttttgtttattattattattattattgagatggagtctggctctgttgcccaggctggagtgcagtggcatgatcttggctcactgcaacctctgcctcccgggttcaagtgattctcctgcctcagcctccaaagtagctgggattacaggtgcccgccaccatgcctggctaatttttgtatttttagtggagacagggtttcgccaatttggccagttggtctcaaactcctgacctcaggtgatccacctgctttggcctcccaaagtgctgggattacaggcatgaaccaccacccctggctttttgtttattttttaaacaagacgtcaggagcccagccctaatgagagctgctttgggacgcgggttgagttgccagggcccacagagcaccctccctctgcctcctcggtcctcgtccctcctcctgcacttcctctgtcctccctgcctgtgttctggtgcctggagggaagtcgacctggccatggggtgcttccccagctgctttccagatgaaactgaggttttaaaatgctgcttcatctggaaggatggggctccgatttatagctttcttggtacagaaagggagatatttaagggagactttgctgatgtccctaaagtagcaggaaggtggtgtgttcccctcaccggtgagcacagctggggcactgcctcccagggtggtcgggccccagacctctgcgctgcgttcaggctcaggctcagggttccctccgtgcttctagatcgatctctctctctctctctgtatttcctaagctgttcaattgtgggtgctgttttcctttcttctcccctaggaaacaccgtttcaaacgcactcccaatatactacacatgacaactgaatcttatttaagacgtggagaagccacccgaccccaggggaggctgagcggtgggtgatgtagagcgctaatcagggttaggcggtggcccctagtcacgtgagggctaaagcgcccggatccgattacgggatctgatggagcccatgccagggcccggccctcagactgcggctcagccctgagctgagcaccgggtggtcgcagcagtgggtgagggattggggagggcaggcgggtggccgagggagtgcccgtgccacgcttttaaaaaacagtgatcgtttgagaatacagcactcttcccaccacagttctaacacaaggtcattttcaaacactgatgttagatggtgattttcttattagtgaattagggattcttgggcaggcttcataataagtgcaggaaactgaaaatgtccagggcggagggggagcccgcctggaggttaatcggggtgcacaaggccaacaccaggcgtcatctgtcaaccaggagggtgactctcctggttaattggctgcccccatgctaggaggccggaccactttggcaactgcaattatctccaactgccaggcaaagaatcccacccctggcctgctgcagtgacctggtgacctggaggcattacaggaaaatcctgttctaatgaacttctccgggcatctgagtagcagcagcatttttctgaaatgaataaattgctggaaatcacagtctcattgtctcagcccaggaggaaagaagtagatgctctcaacccctgttgaggcaggtcccggctgagcacccgggatggttgatttcatggaatttccatacagccctatgattaattccagttttatggatgagaaaagagcggccccaagaaattaagcaacttgtccaaaggtgcacaatttgtaactgggtttggggaaggggcccaagattccgatcaggatcatctgattccagggcctctgtcctcaccgcccggccatggttcttactaaaagaaattaatactaacaaaacaggaagggcttgcacacagcctgtcttgctctcacacacaccattcctattttcttctccttcatcttacatgtggttccttccttccttcctccctcccttcttccttccttccttccttccttccttccttccttccttctttcttgttttttatttttttattttttttttgagacagagtcttgctctgttgcccaggctggagtgcagtggcatgatctcagctcaccgcaacctctgcctccagggttcaagtgattcttctgcttcagcctcccaagtagctgggattacgggcatgtgccaacacgctcagttaattttgtatttttagtaaagatggggtttctccatattgatcgggctggtctcgaactcccgacctcaggtgatccacccacctgggcctcccaaagtgctgggattacaggcatgagccactgtgccccgtcccacatgtggttatttcattgctcttggtggtggaggcaatttggaaatttacccaaaatcattgctaagggttcagctagagagaagcttagattttcctcccccactgtaatgcaaacagctgggacccttgttgtttagttaggaagagtatgtgtcttgtgggctgggctcatcctcgtactggattattgactgaaattggctggccacagggagcaacatccacatgggggcctctttcgtgccgcattatgttttggtgggccttgtgcctgcagtcccttccctagagcatctgttccttctagaacatacgtgtgtgggctgcatgtacctccagcggggtgaaggaagcattatgggaaggggtgggccatggcaaccctgatcccggctccttggttttaaggcaggttgtcaggtataacttgttttgcccactgagttgaaggatgcgttatttaaagacgtgctattatttggcccaaagatcttgaagaaaaacaatgaattttgcagcttcccacactgtcaagcaggagcaatttgtgtcccatggctttgagggggctcaagtcagcatcaggtgctacagtcggtctcacagtctcacgccttccttgctcagacaccttcccctacaacgtgcccagcaaggtacttttcaccccatgttcagacgcgggcctgactgtgaaggtttcctgtgcccggctcccctgggctgctctccgcccctgagtgtgatatgggacctactggctgtcggcattctttggaacccttgtgtcttcaggggttgtaaactccaatacaagcagttccacgtgtgatgtaagctgagtgtaaggcagaaagtgccacgtagcttttatgtcttccaaccacaacacctgctggttctgtatttatagaacactccaaggccttcccaggcagcttggcaaagctgtccaccccgctgtgttaggggggcttacagcgtgagggccccggctcagctcccacctgctggggggctctgctgcttcccttcttaccccgtgggcatggctcagagtggctccctgtctgcagctgaacccagtggcctccaactgcaatgacatcctgcccatccttcgaaatcacacggaaaccttgtatttgtgttttagcccttctcagtgtttacctgtgttctagagacctgtgcactcttcttgtctgtcctagaaaactacttgctaaaaggcagggccatgttacatgtggcacacacaccatgctcagtacaggaagtgcttgtacacagtggtgcttacaaagagtacacagtgggtgctcacaaagtgtgcactgtgggcattcacaaagtgtatgcagtgggcgctcacaaggtgtgcacaggaggtgctcacaaggtgcttgttgtgtgatggaacgtttggaatttgttgggtggttggatcagtttcctgcagctgtcataataacttagaatgaactagggggcttaaaacaacagaaatctcttccctcccagttctgaacacgaaagtctgagatccaggcgctggcagggctgtgctccagggtgggatctttcctgcctcttccagtttccagtggctccaggtgttccttggctgtggccagccccctgcccccacctctgcctctgtctccacatggccttctcctgcggctctatgtggccttctccatctccagaaggacattctcattggattgagggcccctgacccagcatgatcccatct

SEQ ID NO: 712 - DNA, 199261 bp, Homo sapiens
  misc_feature (1)...(199261): n = A,T,C or G
gtgtttcggatcgatgcagtagttcatcagtgtgtgtatacacacacacacacacacacacacacacacacagaatctcacttctattgcccaggctggggtacagtggcatgatcacggttcactgcaacctctgcctcttggggtcaagcaattcttgtgcctcagcctcccaagtagctggaattacaagcatgtgccaacacgccctgctaatttttatatttttagtagagatagggtttcaccatgttggccaggctggtctcgaactcctgctggccattgcttttattttggagaaaataaactgaagtgggttcaagatgactccatgaccatcagccccacccgcatgtgttccagtgcatttacttgagtgaaagaaagagctaggagtgcaaagaatgccagacacacccttggtgtcatctgaaggctatgtcctggcagcgcaccatttgaaaccactatcatagatggtcacgagtgctgagaagaagtgggggaggggagtcaggctagctgcccccagagtgctccccgagctgaccctcagtgacccttttgcctccctagaagtgtctacctcatccagccctgggtcttcttgggcacacaaattttggaagccatctgctgatttcagggctctaggaaatgctgaggccccttgacagctggcgtccccacagagagttggcacctcctgaataaggagtggtctcaggagggcccatcccatgcacagaagctccaagtctcgtctcagtccccccaccccactgagctttgtaggctccccaggcacaatcataggcagcaggcctgacccaacccagggcgctggtgggatggcatcactgagctacaaaggaggaatgccccggccactgtcctgaagagggcaaggccaatttctccggaggcccggagccttgccaactctccgcatggggaaatctgcctcttcctggacagggaggaagcagatggagctgcagagtcacgctgggaaaccacaatagaaaaaaaggagagaagatattttcctgaaacaaaaagcacccagggagacctctgggctttcagtctggctagtggagttcacgtgtaggtatatcaaggtgcaggggagagggatagggtgggaacagaactcaaatgagaccacgtcgtagttagcctgcaagaagcccactaactccaaagctgaggaagcaggccaagcagatgccaagcctcatgggtaaactgaacggaggtgcctgtgcccgggggttcatgcagcagagagggttccagggctccaaccaggcttggctggcctggcctccctccaccatgcccagctggctatgccagggattgatgggggagggggtacacacctcgcccctggtttggattttattgcaggagacactctggggctccgcaaatccagcccagcagagccagagggcaacagcagtacgtggccgcaatgcccagaaacaccacacagaaagtccccatgtacacacgtggagcattccagaaggttgtttggaagttggattttgagctgtggagaatgtcttctaatagaaacaatactctgaggggaaactgggtgactgttcaggtagactatttacatcactagctccagtggatgctaggttctgcagtgtctgcagagattgctgtcttgccatgaggtgctagggtgaaccccatcattcctccttcaggcagtacctgctctgtgcctagctatgtatggggggcacagctgtccttggacgctcctaagctaaacttcccaaggacaagaaatcccgtgcttctgccccctaactactgtactgcaacacagggagcttcgtggtcagctagggaacttctgacgggaaccaaactgtcgggtggggctgctccttctcctcctgcccatctttatgttcagacaggaaatggtcaccaaaaaagccagggagctgagcaagcacctgtcccactactgcccttcctggtgccactggtttctcctttttaaagggtggaagtttctgctgggtgtggtggatcacgcctgtaatcccagcactttgggagcccgaggccaacggatcacctgaggtcaagagttccaaaccagcctggccaatgtggtgagaccctgtctccactaaaaatacaaaaatttaggccaggcggggtggctcacgcctataatcccagcactttgggaggctgaggcaggtggatcacaggtcaggagttcgagaccagcctggccagcatggtgaaaccccgtctctactgaaaatacaaaaaattagccaggcatggtggcgcatgcctgtagtcccagctactcgggaggctgaggcaggagaatcgcttgaacccaggaggcggaggttgcagtgagccagtatcgtgccactgcactccaacctgggcaacagagtgagactccgtctcaaaaacaaaaacaaaattagccaggcgtggtggtgcatgcctgtaatcccagctactcaggaggctgagtgaggcaacggaattgcttgaacctgggaggcggaggttgcagtgacctgagatcacaccactgcactccagcctgggtgacagagcgagactctgtctcagataaataaataaataataaattaaattaaataaaaaatctgagctaatctgaataaattgagagatttcacatgaaagccaggatttctggcttcccaggaacagtcagaagagctagctagcaacactggtctgcttggctaccttctttggaacaacatgaaatctagctcccttttttttttttttttggcccacttcatccattcacatgacctgcctggcctctgcaggtaagtgagtatgcaacaaaaatgtagcacaggttttgtcgctgaactacgtggtttcaggtccagctctgccacttgctagcatgacacctctttgagctcagttccctcatctatagaataggtataataactgccccttatataatggggactgtggggttcccaagcctcactcaagccatttagaggaacaaataagataacaatcataaagcagtcctggtacatcacaagcacacagccatgcatatcattagtgcctatctcaccaggtgacaggtgacagatgggggatgaggagctgtcccacccacaaagctgacatccctgattgccccaccagagcaagtgcatgcccagcactgcaagccataagcaactgcagagaaggtgctctgacaggtgtcagttaggtagtctgactctcccacagtggctccagagtcacctgttaagacactgggaccagaccatcagactgtaaacaagatctgggctaaaaagctgagaggctttgcaggacccaaccaaaacagcaatctctctccctggctttgaagccattcccaagttcaaagggtcaccaagcagatgcatctggaggcccctgcattcgtggtgtgggaagctcagtgcacaagccaacaggaagaagggcactgctgatcctcccaggagtccagtccaaaagctggcatcgcagccccacagtgctcccaatgacgcaagtgccaagaaaggagtccagggatggcccttctgaagtctctgcctcctaactctgccagagcattcgccattggaacatcgacactaacccacccaggactgactccagaggccctgagtgtcaggcataacagtgcccacccactcagggtggcctgcacctggccccacaatccaccctcttcctgctggctcagttcagctccctaaccctggagcaaaagtattccacattctctttttttccctttcaaagggaaagggaggaagagagccccccaagggagctaaactttatatcagaagtcttaatctggcatctggagctgaccctcctggggatctgtggaccacctgaagtttcactaccatgtccctaccacactactctggggagagatcccaatagtcatggcccaaaggggttgggaatctgaatgaaaccactgccatgggcaggcctgacagtgcaccaccctgcccctgtcagatcacagcttggtcctttgaagacaagtctgatcactaggggctgaagctgaagctgcctcatcttcacctcaatcccaggtgatcagaatttctggaatgggacctgcctggacactgacccaggcagcaaactccagtgaagccaccccagttcaggaggcacaaaacagatgtggcctcgcttgggtatccaaggcagagccacctgcacctgtctcacgtgcctcctccaagaccctccctccgatgctctcactgggacagcctcacctttactagtgatggctccaatcgcgttcacaaacacatagtgtgcacgggcactatgctgggcatgggaggggcaaatatacaatgcctgtctccggggagcactgactagtgggagactgtcataaacgaggggcagaaggccctgaaagcggcagtgggccaggaggaaaggggaggggctttccaggcagaggtggaaaacagcctgggaaagtgcccagacagaggggatgggagctcagagtgcaagtcccagcttgatggaagaggagtcaagggccgagggcccactggggagtctggacttacaagggcaagccacagaaggaaggcggtcagcagcggaacagcaggaccaggcttgcactttacatcactcaggcaggggagatcagagggaggcagggctcaattggaggaagagcaagagttgcaatactctacatgaaatcaggtaaaatcaatgttacctggaaactgagtggatatggagaaggagtgaggagtgcaggatgcctcccatgtttgtttcctgcaggagggatggaacagatgagacagggaagaaggtctgcggcaggggtcaggtaatgacggtaacaaggatcaggagttacaccaagaacaggcagagccacagtgttccctgagccagggcccaaggacgtttttctctggccaaggcacctatctaagtaacagtttgttaaattatatggtacccttctcctgaacacaagttgttctccctgtctggctttgggagaacctcaggaagttgcatgcagcctgctctgggaattctcagagtgttcaggaagaccatgggctcccttcctctgcccgcacccatctgcacgagtctgcctctgaaattcaaatagaaagccagccccatctctgacagccgtcctccaggaaaaagaggggtcagcctaagcaggttatcagaggaaccagatccttcctgccacatgagcatgcggctcaccactggggccagagggcccaggacacaatctcaggcctcaaaccctcatggaaatgcccttcagaactgacccacggccccagccccagctgaccacagagagactttgcacagataaagctcatctcatggccaagtgtggtggctcatgcctgtaatcccagcactttgcgaggcagaggcgggcagatcacttgaggtcaggagtccgagtccagcctggccaacatggagaaaccctgtctctactaaaaatacaaaaattggtgtggtggtacacgcctgtaatcccagctattcaggaggctgaggcaggagaattgcttgaacctgggaggcagaggttgcagtgagccaagattatgccactgcactccagcctgagcgacagagcgagactcgggctttaaaaaaaaaaaaaaaagctcatctcactgtaggataacagatgccccaaaggccagccccatctcagctatcgtagcaaggtcatccccaaaaggtcattccaatgaagatgcaaagcctaatgactgtccttggccttgtggctcaggataagtttgattagcttgaaagatccaactggacacagggcaccaaatcactaccaatgaactaaacacacatgcttgcacacacgtccgccctccaggcctctgcatgagctattccctctccctagacctctctcctgtcttctttaccaggctaaatcctttctaatcccttgagactcataatagcttagtttatcttcttcaacgagaggataaaaaggatccatcctgcctacctagagaaaaagcaacgtgttgcttttctgctgggaaggtctctttccaaaatcttattacagaatgaccatttaagtaaaggacaaaggttggggccttttctaaatgttgaggttctatttaaacacacaacaaaaggccgggcatggtggctcatgcctgtaatccaagcattttgggaggccaaggcgggacgattgcttgagggcagaaatttgagaccagactgggcaacacagcaagaccctgtctctacaaaaaatttttaaaaattcgccaggtgctatagcacatgcctgtaatcccagttacttaggaagctgaggctggaagatggattgaacccaggtgtttgaagctgcaagtgagctatgatggcatcactgcactccagcctgggcaacagagaaatcctatctcttaaaacacacacaaaacagagtcagtttaggatcccatttcctccaggaagccctccctgaccttactctcctacaaagggtttgaggctccattcctttgagttcccaaagcactgtgcacttctcctatgagaacacctcaagctggtaggaactgtctgcctaaggggccatgtctcacagcctaggaatagcacattgtgggtagggagtacgcctatattcatcttcatctgagcattgggcagagcctagcatataataggggctccatggatgataccaaacaaatcaacaaatgacctgcgccaagtcagtctgctgctgagatcagccttgccacttcagctcatgccacctcctggtcctccctaagagctcactgtatgcaaagcccggtgagggagagcaacacaggagcacagggcccaagttgttcctactcttctatcccagaatgtcccatctactgtgatctagttgccaccacccctccccaaccagcaaaactcctaccctaaaataaacaaacaaaaaaatagctgggcatggtggccacatctgtaatcccagcactttgggaggctgaggtgggtggatcacaaggtcaggagttcaagaccagcctggccaagatggtgaaaccccatctctactaaaaatacaaaacttggtcgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccaggcgtggtggcgggcgcctgtagtcccagctactcgggaggctgaggcaggagaatggcgtgaacccgggaggcggagcttgcagtgagcagagatcgcaccactgcactccagcctggatgacagagtgagactccgtctcggaaaaaaaaaaaaaaaatacaaaacttagctgggcgcagtggcagacgcttgtaatcccagctacttaggaggctgaggcagggaagtgtttgaacctgggaggcaaaggttgcagtaagccaagatcacgccactgcactccagcctgggtgacagagcgagactctgtctcaaaacaaataaataaataaaataaaataaaataaataataaataataaaaaaaaatcaaaggaatagtccacaagactttgtggctggagcatagccccttgtgggtacttaaggtttaaactcactgggtggcctatctggcttcctttgtgggtggggaaggggagctccaagaggtgggctcagggcataggaatgaggcagctgggagggagttggggcctgggactgggtgactctctggcttggtgctggggaaggaggaggaggggcatcacgtagcaacagagcaagaaggaacaggagtgtggcagccccaggccctgcagatctggtcacacctctccccatggagcagaggaggcaggggacatgagctggaatgtgcgattttctcaaacgtgcaccaccggaatgtgtcagcaacaccaagtgtggggctgtgtagcccagagagactgacagcatcgattatcatgactgaagcacagatgggatgagccacaaagcacgtacagattagtgaggctgagggagttcacaggcagggaaactagccagggaggaagaagacaacacgttctcagacgagaatgggaaaaggaggggaagaaaaaaaaaaacaaaacaatgttttcctgacatttttgttaacttctttagtcttcaaaaaaaaagaatgcggccgggcacagtggctcacgcctgtaatcccagcactttgggaggccgaggtgggtggatcacaaggtcaggagatcaagaccatcctggctaacacggtgaaaccccgtctctactaaaaaatacaaaaaattagccgggtgttgtggcgggcacctgtagtcccagctacttgggaggctgaggcaggagaatggcgtgaacccaggaggcggagctttcagtgagccgagatcgcacgactgcactccagcctgggcgacagagcgagactccatctcaaaaaaaaaaaaaaaaaaaagaatgctagaaatattatagtaaatttgtggacaaacataaaaggtggactacatagtacgggtttcataatatatgtagaaataacaaaaaacaggagggggaaatggaaatatactgttcttacattatacgtgaaatggtatggtatgatttgaaggcagattgtgattaatttaaacctgcaaaccacagagtgaccactaaaatcaaaccaatgaagtatagctaaataagcaaagagtggaaataaaacagaaccctaaaaaatactcaatgaatctaaaacaaggcaagaggccagacacaatggctcacacctataatcccagcgcattgggaggccaaagcaggaggattgcttgaggccaggagttagagaccagcctgggcaacacagtgagattccgtctctacaaaaataaaaataaaaaattaggctgggcacagtggctcatgcctttaatcccagcactttgggaggctgaggtgggcagatcacttgaggtcaggagttcgagtccagcctggccaacatggtgaaaccccatctctactaaaaatacaaaaattagctgggcatggtagcgcatgcctgttatcccagttcctccagaggctgaggcatgagaatcacttgaacctgggaggcagaggttgcagtgagccatgcactccagcctgggggacagagaaagactctgtctcaaaaaaaaaaaaaaaaaaagaaaaaagaaaagaaaaagaaaaaagaaaaatttagccaggccaggcgcggtggctcatgcctgtaatcccagccctttgggaggctgaggcaggcagatcgtgagatcaggagatcgagaccatcctggctaacatggtaaaaccctgtctctactaaaaatacaaaaaaattagctaggcatggtggtgcgtgcctgtagtctcagctactcaggaggctgaggcaggagaatcacttgaacccgggaggcagaggttgcagtgagccaggattgcgccactgcactccagcctgggcaatagagtgagaatctgtcttaaaaaaaaaaaaaaaaagaaaaatgtagccgggcatgttagcatatgcctgtaattccagctactcgagaggctaaggcaggaggatcacttgagcctaggagtttgacactgtagtaagccatgactgtaccactgcacttcagcctgggtgacagcaagaccctgtctctataaaaaaaaattttaaaaaaaagaaggctagaaaagaagaaagaataaacagatggcacaaatggaaaatgaatggcaacatgatagacttcagtctaaccacattgataattactttaaaatctaaaaggtttatatactccaattaaaaggcagagattttcagcctgggtagaaatgcagtatttaatacatgctatctacaagaaacatactttacatataaagacacagatagattcagtataaagcaatggagaaagatataccatgcaaacactaatatcaaggaaggcagagtggccctttgagggagccagctggcagctgccactaaactctggtgtgccctcgcctgctcctgagttgccactgtttgccctcaccccagaacaagtcagctaggaagccacaccacagctatggctttcaaagccatccgtggaactagaggtggcaatttattaaatcagaattaccctagcctgccgcaacatcaaatctctggagaaggtgtgtgctgacttgatcagaggtgcaaaggaaaagaatctcaaagtgaaggatcagttcagatgcctatcaagactctgagaatcactataagaaaaacgcctcgtgatgaaggttctaggacaagggatcgtttccagatgagaatccgcaagtgactcactgacctggatggtcctcccgagattgctaagcagattacgtccatctgtactgagctgagattcaaggttaaagtcaccactgcagatgtttcaagcaactattttattaacagaatagcagttgtttaaaagaaaaaaagaaagaaagttgaagtgcttctgttaatatcaggcaaggcagacttccagacaggaatattaccagaggtaaagagggacatttcataatgatgagtcaattcatcatgaagacataatcatcctaaatgtacacccactcaacaacagagctctaaagtagataaagcaaaaatggacaaaattgaaaagaaaaagtgacaaatccacaatcctagttggaaactggagactttgactctccagttgagaaagctcaataattgagaaaaaactcttccaaaggaagccagtggaagatataagcaaataacccaagagaggtgaagagcaggaggacagagggctgccagactgctggtctggggaacatgagggaccccagcctttgctcacggtagaagagggggctggaggatggccacagagcaggaaatgctccctcctctgtccacagcccctagaccttccccagagggaagcacgccagctcacaccacacttctcctggggtcattttcagtccctgataaccctggataggggtcagtgttcaacagcccccactgccctcagcagacacctggttgactatgtttcctcaattactgcacccccaagcacaccatatacaatccacagatgactttcacacacacacacacacacacacacacacacacacacacacacacaccagactgtcccctctcttccctcctccccagtggcaccgcgtggcatcaccctcattggcgagcaggaatcagaacagagtctacaatgtcagcaaagggctgtatgcgacagtcactgaatccaatcccagctccaccactaatcagcaactaacctcgggcaagttgctcacctctctgtgcttcagtgtcgtcagctagaatacctacttcagagggctgttgtgaggaaatgataagggaacgtaagggaggtatttagaacagtggctgccacagagtgagtaacactatattaatgctggcagttatggccaggtgcagtggttcacgtctgtaatcccaaaactttgggaggctgaggcgggtggatcacctgaggtcaggagtttgagaccagcctggccaacatggtgaaactccatctctactaaaaatacaaaacttagtcagatatggtgttgggcacctgtgatcccagatacgtgggaggctgaggcacgagaatcgcttgaacctgggaagcagaggttgcagtgagccaagattgcaccactgcactccagcctgggcgacagagcaagactctgtctcaaaataaataaataaataaataataaaataaaaatccacaaaaccccttttgtaattgtggtcttagatggaagctcaatatataaacagagaaaagtaagcagctctgactgaagaagatgacggccacaaactcccaagcataggaggaaatgacatcctaaggttccttccagctctggaagcaccagaggactctaagaaagaatggatcagtccagaagcacagagggggagtgcagactgataatacccaacaggccgttaggagggaaaatctcagacagtcgaagcagggagaagaggaaggacagagcccaagccagtggtgcccaaaggagctgctaccagcaatgccctcaattgccagtgatcagccaatcaagcatcccccaggatggtgacaccccagcccccatgctttggccaaagtcaggcagataacagctgtctcctggtcactgttcctgctgctctagaggcacaaacaggatgtttagaagcagatgaccacaagtgaccacaggaagccatgacaaccgcctccaggtaacgatcttcttccccagcttctttccggcttggctgcctccaaagaccagacaaaaagacttcaagtgccaacttccaaagagagagaagggggaggagttcttggaaagttcaggacacagcagaagaggccatttgaggtggtgaggcagggaagaaatgagaccacccagctatcccaacagctacctcacctcaaagacgcattgtgcctgatgaagctaagcaggggtgaagaaactgcacatccactgcttgggacagaggaccttccaagacaggcagcatgtgaccaggcaggctcaggagggctgccaagtcgtgtctctgaggagtgactgcagtgttccaggcatcacgaccactcctccacacccaccccagaggagcccatcccactcagctgtcccagagcacatcagtgatgagaaactgccttagccggccagccgagccaggagtacacaggggaaatggcaaatccagaggaaaccaagtgcaggccattggacactcccatttccacctaaggaagaggaatgttcctggaaacagagggggcaaagctcggccaggactctctgagccacttcaaacctccaacagagcccagggtgggtcccacagatcaactacccctaaaggggtacagtcactgggccagcttcatgacacagctgtgtccactcagtgtacaaccaccaagttcacagtccagaaaaccaactctccttttttctactgctactaggagcctcaggggccagaccaccccatgaggctttctggatgcctagagtgctaggagaagcccagggctgatctgggagtggatctcagcacagctccctgtggcagctctcactaatattagtgttagatgagcgattagtataaaccaagccaccaagccacctcctcccccaccacttcctcatgaaagccaccaaagaggctcaggggaaattaaaagtcatataaccaaaacccaacttaacaccaccagcccaagggtgtggccatttcacctccacagcagagttccaaacattctccaacccatggcgccatgaagagtcctaaatcacattcttccagaaagtaactgaagtcagattcttcccccaggcctagctaagcaaccaaacagggccaattgcactaagtgcccaccaaggccacgggaaatgcagccaacctaaagatgaagtggaagcttaaattcgaagagtgggccaggtgcaatggctcacgtctgtaatcccaacactttgggaggccgaggtgagcagatcacttgaggccaggagttcaagaccagcctggccaacatggcgaaaccccatctctactaaaaatacaaaaaattagctgggtgtgatggcaggtgcctgtgatcccagctactcgggaggctgaggcaggagaatcacttgaacccaggaggtggaggttgcaatgagctgagatcacgccactgcactccagcctgggcaacggaacgagactctgtctcaaaaaaaatcaattaattaaaaaataaataaggcccggcatggtggctcacgcctgtaatcccagcactttgggaggccaaggcaggtggatcacttgaggtcaggagtttgagaccagcctggcgaacatggtgaaaccccacctctaccaaaactacaaaaaacagccagcatagtggcgcatgcctgtaatcccagctactcaggaggctgaggcaggagaatcacttgaacatgggaggtggaggctgcagtgagctgagatcacgcccctgcactccagcctggatgacaaagcaagactccatctcaataaataaataaacaaacaggccgctgcggtggctcactcctgtaatcccagcactttgggaggtgaggtgggcagatcatttgaggtcaggaattcaagaccagcctggccaacatggtgaaacgctgtctccactaaaaatacaaaaattagctgggcgtggtcgtgggcgcctgtaatcccagctatttgggaggctgaggcaggagaattgcttgaacccgggaggcagagactgcagtgagccaagattgtgccactgtactccagcctgggcaacagagcgagacttggtctcaaaaataaataaacaaacaaacaaataaatgccaagagaatgataccaaaagccaaaccctccaccccaggagttgtcaagattatcccaagaatgaacgataaccatcaccagttactgagcactttgaaagtatttcgggaaagtatgtcaggaaatgcacctatttcatggattaggagaccaaggctcagagtgtaaagtgatctgccagggtcacacaagtagtaggcaacagcattgatacagaaccaagtgtggctgatgtcagaggctgggttctatgccacctccccaccccaaacccagagagaactcaggttctccagaggaggaagtggtttgctgcaggctcagcatcactgtgggtgtcgcagttcatacccatttaatcaccaaccaccatcaagtagttattaagtgaccgcagagagaacagcacagtgcttggtggcaaggggtatttgaaaggcagataaaatccctgtcttcaaagagcttacggggcagagcgggagacagaagaaagcctaatttacacagatctgtaaagttttaccttagcaggagggtcaacaggctggttagttttatcggggaaaaaagccttctcaaaaaggtggattcagctaagattttaaaggcagagggtaaggtgagtcaggagaaggctattttctgcaacttgaaccaacatctagactcaaggcagaactgagtggttggcatggtcagaagtcaaatgtaattcagagactgcaatacaagataccccctagatctggcaactgcatttgtcattaaacatcgagcacagagagttcttagaatcccccaaagcaggggccaagtaggaatatgtgtgaggcaagtgagacccaatgtaggcaacagagagggtcaaatacaaggctggagctattgaggttaaccaagtggtgacacagagtacacacatcccatgaagcctgatctgatttttcaaaagaaacgacatgtaatgaaactccgtctctactaaaaatacaaaaattagatgggcgtggtggcgggcgcctgtaatcccaactactcgggaggttgaggtaggagaattgcttgaacccaggaggcggaggttgcagttgagccgagatcatgccactgcactccagcctgggtgacgcagtgagactctgtctcaaaaaaaaaaaaaaaaaaaaaaggaacaacatggactttttggtgcaatctcctgatgttttaaatgttggcaactaatttggaatattttgaataccatgcagaccaagcaacaagggtctgcagaccaaatctgacccgtagatttctgatttctaccttgaggtttcccatatgaaaaaccagaaagaagaccaggcatagtggctcacgcctgtaatcccagctctttggaaggccaaggcaggtggatcacctgaggtcaggagtttgagactagcctgaccattatggtgaaaccccgtctctactaaaaatatgaaaagtagccaggcatgatggcacacgcctgtagtctcagctactcaggaggctgagacaggagaattgcttgaaccccagaggcggaggttgcagtgagctgagatcacgccactgcactctagcctgggtgacagagcgagactccatctcaaaaaagaaaaaaaagaaaaagaaaaaagagaccgggctagttgtgggaagacccacccaaggtgcaggttcttgcatcattgcctgtggtaacactgggtgtgttcccttcccctaactcctctgggcttcagtttagcttcctctgaaagtagaaaataactactatctacctcaaagggtggctatcagaaccatataaaaaatgatcgtcaatggacaaataattaaaatgtggtttatacatccattgtatatagatacagtgaattattcagccttaaaaagggagattctgcccatttgccacagcatggaaggacgtgctaagtaagataagccagacacaacaagaaaaacattgcatgatctcacttatatgtactatatacatatatttatttatttattattttacttatttttgagatcgagtctttctctgtcacccaagctggagtgcagtggcgtgatcttggctcattccagcctccacctcttgggttcaggcgattctcctgcctcaggctcccaagtggctgagactacaggcccgtgccaccacgcttggctaatttttatatttttggtagagagggtttcgccatgttggccaggctggtctcgaactcctaacctcagatgatccacccacctcagcctcccaaagtgctgggattacaggcgtgagccaccacgtccagtccaatatatatatttatatatctataaagaggtcaaatacagagatcgagaatgaaacagtggttactatgggtggaagtggagaatggggagacgtgggtcaaagaatactaagtagcagatacacgagatgcacaagtttagaaatctaatgtatgatatgagggctgaagttaagaaaatcgtactcgggattttcggatttttgttacataagtagatttagctgctcttggcacacaggaaagtagctgtgagatgactgacaggttaatctgcttcactttagcaaccaccttactatctgtacgtatcctatgacaacatgttgtaaacctcgaatatacacaataaggtttagtggttcttttgtttttgttttgttttttttgaaatggagtctcgctctgtcacccagactggagtgcaatggtgtgatctcggctcactgcaacctccgcctcccaggttcaagagattctcctgcctcagcctcccaaatagctggaattacaggcacgtgccaccacgcccagctaatttttgtaattttagtagagacggggtttcaccatgttggccaggctggtcttgatctcttgacctcaagatccacctgccttggcctcccaaagtgctgggattacaggtgtgagccacaatgcccggcctaaggtttagttttttaaaaaataaagaagcacatgaaaatatttcctcaagcttaacgtgctacacaaatgcccattatctaatacaggcccagagaagagagggggcgctaacagagaacaggcagtagatggggcctgggagagtgaaaaggaaatgagaagggagtagatgagaagggagagtggaaaggaaatgagttgagtctctgctggtgcgcagaccggaagaatctggacaatagaattcacgtcaggggtggaaatataaatttgggagtcaccagcacacaggttataaaagaggtcatgcagttgattaactgaccgaggtgcatagttgaaaaacaaggagttcagagaaatcctttgggaaaacacccaggtgcacctccactcagggatcagaggagacttgggaaaagaaggtgggagggtctctggagaagcaagcggagcttaaggaagggagaaaaaaatatgcagctaaagggtgagacaggtgtctcagcaaaagagcaaacgtggaagaatgggtcagactgtgttaaaatttaaaaaggaacaggccgggcgcggtggctcacacctgtaatcccagcactgggagaccgaggcaggcagatcacaaggtcaagagttcaagaccagcctggccactatggtgaaaccccatctctactaaaaccacaaaaattagctgggcatggtggcgggcgcctgtagtcccagctactcaggaggctgaggcagaagaatcacttgaacccgggaggcggaggttgcagtgagccaagatcatgccactgcactccagcctgggtgacagagaaagactctgtctcaaaaaagataataataaatttaaaaataaataaaataaaaaggagcaaagtaaaaaagttagtaagtgcaggtcaggcacaatggctcacatctgtaattccaacactttgggaggccgaggtgggcggattacctgagctcaggagttcgagaccagcctggccaacatggcaaacgaaaccccatctctaccaaaaatacaaaattagccaggtatggtggtgtgtgcctgtaatctcagctactgcggactgcggggggttggggggggtggggcggaggcaggaggatcgcttgaccctgggagacagaggttgcagtgagccaagatcatgccactgtactccattctgggcggcagagcaagactctctaaaaaacaaaacaaaaaactgaagttagtaaaagcagaaaagtaaaaagagggaaacaggcaagacacatggtggctcacacttataataccagcactttggaaagccaaggcagaaggattgcttgaggccaggagttcgagaccagcctgagaaacataatgagactccggctgtataaaaaataaaaaattggccaggcatggtggcacgtgcctgtagtcccagctgctcaggaggctgagggcaggaggatcgcttgagttggaggttacagtgagctgtgatcagatcactgtacttcatcctgggcaagagaacaagaccctgtgagaaaagagaaagaagagaagagaaggagaggagaaaaacggaaccagaagaaaaaggagagccaggtggacctgcagatggggacatcggggccacatggggccacagccatctacactgacagaagatgatgaccatgaggtataaaagggggtagaaagatggggacgtggggggtggagtaaagcgtgagcaaatagaggccatccttgaggatctgtctactatgtgctaagcacctcactcagtctcccaacaatgtggaaggcaggcattacacccatttcatagcctgctttcaatagggtttttttttgttgttgttgttgtttttgagacggaatctcgctctgtcacccaggctggagtgcagtggcctgatcttggctcaccgcaacctccgcctcccaggttcaaggaattctcctgcctcagcctcccgagtagctgggattacaagcatgcgccaccacgcccagctaattttgtattttagtagagatggggtttctccatgttggtcaagctggtctcgaactcccaacttcaggcctcaggtgttccacctgcctcagcctcccaaggctgggattacaggcatgagccaccgcgcctggcctcagtagggtttttatgttttagaagaggccaaagtctccaaggctcattcaaaacaatacacacagaccgggatccagaagagaatcggcctgaagctccctggagctccctggagggttccaccccccttgctccagctcacccagagttctacgattcaaaacagctggaaatgtgtgccctgctctccccaacaagaaaacagaacagaacatggctgtttctgccaagcgaattctgaataagctgcattccatttcattaaaacaattacctgagctccagccaagaattacataaagcttcctcccagcatcaccccctcccccataaaacacacatcatgctgctttcaaataggcagagtgaagctctgagccctcgctagaagacctcatagtcctcgccaagtggccagcctcggcatctctgcacgctgacatagatgacatgaggctgaaagaagaccttggcatgaagccctcccctcatgagagcctgctggctgcccgaaatgtttctagtaggcaccagggccctcacctctgcctcagagccaagagggccactggtgccagaatccagctatttccccaaaacagactggaggtccaagagggccagctttgagtcagcacaaactagacaggagggaccaagggagtggggattccaggagggggagcctgaaggctggaaaactggatggtcagacttgagctataagcaaaagcctggggacactcagccatcactgcccacaggttaatggtgttccactggccacagataaggggttcatgatgtgaggcaaaagacatctcctccccgcccacaggcctcaagctgcccagagaccgttccctgaattatgtaaagccttgctgtggctgggcaccgtggctcacacctgtaatcccagcactttgggaggccaaggcgggcggatcacctgaggtcaggagttcgagaccaggctggccaacatggtgaaaccccatctctactaaaattacaaaaattagtcaggcgtgatgacgcacgcccataatcctagctactgcggaggctgaggcacaagaatcacttgaacctgggaggcagaggttgcagtgagccaagatcacaccattgcactccagcctgggtgacagagtaagactccgtctcaaaaaaaaaaaaaaaagtcttgctctgcatcccatcagcctagacaacccatctcaaactccaaccagagttcggcatctcacatgcttcaaccctggtctgattaatgtcatcatgctcaaataactcatgaggctgcctccacacctatggacacacactgtctctgggcctgtcttttttctgcacaggtcacagcactgtgctccccatttcccagatgatagtcagcagtcactgtcacctgaggcccccccagctactgtctctgctcacccagtcttcccaccacctgctcaatcacaggagaccagcagtcattcaggccaaccataggcaggcgcaggccagcacctaggcccaacaactccaagcccatcatggaaaagcagggtttccttacttttctccaacttttcattataaaaatgtctaagcacacagagaagttgagaggcccgggtactctcacttagattgaatggctgtcattgttttaccactttgtgtaaacgcatggcccttgtgctctctgccctttatgtgtatatcctttttttcattatatcatttaaaactaagttgagctgggtgcagtggctcacacctgtaatctcagcactttgggaggccgaggtgggtggatcacctgaggtcgggagtttgagaccagcctgaccagcctgaccaacatggagaaacctggtttctactaaaaataaaaaaattagccaggcgtggtggtgcatgcctgtaatcccagctactcgggagactgaggcagcagaatcgcttgaacccaggaggcagaggttgtagtgagctgagatggtgccactgcactccagcctgggcaacaagagcaaaactctgcctcaaaacaaacaaacaaaaaaaaacaaataaaactaagttgaggccaggtggggtagctcacacctgtaatcccagcactttgggaggctgaggcaggtggatcacctgaggtcaggagttgaagaccagcctaaacaatatggtgaaaccccacctctactaaaaatacaaaaattagccgggtgtggtggcatgcacccatagtcccagctactcaggaggctgagacaggagaattgcttaagcccaggaggcggaggttgcagtgagccaagatcgcgctgctgcactccagcctgggtgacagggcaagactctgcctcaaaaataaaaaatgaaaaaataaaaataagttgcaagacatcatgacacttcactcctaaatactttagcatgcacctaacaataacaatattctcccataaaaccacaataccacaatcacacaagaaataagcattaaaagtccgtctttaagggaagatttggccactggggttccactgggcctggccaaccgcatgttctgtctaccactggcccagcatccaaggcctccctggagaggccagccctgagcaccactggttaggcaatcggttagttagttggaagacttatcagggtatgaatgtacactcaaggccagatatgagactcccaacaagacccagactgcaaaaggcagagtggaccccgtgaggctgtcgatggagtctcagggcccatcccaggtgaggagggcaccctgaagccatttccatgacttgctttgtgaacatttctgagaaaactcagcttcctgattctctcttcctctccccctcccataggacatccttcattctccaccataaagttttcaacaactccctcctctggatacgggaaagacaaggagcatgttcgggtgcagcggggctgggggcacaggaaggcttctgattcctgagcagaggaggtggcaagggaccacaggggacctgccccaggttctccttggcagtggtgctgtaagctcactgctctgtctcaagagtaacaggtgactggagaggtgaccagggagggaggattggggcctcccctggaacaggagacactccccccaggaccctgcatcccatcctgagtgtgtgtccccaagaaagaacaaaaaggccgggtgcagtggctcacgcctgtaatgccaacactttgggaggccgaggcgggtggatcacctgaagtcgggagttcgagaccagcctgaccaacatggagaaactccgtctctactaaaaatacaaaattagctgggcatggtggctcatgcccccagctacttgggggactgaggcaggagaatcgcttgaacctgggaggtggaggttgtggtgagccgagatcatgccattgccctccagcctgggcaataagagtgaaactcaggaaaaaaaaaaaaaagaacaaaagacagacaagaagctgcagagaacagggaaatgacagatgtggaagacaacagagaatagggtgggtgcagaaaaatgttagtgtcctagaaacagaaaacagtcaaaccaatgggcaacccatatcagatgcagtattatgaacagaagtgtaaagaatgcaccaggcacaatggctcatgcctgtaatcccagcattttgggaggttgatgcaggcacattgcttgaggccaggtgttcaagaacagcctgggaaacatggtgaaaccctgtctccacaaaaaatttcaaaaattagcggggcgttacggcatatgcctgtagtcctagctactcgggaggctgagggaagaggaacacttgggcctgggaggcagaggctgcagaccctgtctccaaaaaaaagtgtacaaaacagttggctgcaagtcccgctcagcagccagaccacctggattcaaatcctagcactgccattcactagttgtagaacttgggcaagtgggctcacctctctgtgtctcagtttcctcacttataaaacaggtagtagtaatacgactactaataaaacctgcctcatatggccagcttgattcaagcaaacaatgcatgtaaagtgcccagcacagtgcctgcacataataagagctcaataaatattatgagaaaaagttctgtaaacactgtaaaaaagaaaagtaccccctaggccagagtgcagtgatgcgatctcggcttactgcaatctctgcctcccgggttcaagcgattctcctgcctcagcctcctgagtagctgagactacaggcacgcgccaccacgcccagctaatttttgtatttttagtagagattgggtttcaccacattggccaggctggtcttgaactcctgacctcaaaagatgcacccacttcagcctcccaaagtgctgggattacaggtgtgagccaccatgcccggcagattttgttattattaatgaaggcactgagactaggatgatccccggaaaggctgcaatgaggctggaagtttattcaacatctctggagcgaggtaaagacgcaagagaagcttcagagtcagatactccaagcaggatgactaaataggagaggagggctgctcagtggcccaccaataactctggccttccatcagcctctccagccaagggtacacccagtctcttcaatgcatgaccatcactagggaagctggaaaaaaggaatactgagatattccctcaaaagaccttgaacctatagtgacagggctttgggttccagtaggctgagcatttctccatcaagctatgtctgcccaggcagcagacagcttcacatatcagaaagtgtacccgctgaagaatcaaacccaccaaggtttgaatcccagctctgccccttactagcacaagcccaggagaaggtctggcactgatgcagagcccaccaggagggcactatcgctgcatgggtaaatgccgcctctgccacacgcccagcagctgggtgccctgactctgccctaacacacagagggaccacagacaggaaagcccaaagtccagactttccatggaaacagggaggctccatagctcccaatgccccaggcaactcctctgcccccctagcactacccccaaggacaatgaggcactgttttccaaagggtcaagactgctgagaagctgaaagaagacatgtccagattccagcagcaactgggcactgccaacagctggctgttccccctgctagaggatgggaaggcaaagctacccagtcttgcactggacacaccctttgccatttcctgggatgggcccctagggcagagattgttaaaggtaactatcaattactcagcaggccccaaggctcatccccctggttagtcaccagcacctaccaccttatgatgattaagataaccggatctggaattggatgagcctgggttcaaatcccagcactaccactaaacttccctgagctcaggtttccacatgtataaagtggagcgaaaacacctccctttctgaaaggttgtgatacagctcgtaaagtgctgagtacagtgcctgtctcccatgaagcgcacatgatcatgattagaccacagttgtggtcaaagcccccaccaagtacactgagaacatgaacagaggaagagcaagcaatcgggttagaaaacacagtcagagtgcatctcagtgttgtgggaactctgtccaggaaactccggccagaacttgaacagagcgaactctgggccaaaccagcatctaaacagtaataagaaaagccaccaagcagccaccccaaagaacaaagtggagagaacacacagggaagggcagaacacgctgtgttgatatttttctgctcagagagctataaatttgtaacttattaagcagcacatggtgagtctgtcattggcaactatgggaaggagaagagttccccattttttattagaccaaaaaacaaagtcacagaggaggtgatgcaccctctggccttgctaccggacacaccataaactctcccctgtgttagggaccaggaggcacacggctgagagcacgctcaggagaaaaataaaaacaagaggtctgggctttgtgtccaccctaaggaaaacagctgagccaccctaaggaaaacagctgatggcagtgtgctgagccgccatccagacagctgacggggccccagtgcaaaggcaaattcctctcccctcctgcacaccccattcctcccaccccaggctccggtcagtcaggcgtggcttgccccttgggagctcaggccaaggaagtcgggcagcccggatgtaagcaactgggagtctatggtagaaagcagtagaagttacaggtgatcgccatcacccagtggcaacccctccttcaagtgcccttgcctcctccccaggaaaaaaagtcttctcggtatacaagagccacagatctgggagctaggaattgggcttccagttatggttttgtcatttcatggctgtgcagccttgggcaagagaatcagcctctcttcgtctcggctttctcaatctgtaaaaaggcaggtggtcatgacagcattggctttaaggtggaatctgataaaagggttgttgtgaggatatcacaaatcgaggtagagggaagtactccacaaacagcaatttaaatccctacaatcccctctcccgtatacagtactctctttcctttcagaactcagtttcctggccctaaatggaagactgtcagaagacaggaattccagatttcgatggcgagctctacaaagactttctcagtccttgaaacagcacggggactgccgagaagcaacagaactgcaccagcactttagaaactgtaactttgctcccagttcccactgggaaagcactcagactcttagatcctggttcaaagaacatcccccagcctccttccagctgagctatttttatgtgaaaaaaaaaaatacctgcctggaagccatgccaaccttgagcacactggaaaaatgggtgccaagcctgacccaaaggcagaaccacgcttggcagccatctcactctgcaaaacaggcaggaccctacaccaaccccagctccaggatctcaggggcaccctgatcccaaaaggaagctggagggaagcagtcaagtccagcacctacaaatagccagtcttaacttagtgcccggcgctgcttggtagaggtccatcagtcctgtctgctgaatctactcctcagagcctgggacagaggaagcatcagtggtcacacaagccacccacagtccagagaggaaagacaaggctcctgcagagaagaaacgttgcccccctcctcacctcccaagctcagggccctccagctacaggcgtgaaggggagggagagacagcgaatcctcccactcctgcgttcacgccacccaaggcattcctagaaccctggcaccaacccccttgggtttagagtcggcttccaggagatactttctttcccctaacaccagatcaagactggactgaaaagagtagccttggggctccaataacaggaaaacagtaaaactctgttctgggcatcctgtcctctttcacctgcgtggcttccagcagggcctgacgcagagagggtggaggggactctgctagccaggacacgttcagggatggtcataccttggggcccaccttccacctcattcccctggcatttcaccagaatctaggggtggggagagaatcaggactcccaaattaccgttctagacttagataccatggtagacggactggtctgtgaattgaggggctggtccacagagcggggaggtcagtgagagaaaatgagtgatgggtccttgaaacggggtgaccagatttgaagtggggggtcagaagagcaggcagactgggaaacttgtctttgaaatgggggtgtggtcatcacacgctcatctctagcttttgcatctgacttgtgaaatgaaaggggtgggctccgaggggttatccctgaaggggggtgctagtctgtgaagtggggggcggccctggagggacggggagcaggtcgaggaaatgagggagcagcccatgagatcgggcagctgctccccgagttgggcggtcgatctgtgaggtgggggtggggagaggtctgcgaggtgagggtcccgtagctgacgaggtggtctgccgcaggaagtctcgtccctgcagcggacggggtgggtccctgaggggcgggctggtccctggggcccttctgggagatggtgatgggtccccgaggtcgggggtccagaggtgaagccgtcccagacggggggtcgctgctgtgcggtcggtgccggggccggcctggcccgagactaaggcccggttagggatcccagccccgcggagccccggccggcagggacaggagctgaggccggggccgccgagggtgggatcccgcggcccctgccgctcgctggcgccctcctggccccaagctgcgcgcctctcgcctcctcctccctcggcctcccgctcactcaccgaggtcgtccatggccggaccacgggcgccggctcagggtcgcgctagctgcccgtcccggggccgctcgtctatgccccgcaacttttccgccgcgagcctcggcccggaacggaacgcgccgccgccgcgcgcgcccgcgcccgcgcccgccgcgcgccccgcccccggccgccccctgtgcacgcgcgccccgcccccggacacccccgcgagcttgctggccccgccccctgcgcacgctggtcccgcccccgccaagagcccgggcagtgggcgtcgctgggcggggcggtggcgccccctcgcggctaagcgggcaggtgggcggctcccaggcctccagccactcccatccatctttctgtccctctcaaagtcacttgcctgaccctgcggatgacaaatccgtccacagtcagccatgtgtctgtgcattcgtcagccactgggtcatcacatgcctgtccactggacagtcagttttgcccacctgtccgtctgtcacctgtaggtcaccacccaggaggaccataaatcagtaccaggcaaggcccggagcccgtggctgacctttcctggggtcgtcctctggatcaatggcagtgcagctcgcagttcaccctttctggcccaaacccaatacctgtgtggttccatctctcttaatattacttccacacagccaccctccctagacacttttccaaaactgcatggggcagaggggtccccagattagacattaaagggaaaactacaggaaagtcacacccagtgctcccacacactcggaaattgggtaataataacaactaccatttattgagtgtctgaatagacagacactatatagctattctctaaattaatcctcctagaggtacttccctacccgttgggatgggtgatggcagtttgtggattttatataaaactgctctgcaagtacagcttcgagttccccttgtccctcaagaatccaggccttctgggtcagatcaggtcctccagaaagcagatgagatgctgagataaagctaggggtaatgcccgtgacagagaaggggaaataagcagggttgggcaaggagactcagatctgacaaacaggtcaacccatcagggaattccaggacaaaaaaaatgagaagtctccttgggcagaagtatccgggttccaatgctcccaccatgttcagtcattttataaaggcagatccaagcagcttctgtggctgccacattctcctataataaattcaagaccaaagactgttcctcaaacactctattgcgtggttttccagcatcttgcacatacctctattttgttttagtttttgtgtttttgtttttgtttgagatggagtcccaatctgtcgcccaggttggagtgcagtggtgcaatctcagctcactgcaacctccgcctcccaggttcaagtgattctcctgcctcctgctgggattacaggcgcataccaccatgcctggctaatttttgtatttttagtagagatggggtttcaccatgttggccaggctggtcttgaactcctgatctcaggtgatctcctgcctcctggtgggattacaggcgtgtactaccatgcctggctaatttttgtatttttagtagagacagggtttcaccatgttggccaggctggtcttgaactcctgacttcaggtgatccgcccccctcagcctcccaaagtgctgggattacaggtgtgagccaccacgcccagcctgtttttgtgtttttaagacacagtcttgctttgttgcgtaggctgggatgatgaataagactaacatgatgtctaccttcttgaatctaaaggtgcacgcaaaagagcaaagtggttagcatgaaggatgagtagcctcgccccactcccagctgtgtggaacagcatgtgcaaaggtctgtagacaagacatttaatactgaccacaagcctaggagatgagcattgttagccccttttacagctggaagagttgagagtcagaggttgaattactccaggtcatacagctaataagtaaggaaactgagatttgaacctggggaggcttatgccaaggcctggttatgaaacggctaagtgaaactgctaacaacttagaccaaccccagggcatacgcttgtccacttctccaaaggtctaaaacctttctttttcaaagctgtgtggtctggaaatgcgaggcacccattgaatgggcaagtttcccattgctatgcagagttctaaagagaactgaagcttcagagttgagtgctggtgcactcgaacactcaggtccctgccagggatttcctcatgtaaatcattcctaaacccccatttcctccctggcttccttcttcccttggactctcaccccacagcaattaaacttggtgtctagttcaggctgctacaacaaaatactgtagaccgagtgacttataaacaacagaaattattttttcacagttttggaggctgaaagttcaagatcagggtgccagcacagtcaggttctggtgagggccctcttctgggttgcagactgttgactttttgtaccctcacacggctcaaagagggtccctttaataaaggcactaactaatctctttcatgagggccctgccctcatgacctaatcacctgtcaggcctcacctcctaacactatcgaattgagattagatttcaacatatgaattttcaaggatatgaacattcagtcccttgcatttgataaaatcaatcaggttttttcattcttcctaaagattaaacgacattgacagagcagatggacaaccctgctgacttcttgctagtggttcatcttgggcaatttactctgtgcctcagtttcttcccctatagaaaggttaatagtagctacctctcagagtcctcataggactaaataagaaacgacacacctagtacttagaatggtccttgtcaccacaaaataacactcttcactcagcaatagaaacagaactcgaccaggctcacacctgtaatcccagcactttggaaggccaaggcgggcggatcacttgaggtcaggagttcgagaccagcctggccgacatggcgaaacaccatctctactaaaaatatataaattagctgggcatagtggtgtgcaccggtaattccagctgctcaggaggctgaggcaggagaatcacctgaacccaggagacggaggttgcagtgagtcgagactgtgccactgcactcctgcctgcgcgacagagtgagactctgtcaaaaaaaaaaacaaagaaagaaagaaggaaggaaggaagaaaggaaggaaggaaggatggaaggaaggaaggaaggaaagaaagagagagaaaagaaacagaatgcaagccggatatgcaatcaaaacttttcttttttttctttcttttttttgagacagagtctcactctgtcgcccagggtggagtgcagcggcatgatctcagctcactgcaacctctgcctcccgggttcaagtgattctcctgcctcagcctcctgagtagctaggattacaggcacccgctatcacacccgactaatttttgtttttgtttttttttttttttttgagacggagtcttgctctgtcgcccaggctggagtgcggtggcgcgatctcggctcactgcacgctctgcctcccaggttcatgccattctcctgcctcagcctcccaagtagctgggactacaggcgcccgccaccacgcccagctaattttttctatttttagtagagacggggtttcaccgtgttagctaggatggtctcgatctcctgacctcgtgatccgcccatctcggcctctcaaagtgctgggattacaggcgtgagccaccgcgcctggccaatttttgcatttctttaagtagagatggggtttcaccatgtgggccaggctggtcttgaactcctgacctcaggtgatcccacctgcctcacctcccaaagtgctgggattgcatgtgtgagccgccgcgcccggcccaatcaaaacttttttagccaagtgctttggcatatgcctgtagtcccacctacatgggatactgaggcaggaggattgcttgagttaaggagtttgagtccaaactgggaaactagcaagacctcctctctaaaaaatatctttaaaaaaataaaagaaacaggccaggcacggtggctcatgcctgtaatcccagcactttgggaggccaagatgggtggattacctcaggtcaagagtttgagaccagcctgaccaacatggtgaaaccccatctctactaaatatacaaaattagctaggtgtggtggcacatgcctgtaatcccagctacttgggaggctgagtcaggagaatcgcttgaacccgggaggcggaagttgcagtgggccaagatccagcctggcttacaagagcagaactccatctcaaaaaataaaaaataaaaaaatatatggccgggcacggcggctcatgcctgtaatcccagcactttaggaggccgaggtgagcaaacaacctgaggtcaggagttcaagaccagcctggctaacagcctggtctactaaaaacacaaaaattagccgggcatggtggtgggcacctataatctcagctactccagaggctgaggcaggagaatcgcttgaacctgggaggtggagtttgcagtgagccaagatcacaccactgcactccagcctgggggacagagtgagactccatctcaaaataaataaataaaatagataaaattaatgttaataatatattttatttaattcaatatatcctcagtgttggctgggcatggtggctcacacctgtaatcccagcactttgggaggccaaggcgggaggatcacaaggtcaggagatcaagaccatcctggccatggtgaaaccccatctctactaaaaatacaaaaattagctggtggcacgtgcctgtaatcccagctactcgggaggctgaggcaggagactcacttgaaccagggagtcagaggttgcagtgagctgagatcccaccactgcactctagcctggcgacagagcaagattctgtctcaaaaaaaaaaaaaaaaatcctaaatgttatcatttcaacttgtaatcaatataacaaaatatcagtgagatatcttactcttttttgtatgaagtcttcaagatccaatgtgtattttacacttacagcacatctcaatccaaatagccacatttcttttcttttcttttttttttttttgagacagggtctcactctgttgtccatgccggagtagagtggtgagactgaggctcactgcagcctcaatctcccaggcttaagtgatcctcccatctctgtctcctgggtaactgggactacaggcacatgtcaccgcacctggctaatattttttatttttagtagagatgagattttgccatgttgcccaggctggtcttgaactcctgggctcaagccatctgcccacctctacctcccaaagtgttgggattacagtcatgagccactgcatccggcccagctagccacattttaagtactcagtagtcacatgtggctagcggctactgcattgaacggtacagttttaaatgtcagctgtcatcattattttggtttttgtttttttttttgagatggagtctcgctctgtcacccaggctgtagtgcaatggcacaatctcggcccactgcaacctctgcctccagggttcaagcaattctcctgcctcagcctcccgagtagctgggattactggcgcgcgccactacacctggctaatttttgtatttttagtagagacggggtttcaccatgttggccagggtggtctccaatgttttttctcgtgatccgcccacctcggcctcccaaagtgcttttttttttggaangagccactacgcctggcctatcttgggggcgtgccccacaaatatttcctcccaaacctgttacaaaacatgccgacctatgacagcactgattttatcacatctcttccttacaggcctcgcgtctccgcccactttcgatcactacggcgttgcttctgtcccataccctccatccgttccgtccttttcacctttatccttcacatgccatgcaccataattgacctttcttatcttcccacaccgtaccccccatttacgcgtatcccgacccccgagccactccccacccaacccccacctccctccctcctctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtttgcccaagtctctcagccagtaagtgaaggcttcagaactgaaatctaggaggaagttcaaagcccctgggcctcactgtgctatacagtccattccaaaccctgagtcagcctccctctgaacgcacttttccaagtatatacatatgcacaaggtacatttccaaggacctcctggctctgatgatataaatatcatctctaattgtagtacatcaatataacggaataccatgaagccattagaaaatggtacagatctatatttattgacatgggaaaatatccacaaagcaaagcgaaaagcacattacagtgaaatataccatacctggccgggcatggtggctcacgcctgtaatcccagcactttgggaggtcgaggagggtggatcatttgagatcaggagttcgagaccagcctggccaacatggagaaaccccgtctctactaaaagtataaaaattagcctggcgtggtggcgggtgcctgtaatcccagctactcaggaggctgaggcatgataattgcttgaacctggggggcagaggctgcagtgaaccgagatcgtgccactacactctggcttggatgacagagtgagactccatctcaaaaaaaaaaaaaaaagccaggagtggtggcttacgcctgtaattccagcactttgggagccaaggcagatcacttgagatcaggagtttgagaccagcctggccaacatggtgaaaccctggctctactaaaaatacaaaaattagccgggtgtggtggcagctgcctgtaatcctagctactcaggaggctgaggcaggaggatcccttgaacctgggaggtggaggttgcagtgaaccgagatcatgccactgtactccagcctgggcagagtgagactctatctcaaaaaaaaaaaaaaaattggacatccctgctctagggcctaggactggagctctggatctgaccggagcaaagaggaagcacgcaaatccggacatgacgacgaggaggcagtagagacccatcctcaactgtaagtaactgccttcggcagggaaggggctaacccacgttgtgtgggctcaggcacggccgcgtctggttctgtgcaggaacacaggcagaggcaagccctgggtccgcatcatggctctgccctcactcagattgccttgtacatgtaggttcttgtcctagagcctctttccctacttctaaatgagtggaaagccacccacaagcccgtgagtgaggatgcccttggtaaacccaggtgatcacaccctgggcaggccctgccccacagggccccatcccgctgctccccagcctgtcctcaccaactgcccaggcaggagcaaagcccacggggaggacctgtgaccacaggcaaggaccacggaccccagccccagggattttgacctcaagaaaggaaacatccacaatttaccctccatctggtgatccagctgcatctggggtgggtttggtctctgctgggaccatgaggttcagaccaccaagaaatagcactagcacaggtgaaaatcatgggcaaactttattggcataaatcacaggaattgaaatgggaaaagccagcttggaagtttacagagaaaaaataaaatcaaaatcaaattttcaaataaccactgactcagagaatggaccccagaaaccccagtccctcttggggaagatctagggtgggtcactataaacagagcggtaaggcctgcgggtgaaagtggagacatcagacctttggaggggctgggctgaccttcccccaaaaaggagggaccctcttcggagaccccagcacactcggcttctgccaggaggccagtggagtggtttggactgtcaccattagaccccggtggggcccctttctcctcatcaggagcccaaggcctggctcctctttcatccttggtaaagagctctggggggtttccccagaggagcctgtccctctgccccaaatcctatcatgctcccttatgaccttctttccagaccccctgagtgccgatcccacctgtgaaaggggaggagcagatctggggaagggatatgcccagaggaaatcaacaagaccaaagagacgtcagagtcctgatggccaaaatcagacaccagctttcctgagaaggcagaagagagagccccatagaagcagtgggggctcagaaggttcagtgggttcacaggggagcagaggctcctgagggcttactcagacaggaagcagccccccaaaacatacttccccttctcctcccacagaaacagaacagataaagttcagaattctaggcccaaaagggtgcaacacccttcaaccagtttcagtgaagagcttgctggcctgggaagtaaagaaggggtttccaaatacagcagtttataaaacagtcctggtgagctatgaagtgaaagagggggagtcacagagctgctcccagttcacctgcttgtgctaagaaacaataaaatacaaattgcttccccaccccaaccctcagtacaaagcaaacttcacaccagagccaccatcagtgacaggcccagtggcggtggatgaggaagagaatacaaaagggaacgtctttaaaatctcttcaaaatcattttgtatagagaagtaaaagcaactcaggcgatatgaattcaaacctcagtgtagaaatctatcaaagtcggtacagtgtccaggcacgccgtcccggagacggaggaagtgactagaaaacattattgctggagaggcttttctcagtagaacaagagcaggtataaaaggggagggcgggtctaaaaggcaggggcagtcgccaggcctagggcactggaagggtaggaggagcacagagaaccttccatggcccctttggttctctgcctttggatggatggatttatgctggcattgtctggagggagccgggtgtcccccaataatcacagaacaaagacaattaggtcgggggaggaataaggataaaaagagaccccaacagaccctgcctgcccttccctgccccccggctgcactgctgaaatatgaggaagagatggctccagtgtggggtgctggccaggccagttcgtggggacgtacatgggctggggtggagcccccagcctctacccctggggaggatggagagtgggcagcctagggagagctacaggagggaggagggggcccagaggctctggcaggggtgaagacaagcagggggacccctcacggccctctgtccatcccgcaccagcggaggacaagggttccagtttcagtcgggtttaccccttcacccccgggtgaagtctctaggtcacagtcgcagttggggatgctggctggggaaggggggcagagacaggggcagggcacctagcagaagagcttgaggaagcagttctgacagtaaggcttgtcgttctgctccttgaaggtgcccttgttgagctgcttgaggcagaaggcacagacgaagtgctcggggtggaacttcttggccatggcggtgatgcagcggccggtgatgggcttctggcagccagaacacagcgagccgcgccgctcgtggtagtgcacctcacagtagggctgcccgtcgtgctcgaagaagctgccgttcacgaatggcgtgaagcattcctgccaggcggagagaggggctcagggagctgcccctcgggctagagctgcaccctgtgtgatggggccgaggtgggcatagtcggcacgctcggagtgactcctacttgctaggcgtttcccatgtgccgtgttgtcctaaacgctcatttttcatttttattttattaaataaattttttttgtagagatgggggtctcactatattgcccatgctggtcaaatgtggcctcctgcaatcctcccacctcggcctcccacagggctgggattatttagttctcccaacaggggaggcaactgaagcacacaggtgaagtaacttgcccagggtcatgcagctactgaggtcacagcctggattcatacacaggtctgactcctgagcacttagccaggtggctgtaacagtgttcccagaaacacaggtgtgacactggtctgtagtcaaactctgcctcctagattctcattggagattcacatcacatataggtagaaaaggctctgagaggggccgggtgaggtggctcacacttgtaatcccagcactttgggaggccaagggaggcggatcacctgaggtcaggagttcaagaccagcttggccaacatggtgaaaccccgtctctactgaaaatacaaaaaattagccaggcatgggggcgtgtgcctgtaatctcagctacttgggaggctgaggcgggagaatcactggaactcagcaggcagaggttgcagtcagccaagatcgtgccactgcacaccagtctgggcaacagagtgagactccgtctcaaaaaaagaaaagaaaagaaaaggctctgagaagtcctgcagggaacagtgtttcccaaactcatttggtcagagagcccttgttgaatcattaataacccctgtggggcccccagaatgcagtggttttggaaaccactgcccatttctgttgagtctgctaaatacttgcattatctcatttagttctcacacactctcctcccaaataggaatggcccagggccgctgcacagggctggactgggggacatgtctaccttgctcctggtttgtcccagcctcagtacaaaccctggcccaggacctactggactggaggaaggagatcccctgcctgctcccccaattaataaccccaaatgaggcctctgagttggatccagacagcacaatgaggaagacccctctctccccactgcctgctcctcgcccctccagatgtggtcaggggctccttacccggcacacaaagcactcaggatgccacagcgtgttgagggctgagatatagttctccaggatggcccgggcgcagccgccacacttgggtgcgaacatgtcgaagtagtccttgcgacagtaggccttgccgtccttctcgtggaaccctggggagcgggggttttggaggcacagttcattccggcttccagaagtggagccactctgactccaacctcagcagcgtctcccacccccacctccccggccctcctaagaggcggtgggtcagtccgccggtccagcccgtaccttcgggaccaaagaaggctccacactgtgcacagaagaagtgttcagggtgccacgtccggtcaagggctgtcaccactttctgtgaaagcaaaatgtgggatcaaggctgagctctgggcagatctcacaactgagacgcccagcaaggccgtccttccacccgcagctcatagccatagacagagcaaaacactcccaagatgggggtctctcctaattgtgctgtgaatgcctctaagaattcagagttactcaggatgggacaagccagacacataccctctcctctactcctcaccccaagtagagggcacaagttctatgactcccattttataagtgaagaaacataggctcagagaggccaggcatttcctaagttcacagagagggagagtgaggccgctggcatccaactccatttatctcctcagggctcctgagtcctgggagtctccacagaaaggaatcgagatgggaggtgaagggaggtggggctgcccgatgcacatcgggacaggctgtggttcaggtgtggctgtgaatccggccccactgttccctagccctgtgagcctcgggcatgtgacctctctgagcctcccacggcaccccctgcatcctcagagggctgcggtgaagctggaatgagcggaagcgggcgcggtgccggatgaggaactcacatccaggatggggccgttgcagtagtagcagcgcggggagaagaggttgtggtagtccttttcacagtagggctgtccatcccgctcgaagaagttccgggatccgatctcctcctggcagtgggtgcagacgaagtgctcggggtgccacgtcttccccatggcggtcacaacctgaggaggagatggaatgcggtccagggccaaggccagccccggagcacccccacccctgcaggagtccactggccacacccctgcccactccccctcatcacctgcccggcgatgggcttcttgcaggccccgcagactcctttggcgactgtggcgacccccagcttgttcaggtcagactgcaggctccccagcatgctgtccagctggctcccgggcttcgggggccccccagggggtgagctgctccctgtcttcccctgggccatgaactgtggacacggagggggctggtcaggactcctgaggctcggggtacggtgtctggcagcacagggatgggggtacttttctccctcctggacagatgagctgatggagacaagaagtacaacctcctccaggggccaggagccctaaagtgggagtgacgtcagcaggactcctggtggtcggaggggcccaccagggtcggaaaggctgagggcacccagcaggcatggccaagcccagggagagcacgacacgcaggacacccagcccagccttggcactgacccctccctcgtcctgccctccggggctgctccgcccgccgtcccgaggccagccggccgcccagcaccgctccccatccgctctttgctccaggccctggatcttagataggggaagagatgagggtaagaaatcttttttaaaaattaagaaagaatacaagaccttgtcactggactaaaagggaatctaggatgagatctgagggtttctcccccaccggcaggaccaaaattgggggaaaaaatctggagaaaaagagccctgagagagaggcctagggagaaaggaagaaggacagggaggggagtcgaccaaaggcagaggaaatggcaaggggaggtggccgggctcagtgatgaggcctcaccgggcgctgggcctgggggctggaagggaggagacaggtttctggtctcccttctggagtggcttctttcctcgatgggagcccggggcagtactgaggaccagtcgaggaaggagcagacatgggtggacccacagaaaagcaagagggcagcggaccttctgagtgggggaagaccggggtcaaggtttacggcaggactgtggttactgtgctggggcttgtagatggagggatggagggtatctgtgtatgtgtgtgtgcacgtgtgtgtgtgcagagtgggggatggctcaggcattaggacaggggacagaaagggaggggctcctttaaggcctgcctgcatcggggggaagagcgggtcctcatcagtctggcagcccacggacctcatggtgtggggtgcaggaatgggaagggcagggccctgcaccccctcatcatggggctcttcccctgcactctggaccccagaagaaccacaggtataagctgagggccccaggggggaggaggcgagcaggctgggcaggggagaagagctgctggccgcggcgtctgtgcgatgctggagcaaagggacagaaggagaagccaggacagagatggttcttctcaggggaatgggagagccaggagggaagacaacctggggagaagaaaggagggagagcgatgaggaagaaatcgccagctcagcccacaggggtggcgggacctccccaggctccccctgggccttcccactctgcaccaagagtggggccagtcttccaaagtcacaggaggcaagaaacccccaccctctccccagatctcccctccggccagcactggggccagggaagaacccggaccccaggtgcttggctctggcccagccccagccatgggcatctcctcgccaccttctctacgagctgccccccggcccgcttcccacgtggctgcacagtgatgatgacgccctcggtcagccagtcctgggcagagggccccgccgcctccgccggctcctctgcctcaggctggatgcccagccgcccctgcagctccgcgatgagctgttcctgggatggggtcctgctcaaggtggcagggtccagccggcggcgaggggagggctcccgggacatggggtgtgcgtggccagactcccagctcctcctgatcacagatcggatctagggggagggggaggggaggctgtcaccgtcccactcccagcttgcacaacgctgctcaggccacactcagatgcctcaggagagggagcacaaaagaaaaccaccaaagaaccaagcggaggtgggtggaggcacggggagggggcagattggaccggtggaggtgggtagaggcaaggggagggggcagatcggactggctccagaagcacaggctgcgagcgagacctctgacccagcattcacctctaagttggccactgaccttgggcaagacacttaattgccatgggcctcagcttccccttccttaaaatggaaccacaagattttcttggcttaccgcacagggtttgcacaagaattattccagaggatgtaagtgcatgcccttgacaaggcatacggctttttcttttttcttttttttaatttataatagaaaaagtgtttccttccaggaacttttttttggggggggacagagtctcgctctgtcgcccaggctggaatgcagtggcgcgatctggtctcactgcaacctccgcctcctgggttcaagagattctcctgcctcagcctcctgagtagctgggattaaaggcatgcaccaccacgcctggctaatttttgttgttgttgttttttgtttttttttttagtagagatggggtttcatcatgttggttcggctggtctcaaactcctgacctcgtgatctgcctgcctcggcctcccaaagtgctgggaatacaggtgtgagccaccgtgctcagctagccaggaacttttttaactagttttttttttcttatttatattattatgctaatattatattatgctattatacttgttggtagtgttttgggggtttttggttgtttcgttttgttttccaaagaggcataaagcttgggggatttttttttttttttttttttgagacagtgtcttgatctgttgctcaggctgaatgcagtggtgcgatcacaactcactgcagcctcaaactcctgggctaaagccatcctcctgctttagcctccccagcagctgggactataggcatgtgcaaccacgcccagctaatctttaattttttgtagagacagggtttcactgtgttgcctaggctggtctcaaactcctgggctcaagcgatcctcttgcctcagcctcccaaagtgctaggattacaggtataagctactgtgccagggtgaggcataaagttttttgttgttgttgttgttttgtttttgttttttgagaccaagtttcactcttgttgcccaggctggagtgcaatggtatgatcttggctcaccgcaacctctgcgtcctgggttcaagtgattctcctgcctcagcctcctgagtagctgggattacaggcatgcgccaccatgcccagctaatctttttgtatctttagtagagatggggtttctccatgttggtcaggctggcctcgaactcccaacctcaggtgatccgcccgcctcggcctcccaaagtgctgggattacaggcgtgagccaccacacctggcccggcataaagttttaatttaagcaaaaagcaagtaataaaagtactgtcagccacggcctattgagggaccacatgctgtgttctaaacactttccaggaattatctcatttaggtctccggacaatcttgatggaaattctccccactttacagatgagaaaactgaggctgagggagggggttgcccaaggtcacagaggtagcaagtgttagacatgtggtttgtatctaggtctatctggttccaaagtccatgctgctaaccatttcaccacatcagaatgtcaaggacagctcatctgaaaggaaaaagcctcaacaaggcaagaggtgggttgacgctatgagaaatgctgggtccacagagcccactgccaagtgctgactgtcaggtccggccacagtgtctcagcattttctgcccaagcagacatgcgcagagtgggaggctgcatgcagttagcgaggagcggcccacactcagacccgccaatggccatgcccagcagccatgcgagctggtgcctgcctggccagaggtggaaatcctctccgtggtgctgggtgtgcccatggccatggcacatggaagctctggctgttccttcccgtcctgggtggcagcttccgtggtgccctctgggctccttggggtttcaggtccctgggttggcctggccacacttcccctctcggtcatctttgcacctagctgctccgtggtaactgaggcaggggagctgcttcccagcctccctggctctggccttggcctctcctgctgtaggccatgttcctccgtgagagtccaggtatctgggaagatggcctgccggtccactgccactacagctggctctgttacttcttggaagcttcgagcagctccagaggggggcattctctcaggcccgaatacctccgaagcccatggctgctcccatgtggcagccaaggcctcctctgggcacgaagggctggctggtggcccctggggctccccaggctcttggagagctgtgctcccagcacagggtacagtgtggcagcggggagccccagagagctcacttgtgatggtcggcaggtgcctccaatctcgaccctgactctctgtgcccactgcccacagagaaccctccacagagggagaccttgagttgaaggtgtcaggcatcaccccaagaccagccaaatcaagccagctgggggctacaggaggtagaaggcctcgtccactctgctcagtacaagggaactccggagtgtggccctggcctcgaggggagggtatagtggtgggtggcagaaatacagatggcatgggaggaggagaaggaggaagggagcagtatgaggacggagcagagctggacagccccggggcactcagagccacagtggaggagctggtctggagaagagagaaatgcagaggggagaggagagagagagatgaggggagtgaggacggctgcaccttgcaggcggtgggctcggccttagggctgaccaaggtggctgcaaagctgacgcacaggactgacccttgaaggagacccagaccccaaaaaagcttccctgggctttgcgtgcttagccctcaccaaacccaagcaagagaaagcagccaccaagccgtgcctgtggagccacccagggagggtatgagaaagaaaagaccacggtaaggtggacaaatggggagccaggtggctacggaagacagccccaggcacaaatggagggagagccagccccaggggctgctgaacccgcctcggacactggcccaactcggccatgtccctccggacaatcccagctttcctacaccccaagtcctctacgtcttccacatccttgctccagggatctgactaaaaccactgctgcttctcctggcatcaggacacaggctgtctgagaaaacggcagccttaaaagcaccggggcacagctccctcaggccaggccctgaatccaacttacttgcttctgaccatggctgctcagaaccactggcctggagctggaactatagcacgcaagggtcacagggccaggctcaaccctccaccccagccacactcctgtctcccaccatgaaacctcagctgaagggaggctaggagacaccatcagggccaagggtgcagggaccgttcactcccctctcatattccctaggtcatgccccaaaggtctccagctgacccacgtggaagtatgaagtcagcagctgctggtgagttctgtcaatatcaatccccaaggaaacactgaatcctctaaattaaacatctcaggcctggcaggactggggaggcccagcaggggaggggaagggcaggtacctcgtgcaagcctggccccatggtttcccacagacacgctcgtgggaactcagaggccctggagggcgagagggaaggatgggagaagagtagcaagggaggcttgtggattcaggatcagaggcagaaagaaagaggatgtgttgaggacagctagcgtgggagatggggctccagggcaaatgacctcccaggcacaggctcccaagtcccacatggcccagcagagaatgccctcccccacccagagcagccatcaacacaaggttctttgtcccagcgtcccagcctcctgatcccctcgacctgagaggctgggagcacccagggaggaaggaatgtcccagctgagcacttctccagcttgtctgccttcactggctactgcaatcctcaggcaggctgacccggccctccctccccatctcctggcatcacagcaaggccagggcatgacagtgtccctggctcaggggcaaggcacccaaacactgagatgccaagatccagctacccacactgaggtaagggaggagaaggatgagggaggggcggcagggcagggaagatggagggttcacagggcaccttgaaatccgacagcgaagccatcagctcgtccagctccctggtggcagaggaggccgagatgcgtgtctgctgttgggtggaggtgacgcgctgcgggctgctcatctcgccctggttcacagtgatggcagggctgcagggtgggcacagcatcagtggggagcccacagtcagccccacacttcccggggatcagatcgacctctcacctcggacactggggtctcaccatccccaaccccagggaggtccaccagctccctgtctctcctggggacccatcactgggtcagaagaaagggcagttcaatggcaccaggaagtgccaggaagactcctctagcccccagcccaagtgaaagctggcctgcgaaacaagcccaagcgccctgtgtttcctccacaacactggacatggaggtgaggctactgcagtaacacgacggcactggtaagagctcgcgtgttgggcactcaccatgtgtgccacgcactacacaccagaaaccattccaagcgctttacatggattactggttctcacccttactgaggtaggtggtcttatcccagtgatcccataagttcttgtcccattttacagatgggaaaactaaggcttgagagctgacagtaactgtcagagccaagatgtgaaccccactgtgtggccccaaagcctgtgctaagagctgctaagctccaggcgccctcagcctgcacaacgtctgtcctttctgactggcagtgactggctgaaggcagggatggtgtccatgtgactcaccactatccccccagtgcctggcaaatggcagacacgggagggagtgggtgataccagggctaaggggacagacactggacccggggcaggctgggccagcccttccccacctggggagggcccagtgggtactcacacggggctgggcacggagctctccagttcatccaagagactctccacactgggccgcacgtcctccaggccccggcccccattccgcttaggcttctctttcgtcaggggcccagctttgcctcccaaggggctgttagtctctgggacaccatagagggggctcagggccccaggaagcggggggcttgagttggcctcatcttgcagagaggagagaaaaaggctgctcagcccttgagccctcctgggatctagaggtcagcagatgggccctgggccctggtagaccctgccccagggacccggtcctacctgcagggaagcctggcgggttatgctgtacagcgttcagttccagcagcaggcggtcgagttcagaaaggttgctgcccagggacgtgctcattacggtgggtgaaggctcagctgatttctgcttgttggggaagctttgagaggcaaaggaaagaagatagtgagagatgctttctggccttgtactggcttggcagttcccagattcccaaggagaacaaggcagaggagatgcgaagtcttcccccgcaagaggacagagggtagggaagggatgtggtaagaagaggggaggaggccgggcacagtggctcacgcctgtaatcccagcactttgggaggctgaggcgggcagatcatgaggtcaggagattgagaccatcctggctaacacggtgaaaccccgtctctactaaaaattagccaggcgtggtggtgggtgcctgtagtcccagctacttgggaggctgaggcaggagaatggcgtgaacccaggaggcggagcttgcagtgagccgagatcgcgcgactgcactccagcctgggcgacagagtgacagagcgagaccccgtctcaaaaaaaaagaaaaaaagaagaggggaggaatgaagtcttgcttcagttcctcagctacacggagatgctgtgatagcccagaatgtccactgcatggagatggcactgatgaggtagacgggcccaccgacaggccttctgcagcttaaaccagaataaccccacaaggcccagttgctatgcctgctcccgggcctccgctgcctcccaccctggccaggtccctgagatttctaagcaggagggaaggtgccctgggcagactggggcagtacctgtagacgtgctcctcctcacccactcgggagcacggagagccaacactgtcctgagggttggagacactggaagttttggcactggagccgtacacaggtgatgaggactgaggctgcgagaaggagaatgctcagaggctaccccgaggggagaaaaaggaacaggggccaggagcagctccagtcacccccaggaggctcctgcccacagccagtctcaccagggaatttccacagttgggccaggaaacctgtgattaaccacttggtcactgttccactcacgtggtgagtgggaagagcagtgtctggttgggaagggtcgactgccccaattccattccatcccctggctccctaagcccctgccagctaagttccctctgtcccccagcctccttggccttcccagccactgtccccgcctcacctgctggtggatgaatcgggagctgctgggctgccactggtctaaggggtcaaggattgtgccattgagggcctcgctggacgggggtggggggacggggggtggcacggcaatctcctggtatgtgtggtttccagttgggtatgagtagggggtctcctccgacaagaacacaggccgtttggagatgtgggaggtggtagactccaagtccgccagcagggcgtctgcaaagagaaggcacgggtagcaggtgagaaccgggatcctggggactctcccgtggcagggccctccctgcctgcacctcaagagttaatgccttctagcacctgccccacccatgggagaaatgaccagccttgggacaggaagccaccagccccgaccagcctaaccaagagccggctcccaaagctaacttcttctggccacccaggactgaaagtgctctagaggcgggctctggggctgccctgtgggatctcctacctctgggagtcaggcacctggcactgcgttccctcctgacagggccgcgcagccgcgagtgaagtgcctgtctggaactctgaatctgcagggcaacgcggagagaatgggcgggaggggccccacgtcacagggaggggccctggctatgccaggccctcacttgatttctaagagcttaggctttcccagcccccgactggaaggggcactcaggatggtccctgccctcctaaccaggtggaagcagaagcccaggctccaggttcctcctgaggctctaggcttatggggtaaggtgtgcggggaggtgggggctggagtgaggctggtgcagcggtccccaccccctcagtgagcagggggcaagactgctccattggctgtttctgcggaagtctggcaagcagcccggccccagaggctccaggcccccactgttctgcttttaacagcggcaagggagccaaatcagccctctagtgtaagcttccattaccctggcacctggcagccaacaggggggcactaggtctccccagtctccagaaaagaagggtatagaagggcaggagtaggacctgctgacccccacttcctccatcccctcctgggaccctcaacagccccacggctcagacagcctggccctggatgccacaccctcattcctgccccgttcacaacttgcttgctctcagctccccggtaacctgctgggtccagggagctgacagcttgatccctagccctcaggataataaacatctaaaaagcaatggctgcgtttattgccacttatcagtagcaggcagactgctaggcattctagcagcatgtacgaggtctccgttaatccccctaataccccctgtagctggaaatgattctccccgaagcgatgaggaaagccgggcttggagaggcagaggtcagaggtgtttgctccaaataacaaagccagtgagtggcacaattgtctgactcctcagaagccccaaaccccaaaaacctggcctgtaagaggccactatgactaccagatgatgccatacttaaagggttcaacttcctgaatgttggaggcccaagctgtgaggcctgccagtgtgatccttccttgtggccttgctcccagtcccccaacctgtgttcagaggagggaatagagaagcaaggccctcacccagggcctcggtctatggggccacaccttgtcccagctgcctgtcctgatctcctaccctcaaggctggccacacctaccccatgctcctgcccagatggacagaggggatgtctgttccaaggcccaggaccccgggtctggtcgcctgacctccaaggaagttcaggtcctacagcccgccccgccctccgggtcccatggaggaggcctggcttcctgtctctagcaaaccggaactagagggagttggtaggtatctaggtaacggcagaaaaggaaccagtgtccaggccaatccccacggcctctccagggccacacctgctgtcttggcttcacgcagtgtcctcatttcctctgggcccaatcagcaatgggtggatccctctttctccaccatgggcagggccagctaagaaaccccataggactccccagagcaggcaacgaatgagtgcaaccccagtagggggcaggagcagctgccatccttgaaggcccactggggccaggagcttcacctttgttacctgccatcctcacaacgccaccagcacagatggtataactgcggttcagaggcagagtcacatcccacactgccaaggctggatgaagtgacaatgctggactctgatctcaggtctcttggactccaaacacccaacagaagacaaatggtcaggcttccttgtcaaacattttgaatcagggactccaccaaacacccgctccaccacaatgtgattctaagcctgggcttttggtttatggattggattcaggtttacaatgtcaacaggctcttgggagcacagatccctaggctggtgaagtattggtgagaggatgcagtcctggggcacagagacacaagatcactcattctgaggtcgagccagacctgagttcaagtgccagctcccctctctaccatccatgccacagggcaaatcgcttagcttctcagggcctgttgtctcagtaagctcttgaataactctgacctcaaagtactggtgtgaggtttataagggctagcaggtacactggaagctgcagacatcagttgcaaatatcaggctctccagacccaagtcactctgcaggaggaagctccatagcacattggaagctacaaacatcagatctgatttgctctgtaaaatccagaataaggtcttcctccaaggagagcagtgtaggtaggatgcaaagtactaacttcttctaagtctcctaagtcttttctgggtagaatatgagcaaaccatgaaaagggcaaccttgaaaagaaaagaaaagtaataaagtaacattcaaattgtagcatgtcccagcctgggcaaaacagtgagagcctgtctctacaaaaaatttaaaaattagctgggtgtggtggcgcatgcctatagtcccagctattcaggaggctgaggtgggaggatcacttgagaacaggagttggagatcggcttgggcaacacagtgaaaccccatctctacaaaaaatttaaaaattagctgggtgtggtgatatgcgcctgtagtcccaattactcaggaggctgaggcaggaggattgcttgagcccaggaggtcaagactacagtgagctacaattgcaccactgcactctagccggggtgacagagcaagaccctgtcttaaaaacaaacgaacaaatcatagagtgcagatgtcagggagaaggcacatcattattcagttttctccaaagttttgtctatttgagggacagagaaaaaccccagcaagtccatccaccagccacagggtctctggtatggcttcctcctctctctccacccttcattctcacctagtgatttggacaggcaaggactaggcaagaggggtaggggttggtgcctccaaaccccccacaaactcctcaagaaagaaaaccagaaatacaggaggcaagccaacagtagactcctagctttactttgatttccaatgggtgcaaatacctgagacttccccataggctgcaaaatggttaagggtcagagtccccttgcaagctcagcaaacgtcccccctggcttgagcaaacagagctggcagacactgcacacaggaaggagtccacttgaaggcagagccccatcccagcggggtcccccagtgtccggctccagcctttccctctgctctaaatattcctgctcctcataccccaaagaaggtgtcaggctatccactcttcagagaaaatggtacccactgaaaccattcaagaccaggaatacaccctcccttcccacatgctgggaggacagattccagacacgctgctcggaagtagtcgggagacctcattcaagctaagaaaggcctcaaatttccttggcattactctactaagtttccaggtccaggcctggggccctccagacccaagtcaccctgaaggaggaagctctctctctggggcttcccaaccactttctggaggaaacccaccctgaattctgcaggttttctgtctctctgggccagcggaagtatgcaacatgaggaggtaggccaggctgtctcgaggctgagggcaggctaggtgcaaagtccccagcgagccatgggcaaaggccacggagctatgtcctggctccgccctggtgaggaaggggtgcagactgtctgctgctccccaccagagggcaccattggcccgtcagcttcttgccactgggtaacctcgtgcaatcttgcaattttctagccggggaagactggggagcccctggccatgggcgcagtggggaagtttctatccttagagaacaaggctgagctggaggaacacagcaagctagtgggaggaacacaggtagcctggtatcacttgaaggcacaacccaagggtgacatgcagggctctggagaaccagaggggtgcacgccctcgcttccagggccctgtgcaaatgcagcaccgtgtgcgcccctatctgcaccccatggctgcacctggtcggagcaacagcatggaacagctgcagctttgggtcgggaggccgccctggggcaggtggctgggcagaaacagtgcactacggccaggctgagaggaagaagcccttccctgggcctcagcaactgactgagcgtaatccttacaaccggtgggagccgctggagggttaaggtacagacaccctcagcccactgctccgaggaggaggggaccggttcgcctgcattccagggcaagtgctgcagctgcatccctcacattcctgtacccacctaggggctccgggtggaaggaaacctgggtccccttgtacctacaatggggggatgtcccccagactgtggctctggggaccccggttgatccactgacgcatggcactcaatatcagattaaagagaatcaattaaaaccttccgcccccacccccgactgcagcacagaaacaagccaggctgcttcctcctacctaagcccctgccacttcttagtgtgtgataaagactatcaagaccagaggcctggagctggacaggtgccaagagagaggagataaaagtccatctctctgagggggtgggaggacccagagcgattccattctctcctcccaggctctgaggactttcagtgttacaacttgtacggtgaatcctcagtcacctgggctctgctcaatggctgaactgctcggataggctgcttaactgcttttgtgcctcagtttccttgtctgcccaataggaattccaccattttactcacaggattgggactacatgagaaaaagatataaagtgctgacttagcacagtgcctggaatacagcacacaggaaatgggagttgctaaatagattacaagcttcttcccagggaggtgttaagccctaggaggggaaagaaatcacctccccgtcctatccaatccctgagggcaaagggtgctgccctctagtcccagatcagcaggaagcaggtaaatgtggggcatggagccagcttttccatcccttcttggagtttacaggctgccctgccacaccagccccagcgccagggccccgtggtccctgcccacctttgccattctggactcctccaccagcagccccaggcagaactagaagaggtatagtcctgtggccctcaggcagcgccccaccttagcacgccttgcattctcgaggcctggcccaggagaggcccacgtaagaacaaggtattttccagccccttcacccaccttcttctgcaggccaatttcactcagctttcattgccccaggcagggagcggccagtgcagcttccttaggagctgacaagccaaaggaaggagcagcaagcaccgccctgaaagctccagcaccagcagcaacgggctgccatagcacaggggccttccccgcagccctgggccagctgtccatccctgccatctgataggaaacccagactcccagagaaacaagtccctgtcctagggggtctggggatgcccagcctcatggcctgtctatcctgttgggtccagaactctggacaagggaggttcccaaccccctgatgaccacctgggcagccttggtagctctgagtgtcagagaagctgcggcctccttacagttgcccacgctcagggatataagcagtgagcagggcttggcccttcctaaggaaggagctatgtaaacagcaggaccagctcagggatggtctcatctcagcccctttggtgagactcttccagattaggaaggaaaacagaacgggaaggcgggtctcccccctccccctggctccaagttcccctcccctcccccagcccagagcacatgagcagttagagcagaggtaatctaatccgcagcggggtgctttcactcggtgagtaagtccccaggaatggtgagctgggtatatttatcctgataaccgtctgtcctcagtaagggccaatccacaattaggccagatccactctgccccacccacccccagcccagggacctagggcctggacactgactaggaactcagtctccttgaggggccttccctgccaatttgggttcttgtcaactgtctcctctccaagaattaagctccagagagcaggggccttgtcggtcttgttcgatgccatatccccagcagctagaatgaatggctgaatgacagaggggctgtgaagaggaggaggatggggaagcagcagtgagcagagcaaacagccagtgcggaggaggggagccaggatgccctgatcccaggcccagcggatgagtgggggcccctcagcggatcctctaacctctctggatgtcttctctatcaagaaaatgggcagaacccgatttgtccccattcctagtagcatgctctgaggagataatacaattatgggtgagatttatatagcacctttgagctcttccgagttagtctaaatccaagattctgctattatctgaatcccagacaggaactgctctgctaagaggatggatgagaaacgatcaataccatagtgtcatttaaatatttaatagccatgcctggaggttacaaagactcagccaccaattctcctccgctgactcatgcctcactcaacaggaactgcattttacccttacagccctgaaggaagtgtgggctggggggtgacacacaggaagccaggggagaaggcccaggagtcttccagtcagccgccaggggaggagggggtggtcatttggatgaagtggttcttccccaggcttcctacaggcctagcttaggagggtggcttcctgtatgctgaggagctcttccttgcagagggtgacacaatatgagtgtgcagacagactggctttattggctgcctggcttgtgcccaaggtcacagggcacaggtaaccagagacctgagaaaataatggctgcaaggcaactccagcagtcaccctgagctccaggcagaagaccaactgtgccaggcccatctgcaccaggcacacacaaggcccacccatcaggctcctggctgcagccacttccccatcaaattgggctccaggagcttaagcaacagcaggtgagacaaggctgcccaggttgactctgagcacttctatgcatctgccttaggctacagacacaggagttcaggccaggctggccaaacaccagagtctttctcttctttttttctttttttgagacaagtcttgttctgccactcaggctagaggcctgatcacagctcattgcagcctagaattcttgggctcaagggatcttcctgcctcagcctcccgagtagctaggactaaaagcacatgccaccacactaggcttttaaaaacttttttgtagagacagggtctcactatgttgcccaagctggtcttgaactcctggcctcaagccatcttcctgcctgggccttcccaaagtgctgagattacagacaggagccaccatgcccatccccagagtctctttcatattgtaaataactcatctctcctgtccagaatcagtgggccctccctcctccagaggtcccagaacattgtggacacatttcattggtcagatgtcatccacctctttaggtcgcccagagatgctagaccttttcaggtcaagtccagggccccattccaggcccaactcacagctccttcaatgggtaaaacccagattcacatacaaaaaagacagcctcaaacccaggagactcatgggctggaaaggttctcagctgttccaaatcgaccccagcccattcctgcaatctgggctcttccaggcaagttgatctgttgcagagcagggcggctccttgggcctctcacccctgctaatcaccaacagaggttaggaggggctcaaagtgagtcatcgtcccacagagacccgaacaaaaagttcaaaagtttgcctgttcctgagatgagctgcagtttttttgcgatttttgtggatttcatagcattagttacccactctttgctaatcaggttctcactaaccagccagcaccttccccttttttcaggcagcaaggtcatttcccgaagtcagctctcgcttgcctgacttccccagttctcttttctaagtccctttaatagctcccacatttagctggtcactaagtcacatcaattcttccttcgcggggcctctccctgtcatcacttgcctccctttcctttcatcaccacagccaaccacttggactagcattcgaatccatgctcagtgcctacctgaacttgactgcagccccctgccctgggttctcccaatctaacgcttcctgcacacaccatcggcccgaacttcttggcacccagcctttttggggcatgcctcacacttcactcttgcttctccccctagactgcaggtcctctgtgggcaagaacatcctcctgctcctgaatccccacagcatggataccctcataggcctcctttttttttgaaatggagtcttgctctgtcaaccaggctggagtgcagtggcatgatctcagctcactgcagcctccacctcccgggttcaaatgatcctcctgcctcagtctcccaagtagctggaactacaggtacacaccacacctggctaatttttgtattttcttagtagagtcgaagtttcacattgttggacaggcttgtctcgaactcctgacttcaagtgatccacccacctcggcattccaaagtgctgggattacaagcataagccactgtgcccggccctcacaggcctcttagaggggcttgaatgaatgtgtgcagagcaaggggtggagttataatactcacccactgttgccctctctgcctataaaacaaggtcagaaaccctggggatggcattctgttcttgaccctctcagaatatggccccaaactaaccttcactgcctccttggtccccctcactgcaacccatgtctccagccaaactggactccccgcttccctttttgccagcgtgcctttcttcacaatactgaatgtgtcccaccactacctctatcatcattcacctggtttgagcctctcgcacaaggatatccatacccccaggggacagatggaagccaggggtacaggaagccacctcaggataaacccagaacactctgaggatcaaatgtactcaggggcaagaaatgtaaatcattgtcttaaaacaaacaaggctacattatggagtcaaatgcaaaatgcaagtgaaatcgtaagataaaaagagaggcttcaaggcctgcatggtggcttatgcttgtaatcccagcactttgggaggccgagacagggagattgcttgaggccaggagttcgaaaccatgttggcctggccaacatggtgaaacctcatctctactctactaaaaatacaaaatttagttgagcatggtggtgcatgcctgtaatcccagcctcttgggaggctgaggcaggagaatggcttaaacccaggaggcagaagttgcagtgaacagagattgcgccactgcactccagcctgggcgacagagtaagactctgtctcaaaaaaacaaaacaaaaaaaacagataagattttgctcttggggactttggcaaacaattttaagcagcaccacaaagcccccactgtccacacataaaaccacccctgcccatatcacagatttggctggtctgctgtcgttgggagctaggatggtcacacagttctttggacaccctctgggcatcccacctgcatggcagtgtggtagagtggaaggaatgggccatctaacagtgaggaggatgggttcaaatccgccactcactagcctgggtgaccagtgactagataattctgggctttagtttactcaggcacctcatagcgcacagtgagtaatggatgaaaaagaatgtgagagccatcctggtggctgggataaaataaacgtaagcctcccactctgacacacaggagacactcagtcaatagatccacatcactgattttcatctcccttaaggccagcagggggaggagtcggagccagggactgcagccagggatcctgggagctgtgacaggttgtcactaactcagccttcttgctgagcaaaccactgacctcaccctttgtgtctcgggttcattccaagtcctccttggagaacatcagctgagcccaggcgcctccaactcactgcctagcaaggacagaggcaagcgagggaagctgcagggccccaacgcctccacccccaccccatccctactgcctgccgggaagtcacagctgtctgagaggcctgtggctttgaacccagaatcgcaacaatagaaggaactgcccaagctccatggtagctcccagaggaacccaggagagagcagcctctgctcctgccacggaagctctgagcccagcagagtgccaaaaagggatccaaagacggggctgcgaggctagaaagcagctcaggagggggtgaggagtggaacaacccttcctgagcatctaccaggagcccagccttgcagccccatttgttgccagggattagaatgcagacacccagagccgccccataaggccccacgaggactgcgctgcctgactgcagagatcacccatgttcttcccaggatgccccacaaggagaggaatgatcgctttcagcagctgtccgtcctctgctcgtcaccactctccactcccacaacacacatccccagagcccccagaggaatccaaaaaggcgggcctgctgggttccgctctactgctgcccactccaagtctcctgttctcttttctttctgcctcctcctcaccctctgcctcaggaggggtcttgagccacagaggagcccctagtggtggtacagagagctcaagaattctgagaaggctggtgcactccatgttctggtctaacttgttgatgtgcaaggtcgacgcgcacaagtgttttccccctgtgctacgctgcttgtggtcccatctgaacctcagggtgcaagatgggcctgccccgggaaccaacctctgacctcgcagagatgacatcagaatcattaagagacacacaggcagacaagggactccactgtaggcaccaaaccagccaacacgggacagccagcaagacagccagcctagattttccaacccacagtcagcatagctgttcccttcaatggacagccacatgtctcacccaagcacttttcccactgagcaaaaaagtaggcagttccatgtcttgccctctgtactgctgtttttaactactctgtgtctgggcacaagagggctgcagagggcacaacacgctggggaaacacaagcctgagcatagagctgtcctcagccactggctctcgaccctgacgtgcaatctgccatgaggtgtgtcaccagtccttggctaatcatcataaggtatggacatctgcaactgatttttttctttttttgagacagggtcttgctctgttacccaggctggagggtggaatacagtggcatgatcacagctcactgcaatctccacctcctgggatcccacctcagcctcatgaatagctggaactataggtgtgtgccaccatgcccagatgatctttttttttttttttttttgagacggagtctcactctgtcgcccaggctggcgtacagtggcgccatctcagctcactgcaacctctgcctcccgggttcaagcaattccctgcctcagcctcccgagtagctaggattacaggtgcctgccaccacacccagctaatttttgtatttttagtagagacaaggtttcaccatcttggccaggctggtcttgaactcctgacctcgtgatccacccaccttggcctcccaaagtgctggcattacaggtgtgagccactgtgcctggccccagctgatcttttaattttatttatgtatttatttatttatttatttgagacaaggtctcactctgtcacccaggctggagtgcagtggtgtgatcatagctcactgcaacctcaaacttctgggctcaagtgatcttcccacctcagcctcccaagtcatgagggctacagtgcatgccaccacacttggctaagttttctattttttgtagacagggtcttaggatgttgccagggctagcctggaactcctgggctcaagcgatcctcctgcctcagtctctcacagtgctaggattacgggcatgagccactgcacctggtcattgcttgcttgcttatgtatgtacgttgatacctacagtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacaaggatgcccaagccaagcaactggccacttgcttacatttctagcgggccatccacttaattgctttggcgttttcatccaaacacgaaggcagtgcctaaaagcactcctaacctactccccagggtggtctccaggatcatttaactcaggaaccaagtaagagtaatggacttcacaccccttgaacgttgctgctatggaaacagtattgttgccagacgcaatatgcttcctcccacctggcaccacaactcttacctgctcccctcctgctaagggtgagtgcacaccccctcccgcaccctcctgccctacccactcacacagctgtccatcccctttcccagaaggaggtgcacacattttaactggacttatatagcatcacaaaagagactgatcctgagcaacctccacagttgtaagagagcgatcatctccagtttccaaaggccactcaaggaggcatccaaatcacttagctcttagcctgcaaaactgacaggaaagctgagaagacggagcctcaagtccatgtggcccagccagcacctccccagagtgagactggctcatccctgagggcagcacaaaccccctagaggtgaacctccttcagtagccctcccccgccctctgagtcaggtcgtctgcagtgcacagctggcgggatccttggaagatactcacggcatcccggctggtggacttcatgatctcacttaggccaatgcacacaccctgcctctcatcgctcttctgagacctcaggccttcctcaaggatggggatgatctcggggaggattttctcccctaacttccgcacaagatctcccaatgttctcgctgcaatctgtcaacagagaccaatccaggaagtaaagtccctgcaaagcccagggcacccagaggaggactccagaatgagggccctgaaacctcccaggctttatctgaatcactgacttaacttccccaaatgctcttacccctaaagagcccccaaatactctctgtagtgcttgcaaaacactaccaaaaaattatctgtttcacacacacctacacaacctaacattaagagccagcagcaccttacacatgtacaaaaaattcatcatctgctgcacagtcaagggccaatttccctggatgactgaagccttaacactgtgctatggctgagcaggagccgaatctggaacaaagctttaaggaaaaaaaaacatctactttctgagacctcatgcaaacccttctttagagccaaatacacaatttgcttgccaaggatggggggttggaagtagaccaaaggagatgggcagaaatgatcaccagcccatctgggcacctcctccaggcccactgatctgtctgcccctgccagcgcgccagcctgatctcatgccgcactgctcctccctgcctcctcactccagccacactggccttgctcagcccctactggtgctatgttcctgcccaccacgggacctctgcatatcctgtctttgtatctgaaacattatttattccctctgtctggaatggtctttcgccacctcctcacctggttagtgcttacttatctttcatcttccagcatcatttcttctgagaagtgttcactaacacaggcccatccctccccagcaggtcaaatgcagctattataagcatttgcagtgccatgcagcactggccacagtcgcattttacatctctttgtgtggttatttgattaatatccatctcctcgactagactacctctcatgaggataaggaatgaagctgcctttcttctccattgtgtccccaggtgctaggcccctgcttagtgcacaggagatgctaataaatatttgcagaggccaggcgtggtggctcaagcctgtaatcccagcactttgggaggccgagacgggcgcatcacgaggtcaggagatcgagaccgtcctggctaacgtgctgaaaccccgtctctactaaaaatataaaaaaatggccaggtgtggtggtggatgcctgtagtcccagctactcgggaggctgaggcaggagaatggcatgaacctaggaggcggagcttgcagtgagctgagatcacgccactgcacttcagcctgggcgacagagcaagactccacctcaaaaaaataaataaaataaaattaatcaaaaaatatttgcagaatgactaagtaaagaacacaatgtccctctgttaggcagggtggatgggtactttcccaggctctgcagacccagccttctaggctctgaaaggaggcactggggctgctggtccaaaacaaggcccaggaaactcaccgttctcttatctgcacacgtgctggccaggaaacccagcaggagcccaaagagagtgggtaggatctcacgcaaggtgcggggggtattggagacaacaatcttccagacatgcagggacgcctgccgcaccaccagctgggtgtctgagcggcccatgtacagccctgccaacacccggttccgccgctctacccccagggcagtgatgatcgcctgcagccagtagaaggggacagagagtagtgaagcctctatggcatgggcatcagggcacaccctaccatcagcaggggcaggaaagccactgcaggcaccttgttggactgggcagttccaaagttatcatcctcagaggcagtttctgtggtcatcttcccagtgactcctgagatgtgaaacaggagatccccaaggagctgaacagagctgaacctgagaaggaggccaacaacacagtcacacagctgcaaggagtgggctcggcacaactgagcactgcacagaagatggaaagaagtgcacccaaaatactcatgacggtcatcttggaatgggaagagtcaggtggtttacatttctttacactcgcccacatattttccaagttttctactaatgaacatacattaatgttgagggaaaaaaactttttaaaaacatgtaaaaatttctataacaaaagttataaaaaataaagtgagtacaaaaggggaagcattaacaggcaagtaggaagactgatcatcagaagtggaggaaccaggagaggccttaaaggataaactatttcaggccaggtgtggtggctcacgcctgtaatctcagcactttgggaggccaaggcaggcggatcacctgaggtcgggggttcgagaccagcctgaccaacatggagaaaccacgcctctactaaaaatacaaaattagccaggcgtgctggcaggtgcctgtaatcccagctactcggaaggctgaggcaggagaattgcttgaacccgggaggcagaggttgcggtgagccgagatcatgccactgcactccagcctgggtgacagagcgagactccgtctcaaaaaggaaaaaaaaaaaaaaaagaccactgtatgaatgtgctatatttttaaatcaacctccaatttttcaaatggtaagcaatactgcaacaaacatccttatgtctaacagctttaagcacttgaccattccctacatccttgaaatatattcccataagtaaaatttttagattaaagagtacttgacacttaaaatctgaatacaaattggaagcctgtatagagaggactttttaaaaaagaatcagaataaagacattgctacaggaaactggaaaagttacaaaatggttaaaagcaagggtctggaaaaagttgagagagttcttggcaacattctgctcttcatttctcaactggagttatcaaaatgcaaagttcaaccctttggatctttttttttctcctaagacagcgtcttgctctgttgcccaggttggagtgcagtggcacaatctcggctcactgcaacctctacctctggggctcaagtgatccttccgcctcagcctcctgtgtagctgggattacaggtgtgcaccaccattcccagctaattttttattttttatagagacagggtctcactatgttgccagggctcatcgtaaactcctgggtttaagcaatcctcctgcctcggctttccagagtgctcggattataggcatgagccaccacgcatcatccccactgggtctttctgcccaagttctcacctgattctccaaaggtcatcaaagaggccttgctctagctggggcagcagcagggcgatggctgtctcagcgtacatggagataacccgctggcccgcgcgcagggcggtgtcacgcacaaactcattctcatcagcaagagcctgggcacacagagggtgggtcagccagagctgccacccccaggcccccagcccaaaaaacatggggctcactgaaggctgagggctctgccaaccaaccccagccagcagggatctctagctctccaggtgagcacttgcctcctgccctcctcaaggactctacccttgccaaggtcatggtacctactttgaggatacaggggatgatgggccccacataaggagtaaacttgtctccaaaggtgatgggcaggtagttaaacatcataatgtagccatctcggacatggggtgcaatgtccactttgctggctgtagccacgatttctggcatcaacttctccaacttctccacccccaaaccggccatgacctcagccaaccctgcaacaaaggacagaatgagtccactggatctgagggccccttagagcattcccaggctggccactggacctgctctggccttaccctgtgcagcgcctgagcgatccacagagctctgctcataggtcagtgtctccatcagccacggcagcaagtcctcaaagcacgactcccccatgcccttcaccatggccccaagggcctttgcagatacggtccgcacctgtcaggtaaccgagagcagagatggtgtgagaagatgaggctcaaaacaaggtagccacatgggagcaggaaggggcaccgagggcctctttctctttacccaacagacacaaaagcagctttggggaattctcaggaatccatttatggggactggatgaggggcctggcccatcccccagcctacctcagactcacctcaggcacagggtccaaaagcgatgctttcaggccaggcgtcacgctgggcaggtacggagccaagtcctgcaacaacacaggaggcggctcaggtgaggcccgactcctgctttctccaggcctgttccactgtggaccctgacctccccattctgctggcaaggagtgcttggcaggggcacctagcatgcaaacctcactgcccacggaacagggagggcaagtaagtcccctctccgactggttccttcaaggccctctgcaattgctcagggactcctacaagggaccccaggcccatcctcaacaaacaggagttcaatgctcttgcacctcccacccttctcttaggaccaaggcctgtccagactctggaatctttagcaaattacttctggtaatttcctttcagaattttattaacatcttccctttcttcatctcaaaatgtttatgtcttttgatagagcattcagctttagggaataattttaaatacagaaaatgccttatgttcactgcagcatcacttaaaatagccaaaaaccttggacactatatgaccaatgatagaattatataagttatggtatataaacttgttgagatattatgtaactattaaaaatcagttttgtgaataacttgttataacttgggaataagttttaagtttaggaatgccatttttaaatgtaattttaaaaattaacagtaattggccgggcacggtggttcacgcctataattccagcactttgggaagtcgaggcgggtggatcacctgaggtcaggagttcgagaccagcctggccaacatggtttcaccctgtctctactaaaaatacaaaaattagccaggcatggtggtgggcggctgtaatcccagctactcgggaggctgaggcaggagaatcgcttgaacccaggcggcagaggttgcagtgagccgagactgattcagtgcactccagcctggcaacagagcaagactccatctcaaaaaaaaaaaaaaaaaaattaacagtaattattttcgtggtggggaactgtagataaaatattttggttttctaatttttttaattaattaatttactttttaagacagggtcttgctctgtcaccccaggctggagtgcggtggtattatcacggcggtattatcacggctcactgtatcctcaacctcctgggctcaagctatcctcccatttcagcatcccaaagtcctgggattacaagcattagccaccaagcctggtctgtttttctggttttttaatttcccaaattttctaggattaatataacttttatatattttttttgcccatagcctcagtaagcaaagcagagctatggcagacagtgagaccacacatgtgagctcctaaggcagacagtgagatcacacatgcaagctcttgggagcaaacaaacaaacaaacaaaatctcccaaaccaggctctcctgacaacaatacaggagtattcttgtcaagagcaagtagtcaaagtggcaagcacttcaacactcttgagaggtcaaaagagaagacaggcctttctgggcctcagctgagaactaagaaggacttgaaccactgcgctaagatgcccagagagcccggatttccaccacaaaatggctcatttctccccataaaaataattagggactaacgtccataactttccatgtctaatgtggggactctgcacctctgactctgcactcaaacatcttctggtctatcccacactagcctcagctgggccgctaccttctggtctgtcagggagtacatgttgccaataatctgggctgccatcttccgcgtgtccgtggaacggtcctggaaggctctctggacaatgggcatgatgagggccagggatggggcatcaatgaagtggacaaacttggtgtccagcagggtctgcaagcacttctgggtcttcctggagggatccgtcagggcatccaggaggactggagcaatggctgcacatccaaagagaagagagctggatgatatacatctatgcagctgcaaggcccctgggcccccagaactagaatggatcagaagagaagggagtctggcacacctcctccctgaaaccccacaagtcaccagctggggaagacaggaaacccacaaagagcaatccttgtttcactccaactcctgacctcaggtgatccgcccgcctcagcctcccaaagcgctggattacaggcatgagccacagaaataaaatttttgaaaagcatgtatccttagtaaatttctggtttgcctatcggtaatggagaagtgtgttgaaatctcccactatgatataatgtatttgttaacttttccctatagctttataaattttgttttatgtattttgaggttattccactttccagactgaagtactgactgggcactggcagctgaagcttagaatttaacaagtgacatgctggtcaaggtggctggctgggttttgttcctagcgatcgacctcttcccagtacttgagaaagaaccacatccagagtagtcaggttaatcctaacccttccttaaccctcccctctatcaaaggcctcctggaatgagatggaatagcaagttttcacaggtcctaacattttgaatggtgctgatgtggtccagataatgtcattcagttctgttgacctcatgctcagcttagtgcacagggatctcttggagtcaaactgctcctgagccaatgactcagtgtccctatttcactgtgaacatatttgtcctcggaggcaaagatcttagctgaatgggtgcaagttccctgcagtgtccaaaggctgcggcgttggtgggaggtcagggcaagcaccctcacgggaaaggcctacccaggatctccgggttcctgataacggagccgatctgcctgagcgcctgctgtccagccttctggactttgacatgggagtcggtcagcacctccgtaagcttgggcacaatgttgggtagacaggatgacagctgcttaggagcacagtacgccattgccccaagaagctccactgaccctgtggatagcagacacaagcccagtactgaatcactgagcaaaggccagcaactcacctgtgctggctacatgagcaagggacatctaccctggcccctgcagacggtgctcaagcagtcactgggaggaggggagagggggctggctctagcagaggggtcgaaaaagctcttgtggcctgctgaacagtgggatcccaggtgagaggcagggcagtatgggagaaagagaccaggataggtaagacctggtttaatccttacagtgagatccaaggccaattcactgaatttctctgaactgtttcttcatccacaaatgaggaaactgatttagatttgtgttgtttcaaactacagggtgaagcctgaaggactgagaaggaggttgagtgggagggccttagatggtgatcctcccccaactagagcagctctacttttatctgtttgcttattagggtgccagacattttatttatttatttttgagacagggtctcacgctgctgcccaggttggagtgtggtggcaagattatagctcgctgcagccccaaactccagggctcaagtgatccttccacttcagcctcctgagtagctgggactacaggcatgcaccaccacacttggcctattttttttttttttggtagaggtagggtcttgctatattgcccaggctggtctaaattcctgccctcaagagattctcctgcctaaggttattttcaaaaagagctttcctggggggggaaaactttaaagccaaagaggagctttagagctttaggatatcctgacttagggttgtggctcttgtcagagacctgtttcttggcatgaaagcacataaactatagaaagatccaactgccagagggagagctggccaggcgtggtgactcacacctgcaatcccagtgctttgggaggccaaggcaggagggtcacttgaacccaggaattcaaggccagtctgggcaacatagcgagactccatcattacaaaaaaaaatacaaaaattagccaggtgtagtggcatgctcctgtgagaatggtttgagccccaaaggtaaagaccagcctgggtgatagagcaagactccatctcaaatttttaaaaaggcagagtcttaaccctatccctggtctggggagctcacaggacaagagctgtggctacccaggatccttgctgaggctggttttcataacaggaagctgggaagagaggcagagcgagtggtcttaccagctttggtccgccacgattcctcctccagggcagccagtaaggaggggagcaccagcttcaccccgtgagcactcaagttgctcatcacagccttggcacagtcatctgcagcctcaaggggggagaaaacacattcaggggcctcctcacccaagcaaggggcaaggcctgacaccagtcctagcgttcctcctataaccaacgcttactggggttctattatgtcagaccctgtgccaaggcctgcagacacagctgggaacacatctcataaagtttccatgctgttctcccgagcagtccggggacttacctcacgcacatactggtttccatccccaaagcacaggagcagatggggcagcacgtgaaccacatacggctcaaaaagtttccccagcatggtgcagagcatctcgaaggcaaagagggctcctaggggaaaagaaggtgggacggctgggaagagaatgtcccctgggggtagccacagagaacagaagggacagcaacctccctgccacctcccacccctctggaaacactcagaaacagctgtggaactagtagatgccccatgaggaggcagcaccctctgcctcagctcaagaagccccagcaaaggaatgtggctgagcgaaagggaggacagcacaggggagccaccttcacttcttggcactaacagttaaaaaagccaaaccttggccgggcgcggtggctcacacccataatcccaacactttgggaggctgaggcaggcagatcacgaggtcaggaaatagagaccatcttggccaacatggtgaaaccctgtctctactaaaaatacaaaaattagctgggtatggtggtgggcacctgtaaccccagctactagggtggctgaggtaggagaattgcttgaacccaggaggtgaagattgcagtgagccgagattgtgcctggagacagagtgggactccatctcaaaaaaaaaagaaagaaagaaagaaagaaaagccaaacctctctcagctaagggtgttgctgagttagaaatttgtggccgggcgcggtggttcatgcctgtaatcccagcactttgggaggctgaggcggacagatcacgaggtcaggagatcgagaccatcctggctaacacggtgaaaccccgcctctactaaaaatacaaaaaattagccgggcgtggtggcgggcgcctgtggtcccagctacttgggaggctaaggcaggagaatggcatgaacccaggaggctgagcttgcagtgagccaagatcacgccactgcactctagcctgggcgacagagcgagactccgtctcaaaaaaaaaaaacagaaaagaaaaaaaaatttgcaagtccaaggaaagcagcaaggacgcagctggactgggtcgcacacagcggggccctctgtagtacacgcacaagcaacggcctccacctggggcgccacggtcagattccttcctctggcaacctggggaccaacttcccatgctgggcagccccaagctcagagatgctcaccctctcgccggcggaagttcttcttatcttggatggcatcagtcagtgccgccatcatctcctgttgcttcagcgagaggatgcccaggcccttcaccaggcccgccaggccataggcggcccctttgcgctctgcgtacttgtctgactccagcagctgctgcataagcctctggatcatccctccagcatcctccttgatggctggcacaaggggtggcaagcagctggctacggactcctggacctggggaagggcccacctgtcaatgctgtggctccgctgcagccgtttcatggttggtggggggtctgaccattctacacagcacccaccactagatgtcccaagccccatctcagccactgcctgcggatgtcacagggcaccagagaagcaaacaggtatacacagtgttgtatacctctgagggtgcacactacaatctgctgacgacaaaagctttggcccatatggtgccatttctggtctaaatggaaaacctaggcctgggcagtggggcaggggaccaaggaagggactctaaagactaaatccactcagaaagaaagcttccagagaagtgtgctgctttgcctccataaaaacagcccgtgtctctgtttccaaacttgtcaaaatcacagagaaattgggcagggccttataggaccaggcacaaattgagtggaaccaaaagacactcaatcctgcctcccagccgcagctcactaagcccagcttgggagcagcaaccccgaggccatgctggcaggtgcccaggtgcgactcttttgctgcttaggctttctgacaccatatttgaccacaattttggaaactggttttcaactgtgcatttttttggtaaagttttttgttgttttttgtttttgtttttagaaatagggtcttactctgtcacccaggctacagtgcagtggcacaatcataattcactataaccttgaattcctggactcaagcaatcctattgcctcggtctcctgagtagctaggaacacaggcatggcctccacctctggctaatttttaaagtttttgtagagacaggatctcactatgttgcccaggctggtctcgaactactggccttaagcaatcctcccacctcagcctcctaaagcactgggattataggcatgagccaccacgcccagcccaactgttcactttatgaagacactctaagtggtccaaaatgcaaaccacacacacacgcgcacacacacacacacacacacaaaatatatatatataaatatatatatatttatatatatatacatgcgtgtttttcaaaacaaagaaaaagaaatttatttgcactgtagcttagaggctacattaaaacgcacctgtagcctcctaaagcactgggattataggcatgagccaccacgcccagcccaactgttcactttatgaagacactctaagtggtccaaaatgcaaaccacacacacacgcgcacacacacacacacacacacaaaatatatatatataaatatatatatatttatatatacatacatgcgtgtttttcaaaacaaagaaaaagaaatttatttgcactgtagcttagaggctacattaaaacgcacctgtaacacacaaccaacacatgtagagggccagaaaaaggcttgacataagagaaagcctgaccttttattttttttccctttggattcccagtgcacgttagtgaatagaaaaaatggaactatctaggaggtctattagaacaaagtaacaaagaaactccctctccaggggcattcttcactataaaccaggtgagtagaaaaaaatgaaactatctgggaggtctactagaacaaagtaacaaagaaactccctctccaggagtgttcctgactataaaccaggctctcccctgcgagagggggtgaatccttaacaagaactgggctttcagggccctgattgtccaactccacccctagtatcccaccgcctaaccacagccgggtcccaattctctaaccgacatgtgggtcccaggccagatggcaggtacctgctgggagggggtggagagggcagcgatgagcttggcaacaatgggcttcactttggggtcactcttgtccaggtgcttggccagagagcccatcaggaccaccacactctgtcgcacagcatcatagctggcatcattgggcgcgttcttcaggaactcctcgaatactggcaacagcgagttgacgttctcctggaaagccaaacccctcagagcctcaggtcaaccctacaggctgcatctggggacaacagtccctgccctgaggaccaagaccaagtctagctctgggacaggcatcctgacatgccagccagtggctcttccagttttctggcaggactgccacagacttaaaagaatttaacacactatcatggtctttttggctcaaagtgctctgccaggactcttggcactcagcatttctggcccctgctcagccctagcgcctgcctcccgtgtctccttagcgggctgggacccccttaccttcccgtgggtgttccctggctgggacccccttaccttcccatgagtgttgagcgttgcgagggctgcatccaacatgcacttccggacatctgggtgtcggtcattgagggcatcagggacaaaaaactgaaagagtggcttcacctgagagctgtccaaatactgggagagcttgttgagggccaacgccaagccacacctgggaaagaagtgggagcacatcaggaggggcagtcagggggcctcctctgccagtggaacctctgctggtgcacggcaaggagagggagcttgcctgaggcaaacactgttttgggggcagagaacagcctgaagcccaccacccagtgctcacccaatgttctggaacaacccacttgtcatatggagacttgccatctgccctgattttacctcctactgggtgaccagccctgtgttggtttccccagagaggaatgtgagtgcaatgctcacccctctacctgcaaagcaggttgtaagagaacacagaggtaaaagaaccagatgtagaggcctgtggaagtgaacacattctccaagggcaaagtgttgttactctttccagtcatggagcaaagaatctgtgtcctatccctggctgatggtctggaatgaaaaataagccaggatgggcccatacaccaccctacactgacacacaaggcctcacgggagtggacacggccaggatgagccattcagagaactaacacccttgcgtgttttgagcctgctctgtgggaggcaagtgtctttcaatgtcccagttgctcccagacatctgtctaatcctccaactgctactcatgggctctgtggagaaaggctggtagcttctgttattgtgccctgcatatagatgaggaaacagaggcctggggaaaaggagaaacacgctcacggtcacgcagctagtgcaggagaggacactctaaggaacttacttagagttcattttaattgatttaactttagccacatgcggttagtggctacatcttggacagtacagcctagagagaggtgaggaggcaggtcagaggctcttctgaaagatggtgcctcacacggtccaatcccaccccttccaggggctgatggaactcaggcctccccgactctgagggaggtcctgctctttcattaacccatgctgcctcctcacagcacccacccagccaacctgccacatctcacaaagcttggagtagaacgaggctgaacaattgttatacctggcttcccactgatctggaggagattctgaaataactcgtcccaaagcatccagcactgggggcggccgctgcaacagacaagttggtaaatgctttgcaacgggcagatcaatgacctgggcaccaggattgtgaggcaggaaactagccgcagctaccctgagccaccgtgagccccgagattcctgtctggagcagtagcggggtgagcagagacccacccaaccgcacacacccagactgcatcagggctgcacaggtcactcacgtagagcttttcctggtaaatctccatgagcctgcccataacctccgccgcctgccgctggtaacgtgccactgcttgggagagggcttcggcccctgcctgccttacagccgcctcatgatagatcacgtcgtcaatcagcaaggagcagaggtctggctgcaggtctaggcccatcattgaccagagcctgtgggagatccaaggcaggggctgcttagacaaagatctgcagcacttgccctgccagcccagcccttcttcccactggaggctgagcacactgggttcagttatttcctaaaggaagagaggatgcagcaggagaaagcgacatgctggctctctcacctctcagccagcttccggatctcctcctccttgtcaaacttgaccacccagagtctccgcagaaggttcaggccattcttctcatcagtatcaggtgctggcaataccatgtggagttccatcagcccctggaaggggtgggattggaccgtgtgaggcatcatctttcagaagagcctctgacctgcctcctcacctctctctaggttgtactgtccaagatgtagccactaaccgcatgtggctaaagttaaatcaattaaaattaactctaagtaagttccttagagtgtgaggtggtaaaatgtttttttaatgtgaaaattaaaacgttaaataaaccagacagataaaaacctcagaaaaagcgtattccttttgttcaaaaaaattttaaggaaaaatttactatattgtcatcattttcacattttaccaaaagccagtgaaaactctgtcacatatcaatagcaggaggctgtggatcagcaggtaggaaccactgtcttaccactacaaggggatgcttcagtttttggtccaaaagccatgaagaaaaaccaagtacatggcagtgggctaaagaattgaactcctcctgcaagttagctctgtccgtggaagtaccaaggtccacattccagtttaaaaattaagtgaagtgttccaaggtaaaggaaaaaatacagtgatacatcatgactgcttagtgttctgattctcagagagaccccaaccatgtgacttcttctctttgcctctaggcctcccaccagagtgagggacattctctcaaatgcccatcatgcaatttgcacttgcatagagtgacaagggacactgcagtggctctgagactgagcacacacccggagcacggtttcccgcacgctggcacacggggactgcaaggcacagagcagcacgtccacctcctcctgctctgcaaaggcacagccatcatcaccactgctgctggcacacagggtggtcagggtgtctgaagccagaacctaaggagaacatcaatccactggttcagtcagcaactcatttactactagggggccagagagggatatgcactgagaacacccacccctacagcactgcaagggctaagaccccagctccagtggcaggacccaagcaaaacccctcactagctaacaacagtcaggctggctctctaaagcagtctttctaccaaagtccaaaagtaagggctgaaaggaaactaggactccaccctttacactgggacttgaggtctgggtcacgaactgagtcacagcaacagccaactgaaaaccacatcacctgtaagcgaggcgagcccgtcccgatcacccaagtcagaagacgcagcatggccacgcgaggcagcaactccgggccattctaggagagaacggcaggtaagtcgagatgaggctgtggggaggtctgtaacccaggcggccaacggcagggcatcctctcacccacgggggaacattctggatcatacaaccggccccaccacagaaacctcattaagtttacaactaggtccacaggtgctaaccccagtcaaccatgatcctcaggaactaaaaactaaattctgaaacttgcttgaaattcacactatgaaatccagaaagaccgtaaatatatgaagagacactcaactttaaatgaaatgcaaaataaaatgagattatcattctttcactcatcactgacgatattaatactatctgaggttgcattaaggctttgagaaaagaaaactcttggtgagagtatagctcagaatatgccatataatctagtaattccatgtccaatgaacctgtcctaaagaaatgctcacactggttaagtaaggggcatatacatacaagagggcacatcacagtgctgttcaaaacaggaaaaagttagaaacaaccttaagaactcatcaacaggtaaagagttaagtaaaacatggtacatccatagcacagaatctcatgcagccaacaaagtcaatcaggtgaactgacatgtactggcatggcaggagagccagagtctacaatcacatgaaagaagcagtctgacccgtttttgccttaaaaaacccacaacactgtgtgaggctgctgttggtataaacatacactctctatttccccaccaggaactgttcatgagacaaaacgtgtccacaggccctgcctccctgatcccctttaaaccaagaggagagcagagcttccctgccaacctcgtccacccgcccgggtggggtgttgggggaggccctcagctgggcttggacagtgaggatctgaagaatctgggccatccactcctcctcctcctcactgtggtggggcatctccgtcagcaccatcttcagaaacgggaagactaaggagaaggctggcgcggacaagggcgcagcacctgtgagagcgagaagcagataagattctgcaggcagggcagggacccgggccactgctgcctatttctatcctcagggaaagtagggaacggatggaccagaggcccgttctgacacctggaagcacatggcacgaggacagagacagcagctggtagtccagttctaaaaccaattctgcttctactgccaaacactgcccagttccaggatgtgagagttaaaacagagatggggacaccagtgacaaaaagtaaaccctcaactgggctcactgcaattcacagactacgaaggttcaattcagaaatcctccatatggtccaatcccccaggctcaggaggccctgggtgacgctgtgccttgagcagcattcctggcaccagctcacaccgcctggtgcccctgatcccgtcccagcccttacctggctcccccttgcccaccctgctggtgatggtgtgggtgtgcagcagcatcaccgccctcttcacagccaccgacagctcttcctggcaccaggacttatccaggacacactctggcttcagcaggcgcagggtcacgtggctcaccaaagtgcctgtgttgaagaggagagacccagcaggagatgacacacagagatgtggaatccagcccaggctaaaacaggggacccagtgcctcatccttctgacttaaaaaaatatttctgcggctgggcgcggtggctgatgcctgtaatcccagcactttgggaggccgaggcgggcggatcatgaggtcaggagattgagaccatcctggctaacacggtgaaaccccatctctactaaaaatacaaaaaattagctgggcgtggtgacgggcgcctgtagtcccagctactcaggaggctcaagaaggagaatggcatgaacccgggaagcggagctggcagtgagccaagatggcgccactgcactccagcctgggtgacagagtaagactccgtctcaaaaaaaaaaaaaaaaatctttctgcttcgccaaaatgtccccagcctaatttctcacttgatctttgtgacagcctcagagggcaggtaggcagagagttgccctttggacatttaagaaatgagtacgctgacaggagacaagggccaccaaagagtcattcagccaagagtacagctctatctgtgcagcatctccacctctacgcaacaagcccagacagccaggtgacacttctggcaggtttcatatgcaccagctgacttttccactcagaacagttcccagattctagcctcacccgtgggaacatcaccgttaggccaggatagaagtctgctgaaggccactaaacaacccacagaagcaaggccaccagaactgccagccaccctacctggtgtttgtttctccagagctaagaggaagctaaaggtctcaagggcctctgctcactgctgtcatgtggctgttcaggagatctgggctgggctgagccaccaaaccatcctcactgccactgaacttctgacttcttagttttaaaactggtatacaaagatcgaacactgactagcatctaaaacctactcctcagagggagggcacagatgtgaagtgggagagaagaggaggcactacgtctctcctaagcatatccagcttgagtctccaaggctgcttccacaagaaaacaaaactcagcagctgaggtcaccacccacctccccacaagcactcaggggcacaccctgtccaagcactcaggggcacccctgggccatccctgcagccagcaaacaaggactaacccaaagccttgagcctagagggcatgacacaggcagccaaggacaagaaggggttcttgatcctgggagcagccaggggagacttcagcaagggcagaaaagagtcgaccaaaacagggatgtactgggtcaggccggacgggttcttggccaggatgatgtccagcagtccaagcgccgcctccagctccccatccagctgcaagcagagttgtccagaaggcaggtcagcagggccctgcttgtgacagcaagcagcaggaccaagctgcccagcactcttccggcttgagcatgtggcggaggtggccactcacctcctgcagccgcctccggacctgcgcctccctgtctagctgggcctgcagcatctccttctgcttgctggtcagctgcacctcctctttgatgcctttcttcttctttatctcctaaagaggatgggcaaaccaaccaatcccatctccagggaacagacctccctccccaacagaggaaggtgagcttgcttccacacaaacagcaccataccagctctaagtgtgagttgggcccctgaacccaccatgtgcacccccaacctcccacaaagtccacagccacctggtttctatagaatggagacagcaatagagaagtagttgttttactggattctctactgacaaaggctaagagggctttttatgttagagaaataaaggttcctcaatgtactcaaaagggtattctgacagccaaatggattcagaatcaaaactttagcctcctcctctccaaccccttcctacataagctctcccacaggataagctgaagcttagaaaaggcctgctatagtggcctgagacaacaagccacagaactcactcactcattcagcaaacatttagtgagcacctggattgtgccaggcactgttccagatggcaggaatatcgtaggaacaagataaagtccctgccctcacggagctcacaatctagcaggcgaagatagataataaacaagtcaacaagcacataaacaagatgcttttgggttatgataaatgttagtaaagaaacaaatatgatgtttagtaaaagggaggaagggtggggtctactttggatagggtggacaagctggccacctctctgagaagcacacatgtggactgagatgagaaagacaagaagaatcctgccttgtaaagacagagagaagagcaaacgctgagaaggaaagagtcctgtgtgctctgctcctgtcagaacctgctctgcccaaagctgaattcagcaatcaagtcatgattccccagaagtcccactgtaccaggcgctgtgcctgctatcaggagtctagatgggtcccagtcttcaaggaagtggagggacagacatggaatccagcaacaccacttagcagaggagacacgtgcactgtcgccagcacccagcagagaaagaaaccggttttgagttgtgggtggaagaagctatgaagcaagggtgaagggaaagtgtgccagtgcaccagacactggtcaggggcatcagaggagtgtgccatgggcctcaggatgttccaagtgaacagcatatgtgcagtgggaaaagccaccagcttgaggccaccaagctcagcagccaccttccgtaagtgcctccgtgtactcacctccttcagctccagctcgatgatctgctctttgaaggaataagctttgttctctcgcttcatgttggccttttttatgctgtcctgctgggcactgaaacaccagagtgggtcatcagccagcttgaaaagcaccgcaagtcctgtcagcctcccgccagccatgcaattccaactagctgttaagcactgtgcaccagcacagtgccggatactggacacacttaaatacccaggacctaagcaccgtgccggggacacaacaggcgcttagccaatgaatggataggctgttgcattcaactcacaggaggcactggctccattctacacacaagaaaactatgccttggggagcaaaggaaactgagcccataagtgaggtctcacctctgaatgatggatttgtcatacagctccccagcaggggtctgcataatggcaaactcctcccgcgtcaccaggcgcagtgcagggttctgcacggaggcagtgatggtgctgatgagctgtgggaggacccggtccggcgacaggacggaaagggagcccatggcattcatggaggactgccagacaaacgcagacatggtcagtgtgtgccaaggctggcactggcaagaggtccaccacacctgaatgcccctagcactggctccccttctttatgccactgccttgttactcctgggcaatgcccatcacagtggccggctggagtctgcgtctgctttcctcaccaagcagtgctcctctgtctgacacagcacctgacgtgaggtgatacactccttcccaattctcaatctccgtggttcaggtggagctgccctcactttttccagaggtaggcatgtgacccagaacagaaggatgggtgcagagatgagcatggcacccaagtcagattaatcagggtcaaagcgaccccaagccagtagacattattgaaatatgcaagctattcccctaggagctgatggcaagacaaagcctggaactctagcagctcttgtgctaccagaaagggaaagcctgagaatggagcccacatcgtggaaaacagagacaacagacaaagatggatgggacagagtaagagagacatcacctacaatgttccaagggcaacatgtgaacccctgtagccagtcatatccttggactttgcaggtaaatgaggcagtaagttcccttttgtgcttaaaccagtttacatttctgtcacgtgcaaccaagggtccaagcctacatttcatccatcttcacctgcttctttgaatcctctcttcctgtacactgtgatgagagggccccctcccggacctgaggccagaccagctcatgtgcccgtcacctggtttaggggactctgtgtggtcatcctgggaatgatctgatccaggtgcctggtgataaaggcttcaggatcgatcttcatcctggcaagaagtgctggccaaagtccagactgcacggcaactgaaggggaagggagctctttgaggccttctgcctggcctgctcttaccccatcccctaaagctctgggctctcccacacccaccgcagccacggacctaaggatgggtggtgggagatgatcagcatttcctgggccagttgttcagtgtcggtgacatcacccttgagccctggcacaccggagatgacacacagagcctcctgcaggacccgtggaggcacgtaggccttgcctgcctcagtcacctctccagcatcagtcaccaaagcctctaagggcagcacctgtgtggagacacatgagataatactgctaagagccctgtgcaggcttggaacacaggaaccaaatatgctacggacacagcggcccctcactcagttcttccctggggtccttgctggagtagaaatggatgcccagcttcctgcaatgggacccacaggctgtgagatgtgcctggaagaaggaagcacctgtggctttgcatctaaaaagcctgcaggggtaaagaaggcaccaggaactggtccaggagacccagcctgtggtggcaagtctgtcactggcccacattcctcaacaggctttgggagggagggaagcagtggaacacggcacaaagagcacagaaataacagccaggtctttgagggtctccctccgtcgggggagaccctgtgcaagtcatttgaactcctagaaccctggtcaattcatatgacacaagaataacaagccctatttgcctttgaaacgcattgttaaaaaaaaaatcaaaaggaaaaaatgggtagaaaatgctttaaaaagtacaaagtgctttaaaaacataaagtgttattcaattaatcaaggataaagggggagggcacggtggctcgtgcctgtaatcccaacactttgggaagccgaggtaggaggatcacttcagcctagaagttcgagatcagcctgggcgacatggcgagaccccatctctacaaaaaatcaaaaatcaaaaaattagcggccactgcaggtggtgtgcacctatagtcccagcaacttgggaggctgaggtggaaggatcgctcaagcttgggaagtagaggttgcagtgagcaaaacaaaacaaaacaaaacaaaaaccccaaaaaccctggaaaaaaggttaagctacatgtgaaaaaaagtctctgaaaaggaaaaggaatcctatgaaagatgttactggagcttgacggcagagcagaagatgctggcatcacacagattaagaaagaacacccagggagtggcccagccaaaaccccacatcgtaagcaggggcagctaagtggatccaagagccccagttctagagcccagatgccctcaccttgtgagaactgaggacagtcttcagctcctccaagagtccgtgcgccagcttaaagcccccaagagaggacagcagcttccgaactgtctgctgagcctgcctgcggacgtgccaggtgcggctcaggagcaccgccaccagagcccggtggtactgcctgcaagcacagggacagacaggtctgggggaaggccaagagcagggctttccacagccaacccttccacctgccacacaccctttctcgggttcctgccagcctttgcctcatttggcccaaaagaaaaggtaagccagcctcacgtactgaactttgttgccagtgagtctatgcgggtggtcaaggaaaagtctctctgtcagatgcaacacagtacacagggcttggagggaagaaaaggaatggaagtgtttttaaaatagttaagtgtacacatacataccaatacccagaaataactggaatgaactgaaaattaacaccaaaatataaatgtgattatcactcgaagtgaaattacagcttgtttttttttttttgcttatgcacacatgtattttggaatcagtaaagtatatactatttttatttattttatatataatatacacacatatacacatatatacacatatatatacatatacatatatacacatatatacacacacacacacacacacacacacacacacatatatatatatatatttttttttttgagagacagtcacgctctgtcgcccaggctggagtgcagtggcacgatctcagggcttactgcaagctccgcctcccaggttcacaccattctcctgcctcggcctctcgagtagctgggacgacaggcacccgctaatttttttatattttttagtagagactgggtttcaccatgttagccaggatggtctcgatctcctggcctcgtgatccacctgcctcagcctccctaagtgttgggattacaggcgtgagccactgcaccaggccaaattttgtatttttagtagagacggggtttcaccaggttggccaggttggacttgaactcctgaccacaggtgatccacctgcctcggtctcccaaagtgctaggattacaggcgtgagccaccgcacctagcctatttttactttttttgagacagagtctcgctatgttgcccaggctacagtgcagtggtgcagtcttggctcactacaccctccgcctcccaggttcaactaattctcctgcctcagcctcctgagtagctgggattacagaagcccaccagcaagcctggctaatttttttttttctatttttagtagagacgaggtttcaccatgttggccaggataattctgaactcctgacctcaagtgatcagtccacttcagcctctcaaggtgctaggattacaggcatgagccaccatgccaggcctatgtattttgttttcgttgttgttgttgttgttttgagacggagtcttgctctgtcacccaggctggaatacaatggtgcaatctcggcttactgcaacctccgcctcttgggttcaagagattctcctgcctcagcctcccgagtagctgggattacaggcacctgctaccacgcccagcttatttttgtatttttattagagacagggtttcaccatgttggccaggatagtctcgatctcgacctcatgatctgcccgcctcggcctcccaaagtgccccccccttttcgcggcggcccccaacaccctccccgtccgcgtttttcccaaaaacaccacgacatgtttagtctcgtgacccaaagcctcactatcctcccgcgtcccaggcaaccttcacccccacacccgcgcacccgtttcaacccccgtttctcctgcgcccaacntccgctacccttccgccaatcggggtctccaaatctacgcgtcaccctcaatcacatccagtgacaactgantccgctcgcttcgcctaggggtgtgtggccatcttgagccgaccgagttccgctgcgcctcgaatcccaagttcccgtcgggcctctcacgctaagacgcccggcgcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagattgagtgcgctgcagtagttcatactattgctaacacaaattaatattttacaaaaataggccaggcacattggctcacacctgtaatcccagcattttgggaggccgaggcgggcggatcacgaggtcaagagttctagaccagcctggccaacatggtgaaaccccgtctctactaagaatacaaaaattagccaggcatggtggtatgcctgtaatcccagctactggggaggctgaggcaggagaatcacttgaacccaggagtgggaggttgcagtgagctgagatcgcaccattgcagtccagcctgggtgacaagagggagactctgtctcaaaaaataaaaataaaataaataaataatttttaaaaagtacatttaaaaaaatgtcactactggacgggtgtggtggctagtgcctataatctcagcacttagggaagccaggcgggaggatcacttgagttcaggaaaacagcccatctctacaaaacattaaaaaattatccagttgtagaggtgccaacctgtagtcctaggtactggggatgttgaggaaggaagattgcttgagcccaggagttggaggctgcagtgagccatgatcacaccattacactccagcctgggtgacagagcaagtccttgttccaaaaaagaaagagaggagcgcagcactgccgcctggcccctccagcttcccggaccacggccaacctcgagcgcaccttcatcaccatcaggccggacagcatgcagtgcggcctggtgggcaagatcatcaagcgcttcgagcagaaggggttccgcctcgtggccatgaagttcctcccggcctctgaagaacacctgaagcagcactacattgacctgaaggaccgcccattcttccctgggctggtgaagtacatgaactcagggccggtcgtggccatggtctgggaggggctgaacgtcgtgaagacaggccgagtgatgcttggggagaccaatccagcagattctaagccaggcaccattcgtggggacttttgcattcaggttggcaggaacatcattcatggcagtgattcagtaaaaagtgctgaaaaagaaatcagcctacggtttaagcctgaagaactggttgactacaagtcttgtgctcatgactgggtctatgaataagaggtggacacagcagcagtctccttcagcacggtgtggtgtgtccctggacacagctcttcattctactgacttagaggcaacaggattgatcattcttttatagagcatatttgccaataaagcttttggaagctggaaaaaaaaaagagagaaagagagaaggggagggaggggaggaagggagggagggaggaaggaaggaaggaaggaaggaaggaaggaaggaaggaaggaaggaaggaaggggaaagttaaatagaaagaaagagacacagacgggccgcgagcggtagctcatgcctgtaatcccagcactttgggaggctgaggtgggcggatcacaagatcaggacatcaagaccatcgtggctaatacagtgaaaccccgtctctactaaaaatacggaaaagtagccgggcgtggtagcacgtgcctgtagtcccagccacccgggaggctgaagcaggagaatcagttgaacccgggaggcggaggttgcagtgagccgagatcgcgccactgcactccaggctgggcgatagagtgagactccatctcaaaaaaaaaaaaaaaaaagaaagaaagaaaagaaagaaaaaagaaagaaaagaaaggcagtacagacaataacaagaggggcctcaaccgctcaagagtgattcaactgagacttgaaaacatttcctggaaaagagctaaccctagcttgatgttttgcgaaagggaggctgtgggaagagcattctggaaggaggggttggtatttggaaaggtatgccgagggccccagaataggggtagtaagacggaaagtttccagcctcccctggcttatctcaaggaggagcctcatggctcagagggtgggtcctaccaggcccttcggccctctaggagaggctcctcgtgtccaggaaacccaaaacaggcaagggtttaaatctcagttctggctgggtgcagtggctcacgcatataatcccagtacttcccaggctgaggtgggtggatcacttgagctcaggaggtcgagaccagcctgggcaacatggcgaaaccctgtctgtaccaaaaaaacaaaaaattagccaggcgtggtggtgggtgcctgtggtcccagctactcgggaggctgaggtgggaggatcgcttgagctcgggaggcggaggttgcggtcagctgagcttccaccactgcactccagcctgggtgacacagtgagaccccatctaaaaaaaaaaaaaaaaatcccagttctatttgccaactgtgtagtctttggcatgatacctcatctttcacctttctgagcctcacttttctcttcagtaaaatgggagtgaggttctacaggtttaatacttagtagttgtgtggtttgagaccaagtgacttgaccactctgagcctcagttgccttctttgtaaatctggataataaaacatatatatgccttccatggctgttatgtggatttaacaacaaaaacaaaaatgcacaaaaagggctgagaaattgtagctattagcatcattgaagaaccgaggtgagactttagggctaagagggaaaaggacagatttggggatttatccagccacccaagtgctgaatcgagttgttgtgagttaataataaatattattattattgagtacacattgtttaacacgtgtaaagcatcacgttaagtctttaaaacctaatgggtgttttatgtcctatttacaggccaggaaactgaggcttattaagtaaagtcacctgctcccagctacagctacaaagtggaagagtcaggattcaaacccaagactgtctgactcatgaaggggagtgtcagggttgtgccacagcctttgggcaagtccaggattcccagccgacttggacacagtgccttgggaaggctctggttgcctctgaatttgggagaaggacacagtctgggttactgccctgcataaaaccttcatgacaccagaataaagcccagtggtttttcatgatctcattggaggacccagtatgtacctcctcaccaactctctctacttcctcccttctcagctccactcactgggaataattttcaggttgttcaataagccttgttgggccgggcgtggtggctcatgcctgtaatctcatcactttgggaggccaaggcgggtggatcacttgaggacaggagttcgagaccaggctggccaacatggcgaaaccccatctctactaaaaatacaaaagtcagccaggcgtggtggtgcatgactataatcccagctactcaggaggctgaggcaggagaatcacttgaacccaggaggcaaaggttgcagtaagctgagatcgtgccactgtactccagcctgggagacagagcaagactccacctaaaaaaaaaaaaaaattggccacgatggccaggtatggtggctcccgcctgtaatcccagcactctgggaggccaaagcaggtggatgacctgagatcgggagttcgagaccagcctgaacatggagaaaccccatctctactaaaaatacaaaattagccaggtgtggtggcgcatgcctgtaatcccagctactcaggaagctgaggcaggagaatcgcttgaacctgggagacggaggttgcggtgagctgagattgtgccattgcacttcacctggacaacaagagtgaaactctgtctcaaaaagtaataataataaataatacaaaaattagctgggcatggtgatgcatgcctgtagtctcaggtatttgggaggctaaggcacgggaattacttgaacccgggaggcggaggctgcagtgagtcgagattacaccactgtactccagcctgggcaacagagagagagactctatctcaaaaaaagagacaaaaacaaacaaacaaacaaaaacaccgggcacagtggctcacgcctctaatcccagcactttgggatgttgaggtgggtggatcacttgaggtcaggagttcgaggccagcctggccaatatggtgaaaccccatctctactaaactacaaaagtagctgggcgtggtagcccacgcctataatcccagctacttgggaggctgaggcaggagaattgcttgagcctgagaggtggaggttgcagtgagccgagatcgtgccattggactccagcctgggtgacagactgaaactccagctcaaaaaaaaaaaagaaagaaagaaagaaagaaaggaaaaaaaggctgggctcacgcctgtaatcccagcactttgggaggccaaggcaggcggatcacctgaggtcaggaatccgagaccagcctggtcaacatggtggaaacccatctctactaaaaatataaaaaattagccaggtgtggtgacgagcacctgtgatcccagctactcgggaggctgaggccagagaatcgcccgaacccgggaggtggaggttgcagtgagccgagattgcaccactgcactccagcctgggcaacagagcaagactctatctcaacaacaacaaccacaacagaaaggccacatattcctgactccaggcccctgccagtgctgttaccactgctaaaatccatcctgccctctttgtcccggttaatgcctctcctccttcagttcacagctcagctacccccttcttcaggaagccctccttgacaactacccaggcttagctagtcagtcccatgaccaccccatccccactaaagtacttaactctgaaacaggcaccaaaggaagcactcttcccatatctcacttaatactcaccaaatctctggccggtcgtggtggctcatgcctgtaatcccagcactttgggaggctgaggcaggtggatcaggaggtcagatcaagaccatcctggctaacacggtgaaaccccgtctctactaaaaatccaaaaaattagccgggtgtggtggtgggtgcctgtagtcccagctactcgggaggctgaggcacgagaatcacttgaacccaggaggtggaggttacagtgagccgagatcgcgccactgcactccagcctgggcagcagagcgagactccatctcaaaaacaaacaaacaaaagatactcaccgaacctctctggtagtgggtctcatctttgcagaaacattggaagctttaacacacattttttttgccctgacccattcctcagaaattctgatttaatgggtctggaatgcagccggggcacagggatttttgtaaagctcctcaggtggttttcttgcacacacagtcagggtggagacctaccgaactctgagatagaatcaggactctttttgtttttacagccagggacactgaagcatgagagggtagatgagtggcttaccgtcatgcaagtagagaataacgaagcaaggtcttgaacccaagtctggcttcaaagcttcatgggggaaaaaaaaatcagttggcctcagttaatttcccagcaatggagaaactgtagagcttagagccagctctgttttgagacagacactgagggccccttgggcatgggatatttttaacctagaagctggtgattcttgctaacattctgcagtgccttgaacactgagcagattgtttaggggtctgtgggctctttccctgctgagatagcccttgtagtagggcttttccatcctctggagccagtgggtgggagggtgggtgggggttggcctcatggcgggtggggtggctaatgtatccaaggatattacctacatggtggatagggagaaggtcagttttggatgagcccagatttctcctccctccgagacattttatctcacccaacacagccccttctcccttctctccacctggaaaacagctggaagacaaacctaggttgaagctggattgtacactcagcgcctcaggaaaatggatgcacgttcaccctcccgcttcttcccctccctgacccgtgacagccccgtgaaagctgcagaacacttacaaatgtatgtatcaggccaggcgcggtggctcacgcctgcaatcccagcattttgggaggccgaggctagtggatcacgaggtcaggagttcaagaccagcctggcaaatgtggcaaaactccatctctactaaaaatacaaaaattagctgggcgtggtggcacatgcctgtaatcccagctattcaggaggctgaggcaggagaatcgcttgaacccaggaggcagaggttgcagtgagctgagatcgcaccattacactccagcctgggcaacagagcaagactccgtctcaaaaaaaaaaaaatatgtatatgtcaaaccttctccagctgtcctcatatgtgatttgttgggcaaatacattggtatagtcttaggggtgccagtatagggatatcccttaaaacgcaaaataagcatggcctttgaggaggcaattctacctatagaaattttccccacgcccagattacctgaggcgaggagatcgagaccagcctgaccaatatggtgaaaccctgtctctactaaagatacaaaattagtcaggcgtggtggcaggtgcctgtagtcccagctattcgggaggctgaggcaggagaatcgcttgaacccgggtggcggaggttgccatcagccgagatcatgccgctgtactccagcctgagcaacaagagcaaaacttcgtctcaaaaaaaaagaaagaaagaaagaaagagatttctccccagaaataccccaagagtaaggaaagatgacgtagcatcaagcgtattcattatagcattgcttatgggaaaaactggaaacaactcacgtgtccaataatgggggattggttaaccttggtaggtcacatccatatgggaaaaggggaattaggtgctggcatggaaaatgtgtccacaatgtattgtacagcagaaagaaaaaggaagtaatagaactatatgtagagtataatccaatttttttttttttttttgagatggagtctcgctctgtcgcccaggctggagtacagtggcacgatcttgtctcactgcaagctccgccacccaggttcatgccattctcctccctcagcctcccaagtagctgggactacaggcgcccgccaccacgcctggctaattttttttgtatttttagtagagacagggtttcaccgtgttagccaggatggtctcgatctcctgacctcatgatccacctgcctcggcctcccaaagtgctgggattacaggtgtgagccactgcgcccggccaagtataatccaatttttgttaataattatgttgacctataagtagaacattttggaggaataatctcacgtacctgtgactatctccttggagtcaaggtgagattattgtgagagcctttgtcactgtttcatgtgtatatttgaattttatatacaaacatgcagtaatttttgtattcagaaaaaagaatttagatttgaaacagaaaacaatgatacgtaaaaatcacatgaagccctctctcccctccttgcttgcagaataataacaaaaaaatggatccactttaatatggttaattttatgttatgtaaattttacctcaatttttttgtttggattttccttgtgggggattttgagatagggtctcactctgtcacctgggctggagtgcggtggcgatatcacggttcactgcagcctcgacctcctaggctcaagcaaccctcctgcctcagcctcctgagtagctaggattacaggcaaacactaattttttaatttttccaggcacgatggctcatgcctgtaatctcagcacattgggaggccaaggcaggtgggtggcttgagcccaggagtttgagactagcttgagcaatatgcaaaacctccacccctacaaaaaataaaataaaattagctgagtgtggtggcacgtgcctatagttccatctactcaggaggctgaggtgagaggatcacttgagcctgggaagtggagattgcagtgagctgatattgcatgactgcactccagctggggtgacggggtgagaccctgctctctccaaaaaacaaaaacaaaaagaacaacaacaaaaacattctcatattttttggtagagacaagtgtctcatgatgttgcccaagctggtcttgaactcttggactcaagagatcctcctgccttggcctcccaaagtgctgggattacaggcgtgagccaccaggtccggccaagaacccatctctaataaaaaatctgcaataaacagtaagtcgagttttcttctagcgtgtgatgatgctaattatacaatgctacatttcttcccctgctgttcaagctgtggaccctggaccagcacctgcgaacttttagaaatgcagaatcttagtctccatcccaggcctcctgaattggaatctctaggaatggggattcgatctgtgtcttaacaaattctcaaggttatttttatgcacgccaaaatttaagaaattgttgtagtttgattttgaaaggacatgcactcttcttttcacgttatttctaagttttggataacttttttttttttctttttgagacggagtctcactctgtcgcccaggctggagggcaatggcgcggtcttggctcactgcaatctccgcctcccgggttcaagcgactcccctgcctcagcctcccgagtagctgggattacaggcgcccacgaccatggctggctaattttttttttttttttttttttttgtatttttagtagagatagggtttcaccatgttggccaggctggtcttgaactcctgacctcgtgatctgcccgccctggcctcccaaagtgctgggatgacaggcgtgggccaccgctcccggcttcttcttctttcttttttctttttttttgagacagagtctcactgtcacccaggctggagtgcagtggcgcaatttcagctcactgctaccttcgcctccacgtctccagtctgtgaggtccttgaactggggactgagtttaatttgccactggagctgtttttcccagcaccgtctttgaccttgtaggtactgttgccaccctttttgccacctctttttgctacaggctggaggagtcttttatgggcggtgtcctaagcaggtccagctggatccgccatgcccagagttgtgactcctgaggacctctgtccatggacagcccaggtcttcgtaaaaaggtaagactggaagaggctggtgtagtgggaacaagtaccacactaggggcaagagaacctgataagccccagctctgccgaggactccacagtaggacctgagcaatcttctgtgcctttttccctcttggtcgctttaaaaggaagaaaacgcggtggttcacacctgtaatcccagcacttcggaaggccgaggtaggcggatcacctgaggtcaggagtttgaaaccagcctggccaagaaggcgaaaccccgtctccactaaaaatacaaaaatgagccgggcgtgatgttgggctcccgtaatcccagctactccggaggctgagacagagaatcgcttgaacccggaatgtggaggttgcagtcagccgagatcgcgccactgtaccccagcctgggaaacagcgaaaactccgtctcaaaaaaaaaaaaaaaaaaaaaaaggaagactttggatgtattaatgtgttagttttagagttccccttccctttaagggaatctgtgaccttcagtgacaaaggaagtggagtagctcactcgctggctgcatttggataaaaaagattaacgataactgtcttagttagaacccagttcccaacatagtgtcatacattttggaaaacaactcacagtacccgcacagaaccccggacattcaatcacggaatactcctgaacaacaaccaaaaaactatcataggaacagctcataacttatcaaaccaaacataagacacaacctgctataatacaacttcctaaaacccttttctttagacttttaaaaattcagtctccgtagagactgtcaaaaattgccaatgccgactatatttcaagtcgtcatggcggggtattgggaaaagttttcaattagcaataatcgcgcctcggataaacctcattggctacgatactgccactgcgcaaagctggaaaggttctgttcgcgccccgctcccccacggatgatgactaccattacattgagggtgagtgcctgcccgtgtgtccgtgtatacgacgtgttcccactccaccagccgtatttaaggcccatctgcataggaggtttcttgttgttggaacatcccgtgtcaaacattcaggttttgaaaaccataagaatattcgcttgggacgctggggaatcttatgcaaatcaacgtgacgtcacagagatgactcggttgagacttgaattttgagcgaggagagtgagcagtgggaaagcgagcctggagggcgcagacggacgactagctgtgctcgagggtgcggaaacagcagggtggggggagttgggaataattttaggacgtcactgtgacaaaatctgaatggagaacacggctgggcgcggtggctcacgcctgtaatcccagcactctgggaggccgaggcgggtggatcacgaggtcaggagttcaagaccagcctggacaagatggtgaaacggggtcgctactaaaaatacaaaaaaatcagcggggtgcggtgggcaggcgcctgtaatcccagctagtcgggaggctgaggcacgagaatcgcttgaacccgggcggcagtttgcagcgagccgagatcgcgccagtgcactccagcctgagcgacagacttcgtctcaaaaagaaaacaacagtgcgagagaaagaaaacaggacagccagctggcaagaaaagtcaacaccgccctgcatttaccttaaaagtagagatcacaaaatcagcaactccaactttcacaaacggaaatcgctaaacaggggttcggcaaagtttgcagcgagccgagatcacgccagtgcactccagcctgagcgacagacttcgtctcaaaaagaaaacagtgcgagaaagaaaacaggacagccaactggcaagaaaagtcaacaccgccctgcttttaccttaaaagtagagatcacaaaatcagcaactccaactttcataaacgcaaatcactaaaacaggtaaacttgcaggtgctctcgcgaatcagctggtaagacacttccccatctctcatttagagagtttgcgaacaagtactcttcaacctcccaaaaccaagcacccccacacacacaaaaaaagcctctgttgttcaactgcaagaaaattcagtctccgtagagactgtcaaaaattgccagtgccgactatattgcaagtcgtcacggcggggtattgggaaaagttttcaattagcaataatcgcgcctcggatagacctcattggctacgatactgccactgcgcaaagctaatttgttacgccccctgctcatcactcccaataaaccagcttcctatttcgcaaaggtgagtttagggcctatggaaaaatcttcacttattgcttgcttgaaaattatacaatcatagaaagatgtttgtgacctgcgtaggtggtttctgcatatcgttgctgatttcacttagctaggtttttgttgatatgaagcaaagcactatgggaggaacatgctaatagacttaattcagagactgcgaagggcttttgagagaaaagggatcaaaatcagggttctgttcacttggctccagattcagtgtaacagacttctccaaagacgattattgttttgtcttttttctttttcaaacttttttttaaattatgccaaagtatacataaaatttaccattttaaccttaagtgtaaattcactggcatagaatatgttcacattgttgtgtaaccatcatcactacttacctccagaactttatctttcatgcccaagggtggaaactgagactctgtacccattaaacccttactccctgttcccttctcctccagcccccgtggcaacctcttttctactttctatctctatgactttgtgagtactttatatatatataaatggaatcatacaatatttgtccttgaggtcagtcttatttcattcagaataatgtttttaaggttcatccatgttgtagtatatatcaggaattcattaattttatggctgaataatatttcactgtatgagatgttatctttttttttttttgagatggagtttttgctcttgttgcccaggctggagtgcagtggcatgatctcggctcattgcaaccactgcctcccggattcaagcgattctcctgcctccatctctcaagtagctgggattacagatgcatgccaccactctttgtatttttagtagagacaggatttcaccatgttggccaggctggtctcaaactcctgacctcacgtgatctgcctgcctcggcctcccaaagtgctggaattacaggtgtgagccacttcacccagcccatttattcttgtctatttttttttttgagacgaagttttgcttttgttgcccaggctggagcgcaatggcgagatcaacctccgcctcccaggttcaagcgattctcctgcctcagcctcccgaggagctgggattatttttagtagacacggggtttcaccatgttggtcaggctggtcttgaactcctggcctcaggtgatccacccgccttggtttcccaaagtgctgggattacagccgtgagccaccgcgcccggtcccattcattcttttttgagacagcttttggctctgtcgcccaggctggaatgcagtggcgcgatctcagctcacttcaacctctgcttccaggcctcaagtgatcctcctcccacttcagctggatactttctgtatttttcgtacagacaggatctcaccatgttgcccaggctggtctcgaactcctgggcccaagtgatcctcccatcttggcctcccaaagtgctgggactataggcatgagctgccgcccggaccaactgtttatcctttttttttttttttttgagggggagtctcgctctgttgcccaagctggagtacatagactcaatctcagcccatgcaacctccgcctctggggttcaagcagttctcctgtctcagcctcccgagtaactaactgggattacaggtgcgtgccaccaatcctggctaatttttgtatttttagtagagacagggtttcaccatgttggccaggctggtctcaagctcctgacctcaagtgatcctcctgcctcagcctcccaaagtgctgagccacggcgcccggcctatccatttatttttagatggtcattgctggtttccaccttttgtctatgggaataatgctgctattggtgtgcaaatatcagcttaagtttctgttttccttttttttttttttgagactgagtttcgctcttgttgcgcagtctggactgcaaaggcgcaatctcagctcaccacaacctctgcctcctgggttcaggtgattctcctgcctcagcctcccaagtagctgggatgacaggtatgcgccaccatgcctggctaattttatatatatatatgtataaatatatatatagataattttttttttttttttttttttagtagagacggggtttctccatgttggtcaggctggtcttgaactcctgacctcaagtgatctgcctgcctcggcctcccaaagggccgggacaacagggtgtgagccaccgcgcctggcccctgtnnttctattctttggtgtacatacctagaagtanaattgctggatcatatgttaattcaaaagggtttggacaccttaattcaaaaagaggctcaaataataaggatttatttccacagaatgttcacagtttctaaaatttgaagcaactttcaccctcactgcctgttttccttcaggatgtagaaagctattagaaacctacatctggtctaggtgtggtggctcgagcgtgtaatcccaacgctttgggaggccaaggcaggtggatcacctgaggtcaggagttcaagatcagcctggtaacatggcgacatccctgtaaatacaaaatacaaaaatacaaaattacaaaaatacaaaatacaaaaattaacggggcgtggtggcgcttgcctgtaatcccagctactaggggggctgaggcaggaggatcgcttgaacctgggaggtagaggttgccatgagctgagatcatgccactgtaatccagcctgggtgacaaagcgagactccgtctcaaaaaaaaaaaaaaaaaaaaaaaaaaagaaagtaacatttcccccaacattttatcataaaaaattgtaaacacgaaaagttcaaagaattcctcagtgaacattcatgtactcatcatccatatacaaaaatgacattttttttttttgagacggagtctcgctctgtcgcccaggctggagtgcagtggcgcaatctcggctcactgcgagctccgccttccgggttcacgccattctcctgcctcagcctcccgagtagctgggactacaggcgcccgccaccacggccggctaattttttctatttttagtagagatggggtttcaccgtgttagccaggatggtcaaaaacgacattttaaaaggcctgtttgatgctgatgtgttatgtgattatttctaacttgttttgtgtttttttttttgttttttttttttttgagacatgttctcagtcgcttaggttggagcgcaggggtgcaatcacggctcagtgcagcctaaatctcctgggctcaagcgatcttcccacctcagcctcccaggtagctgggactacaggcacacaccaccatgcccagctaatttttctgtattttttgtagatacagggtttcaccatgttgcccatgctggtctccagctcctgggctcaagtgatccgcccgcctcggcctccccaaggggagggattacaggcatgagccactgcagcagatttcttatttaattcacagcctggataaaaagaaaagactagcaatgtggtgaatttagattcttttactttgatcatccagtcaaggatttagtcattaattctggatggggtggagttgtgagaaaaacactaggccaggcacggtggctcacgcctgtaatcccagcactttgggaggccgaggcgggtggatcacaaggtcaggagttcaagaccagcctggccaagatggtgaaacctcgtctctactaaaaatacaaaaattagctgggcatggtggcgggcgcctataatcccagctacttgggaggctgacataggagaatcacttgaacccggtaggcggaggttgcagtgagcctagattgcgccactgcactccagcctgggcgatagagcgagactccgtctcaaaataaataaatacatacatacatacatacatacatacataaaataaaataaataaataatggggcttggtgtggtggctcacgcctgtaatcaaaaaaaaaaaaaaaaaaaaaaaaagagagagagaaaaagactaaagccctaatcctaatcccatgagggtatcaaaggaacttcctagcccttgagaattctagaatgggtggcccattacactctctcagtagctatcaagtgaaattgtgtgtttcaccagctgacttggatgacaaaaaaaaaaagaaatagaaacaaagcatacaaaaattaaaaaagaaagaaagaaagaaagaaaaaacaaaacaaaacaaaaaagacttggatgacttcaccgtccagggatgattttccagcactatgagaaaaattgaaaactcagctaacttttcctcagagcatgagatttttgggggcctagaagcacaatagaattcccaaccaatctctattagtgatgatcattccacttggagaactgaaaaaataacctaggtttgaactttttcatagtaaaattggtgaatggggaaggagaatgtcactgttctcacatttttaaaagttatgatcaaatacccagaaaatgtgtgcagaaaatgtgctggattataatttttaaattttgggggggattataatttttttgacaacgaaaatttcagtctagcttctggtgctttctttcagcagatgtggtcaggttaactaatgcagaaagggctgtcagtggctggagtgcagtcacaggatcatggctcactgcagccttgaaaaaaaaagggggtggccgggcgcagtggctcacacctgtaatcccagatactggggaggctgaggcaggagaatcacttgaacccgggaggcggaggttgcggtgagccaagatggcgccattgcactccagcctggtcaacaagagtgaaactccatctcaaaaaaaaaaaaaaaaaaaaaaaaaaggagggggctgtcatatgagtttccccgcctagtagatcctacagctactgactttcgctgttgctggagctactactccctgtgtactaagttaaaaagaatcggccaggcgcagtagctcacgcccgtaatcacaacactttggaaagcctagagcccaggagttcgagaccagcctgggcaacatggtgaaaccccgtctctacaaaaaaatacaaaaattagctgggcttggtggcccacctgtagtcccagctactcaggaggctgaggtgggaggatggtttgagtccaagaggttgaggctgtagtgcgcagtgatcgtgcctctgaactcccgcctgggtgaaagagtgagaccatgtccccaaaataaaaaaataagcttttaaataattaaagtggcagggcgcagtggctcatgcctgtaattccagcactttgggaggctgaggcgggcggatcgcgaggtcaggagttcgagaccatgctgacaagcatggtgaaaccccgtctctactaaaaatacaaaaattagccgggcatggtggcgggcacccgtaatcccagctactcgggaggctgaggcaggagaatcacttgaacccgggaggcggaggttgcagtgatctgagatcgtgccactgcactccagcctgggcacagagcaatattccgtctcaaaaaataaataaataaataaataaataaataaataaatagccgggcgcggtggctcacgcctgtaatcccagtactttgggaggctgaggcgggcggatcacgaggtcaagagatagagaccatcctggctaacacggtgaaaccccgtctctactaaaaaaaaaatacaaaaaattagccgggtgtggtggcgggcgcctgtagtccggaggctgaggcaggagaatcgcgtgaacccgggaggcggagcttgtagtgggccgagatctctccactacactccagcctgggcgacagagcgagactccgtctcaaaaataaataaataaataaataaatacaataataataataataaaagtggcggggtgcagtggctcactcctgtaatcctagcattttaggagactgaggcaggtgggtcacctgaggtcacgagttcaaaaccagcctggccaacatgacgaaaccccatctctactaaaaatacaaaaattagccgggcgcagtggcgagcgcctgtaatcctagctactccggaggccgaggcagcagaatcacttcagccgggaaggcagaggcttcagtgagtgaagatcgcgccactgcactccagcctgggcaacagagctagactctctcaaaaaaaaaaaaaaaaaattaaagttagttttacttacaagtcttactgaggattacagaccgagggctatagtgtgggagcagttccatcagactggtccaacacagaatttcagccactcatatacaagtggtgagtgtacggcgcctgcaaaatcacattaaacttgcttcaaagttacattaaagcacaatcatatcaaagtttgggtgcaagagtatatctggttatggattacagaggtatcatcactaaccccatcagacattatcttgtgcaggaaaaggcaatgaccagagtcatttatcttttaatgaatatagtgacttggaagagacatggagggctgtgtgctctattctgttttgtcttcaaagcatctttctggagagctgtatgttgtcacagagtcaggggcttcatgaaacgatgctgccaagtcgaaataagcaggcccggcatggtggctcacacctgtaatcccagcactttgggaggccaaagcaagagctttccttgagttcaggagtttgagaccagcctgagcaacatagtgagaccgtgtctcgacaaaaataaaaaataacaaaatttagctgggcgtggtggtggatgcctgtgatctcagctactcgagaggatgaggttggaggatcccttgggcctgggaagtagaaactgcagtgagctgtgatgtcacaactgcactccagcctgggtgacagaacgagaccctgtctcaaaaaaaagaaaaaaaaaaagcagaaatgggcaaactactaaatggtcattttgccaatattacctccaaagatacaatgatagaaccaaaaacctaaaaactctttctcaagcttccacattacttctctgcacttcagttcatctttatttattattattattttttgaagagatgggatctcactttgtcacccaggctgaagtgcagtcgcacaattatggctcactgcagcctcgatctcctgggctcaaagtgatcctcccacctgagcctcttgagtagctgggactacaggcacacaccaccacaccccgctaattttgtttattttttgtagtgagtgggtctcactatgttgcccaagctggtcttgaacttttgggctcaagtgatcctcctgccttggcctcccaaagtgttggtattacaggtgggaaccactgcactcagcccaattcatcttaaaatgggggaagggagtccttaggtggtcttcaaggtccctgctggccgcccacctttatgtccaaagacacttatacatttattgatttaggtgatgctgcagagcggcagttctggttgtctacacattaggaacaattaggaaatttgtagatcagaatccctgggagtgagacgcaggccttgtttgattaacttaataaaaaaaatatgataaataaaattggagaagccaagcaggttaagtacattagtccaggtataatatatttggcttcatattaactgtaaaaacatcacttttggctgggcacagtggcttacgcctgtaatcccagtactttgggaggctagggtgggcagatcacgaggtcaggagatcaagaccatcctggctaacatggtgaaaccttgtctctactaaaaataaaaaaattaaccgggcgtagtggcatgcgcccataatccctgctactcaggaggctgaggcaggagaattgcttgaacccgggaggcggaggttgcagtgagccgaaatggcaccattgcactccagcctgggcaacagagcgagactccgtctcaaaaacaaacaaacaaacaacaacaacaacaacaaactatcactttttcagatatgtataaacacatttcttcacaagttcaaggtattttaccaatagcaaataacttgatactgtcgttgtgaatgaaaaggatcacaaactctgatgtttagaatgagtcaaatctaggccgggaacagtggctcaggcctgtaatcccagcattttggggggccgaggttggcggatcacctgaggtcgggagttcgagaccagcctggccaacatggtgaaactctgtctctactaaaaatacaaaaactttaaaaaaaagtcaaatctagatccatgattaatgacgtgctcatttcacattgcatgtttgtatcaaaacatctcatgtgggtaaagcatagacaggcacagagaaaagaaaaaaagacaaaaaataagagaaaagatggccgggcgcagtggctcacgcctataatcccagcactttgggaggtcaaggcgtgcggatcacctgaggttaggagttcaagacgagcctggccaacatggcgaaacccccgtctctactaaaaatacaaaaataatcccagctactcgggaggctgaggcaggagaatcggttgaacccgggagagggaggttgcagtgagccgagatcgtgccactgcactccagactggagttttttcaaaaaaaaaaaaaacaacaactccgtcttaaaaaaaaaaaagaaaaaagaaaaaaaatcttatgtacactataaatatatacacctactaagtgcccacagaaattgaaaacaaagaaaaaaatccatgattaaaagcttttatattaacgggggaacctctgaccagaaagagccgacagggggcgttcctggatgatctggggctgtcaattgcgagacgcggaggattgtgggacttgtggtttttctcgcatcatttaagctttctggactacatgtcccaaaatgcaaatgcaatcagacggtcccactgtggggtgtgaagtgtccgtagagctgtgagaggtaagtgtgttctgtgtgtgctgcggatttctagaagttgtggatttcttgtgagggattctatttctcctctttgccctcggtgggacctggaagagagtagttgttccactgatgcacgttttcagcgggggtttcccctgaccctttggtctcgggaaaccggactgtgtgtttgttcagctgttcacgttttgctgtggaatgtcaaggagaaagcggggtcctgatctcagatctggaaagccaaacataaaataatgtttacatacggggtgcatgtcactagaggatttatgcattgcattgtgtcaaataatatgtcaaagttttttctttttctttttctttttttttttgatacggagtcttgcttcttcgcccaggctggagtgcaacggcgcgatctcggctcactgcaacctccgcctcccgggtagggggccagagactgatttgcactgagaacacccagccctacaggactgcaggggctaagaccgcagctccagtggcaggacgcaagcaaaacccctcactagctaacaacagtcaggctgcctctctaaagcagcctttctaccacagtccaaaagtacggcctgaacggaaactaggactccacccctctacactggagacttgaggccaggctccacgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcactctgggaggccaaagcaggcaggtcacctgaagtcaggagttcgagaccagcctggccaacatagtaaaaccccgtctgtactaaaaatacaaaaattagccaggtgtggtggtgtgcacctgtagtcccagctactcaaagaggctgaggcaggagaattgcttgaacccgggaggtggaggttgcaatgagcagagattgcaccactgcactccagcctgggcaacagagtgagactgtctcaaaaaaaaaaaaaaaaaaaaatgcctgatccggtggctcacgcatgtaatcccagcactttgggaggccaaggtgggcggatcatgaggtcaggagaccaagaccagcctggctaacactgtgaaaccccatctcttctaaaaatacaaaaaattagccaggcgtggcggcatgcacctgtagtcccagctactcaggaggctgaggcaggagaatggcgtgaacccgggaggcggagcttgcagtgagctgagatcgcgccactgcactccagcctgggcgacagagcgagactctgtctcaaaaaaaaaaaaaaaaaattactaaggccaggcacgatggctcatgtctgtaacaccaacacttttggaggctgaggcaggagaattgcttaagcccaggagttcaaggtcagcctgggcaacatggtgaaacccccgtctcttaaaaaaaaatacaaaaattagccagatgtggtggtgtgcacctgtagtcccagctactcaggaagctgaggtgggaggaccacctgagaccagggaggtcgaggctgcagtgagccatgactgtgtcactgcactccagcctgggcaacagagtgagatcctgtctcaacaacaacaacaacaacaaattactatggagttataaaaagaggccgggcatggtggctcatgcctgtaatcccagcactttgggaggccgaggcaggtggatcacctgaggtcgggagttcgagaccagcctgaccaacatggagaaaccccatctctactaagaaaaaaaaaaacaaaaacaaaattagcctggtggtagtggcacatgcctgtaatcccagctactcaggaggctgaggcaagagaaccgcttgaacccagggggagaggttgcggtgggctgagatcatgccactgcactccagcctgagcaataagaacgaaactccatctcaaaaaaaaaaaaaaaaaaaagaatgatgaagttcattatatactgatatggactcatttccaggtctagaaagcacagtacatacggcaggcacactaccatttgtgtaaaaaaggtacagaacaaacatatacaggtatttacttgcatatatataaaatatcaaggctacagaagaagctaataaaattggttatctatagccgaggaactgggtagccagagatcaaagcaggggtataattttcaatgtagaccctcttgtatctatttttgaattacattagtctatttccttttcaaaatttagctaaaaatttttctaaaaccaggaaatgactaacagttgtagctcattaatgggatgttgcgatttatgagtcaaacgactcttcaaatcaccaattagtggcagacactcctaaggcaacgtagaatattaaacacatatttaaaattcaactgttccttttctgccaggatagaaaccagtagtttttgtgtctcttggtgggggagtagagcctgccagactccacaagagcttctcagctgccttaacacaagaaaacctccgagacagcaccaattacccaatcagctataattacagctcatgtcgtagctccacagccattactgctctgtctccacacatctcccaagtcccatttccctaaccttatgttccctacaggaatgaatttattcccacaacagctaagctgttggccagatcactctggcccaggtttttgcagacctgactggttggtcaagaaagggtcctctctgaagattttccaaagagactttgcctcaatcccgagttcaactaagcatggagtaacttaccatcctctgaagccatgaccaggaatttctcagaagtgaaaacctgctttttctcatccacaatcaactgccagaaactgctcagtttggcctctgcaagaaacaaaaggttaccccacgacgcagctcaccacatcccccagagctgatctactccatcctgaagctgctggggtgggctttgctgacaaaccctcctctgcagcaggaggctcagtgctcttccatttggggaactgacctcagtccttctggtatcacctcctgtacgaaactcttcggtggctctctgctgcctacaggatcctaggtgaactgcttctcatccggaattcccatccaccccaggcgccaagctggaatacctgaggtttacagactctggctttccctgcccttccctgactggggctgtttggactcacactgggccatcccttcaggataatgaaatccttcagaggcttcagggtaccagttcaaatgcttcctccatgaagcccttcccaatacccacccccccaactaaaagcaatctctccttcaaaactgctctaatgccgcattttgtcttaagctacggatatatttctgtatttcctcgcgcctactgtgaagtaagcaccctgaaatttgctgaagaaggtcatgttcatcttagcattcccccaggtagcccagtgccttgcatggccacagtgagcacacgatattacatgaggagagctgagctccattcctaaccaaaggagttaagttcaggtgtgtcccagtgcagagattgggagatgaaataaagaaagcctggccgggcgcagtggctcacgcctgtaatcccagcacattgggaggctgaggtgggtggatcacaaggtgaggagattgagaccatcctggctaacacgatgaaaccctgtctctactaaaaatataaaaaattagccgcgcgtggcggcgtagcgcctgtagtcccagccactcggaaggctgaggcaggaggcggagcttgcagtgagtcgagatcgcgccactgcactccagcctgggcgacagagcgaaactccgtctcaaaaaaaaaaaaaaaaaaagaaaaaaaaaaaagaaaagaaagcctgaaatacgatgtagccacaaaaaataatgagaaagctctttctgatgtactgatttggaatcatttcgaagatatattatatatagtatatatattatatattataagtaatatggcatatagcgtatgttccccagcatgttcaattacataacacactatgtctggacataaaattggtaatactgttttttctttcttagacaaagtctcactgtgccacccaggctggagtgcagtggagcaatcccagctcactgcaacctacgcctcctgggttcaagcgattctcctgcctcagcctcccgagtagctgagattacaggcatgcgccaccacacccagctaatttttgtacttttagtaaagacggggtttcaccatgttggccagaatggtctcgaaatcttgacttcgtgatccgcctgcctcggcctcccaaagtgcaaaattggtaacaccgtttacagagggaaacttaacggctacgggaaaagacagggctaaggggaagcttctcatgttatatccttttgaattttgtactgtatgaatgtataaccaactgaaacaaacagtcccaatactaaaccctggtccatctaggtatcatctacaagcctgtgtagcactggagcaacagaatgaaggaggacagtgacacagtcccctgactgcattcccactgcccatgcaaccatgaggttcatcctgcagatgacaagcaaacctgtggctgatccagtgtggtcaggaccaagctaatcctgaacatcaagacacacctcccaaggactcttgtcagaggcccctgtctctaccatcctagacacctctggactcataccagcctgtgagtcagccactgacaactttaagagcaacaaggctgcggcaaccccttcagtgatggtgggaacctgagtgctttgggaggctgccttctccactgtctggatgagcaagggcagtaagtccagggcctgcaacagcgtgtcacctgtggagagaggacaagcaccttaaaggacatcctgatccttggaaatgacaggactgagaaaggatttatctaaccagctgtgaaccagacgactaaaacccttcagttaatttttcaaatatctcaaaaagaagtgaagtgaaatcaaaacttaaatcaaactctacagccacaaaattagagggagaaagataatccttatggccaggtgcggtagctcacgtctgtaatcccagcactttgggaggccgaggcgggtggatcacctgaggctgggagttcgagatcagcctgaccaacatggagaaaccccgtctctattaaaaatacaaaattagctgggcgtggtccagttattcaattgatggataagcagagacattaggtgtgttgctcaaggtcacacggctagttgaggcaagtcagagccaccctcaatcctgtcaattcccatctggtactcttcccccatacagatgaccttcggacccaaattctaaatttgggtccaaatctgctgacctctgaactaaactcttttaaaaaaaaaaggaagccaagcacagtggctcatgcctgtaatcccagcactttggcaggctgaggcgggggggatcatgaggtcaggaattccagaccagcctgaccaatatggtgaaaccctgtcttagccgggtggggtggtgcacgcctgtaatcccagctactcaggaggctgcagcaggagaatcgcttgaacccaggaggcggaggttgcagtgagccgagattgtgccattgcactccagcctgggtgacagaacgagaccccatctccaaaaaaaaaaaaaaaaagagaaaccagttaaaactatagtttggctgggcacggtggctcatgcctataatcccaacactctgggaggctgaggcgagcagatcacccgaggtcaggagttcaagaccagcctggccaacatggcaaaaccctgtctctattaaaaaatacaaaaattagccaggcatggtggtgggcatctgtaatcccagctactcaggaggctgaggttggagaatcgcttaaacccaggaggcggaggtttcagtgagctgagatcgcaccactacactacagcctgggtgacagagagaaactccatctcaaaaaaaaaactatagctcaagcacatgttttcttcccccctaccccaacaccttggtttgttgttccatgtttccatagctactaaatgggtacatcagaacatttcacaatgaaagcagtttcccagataatgttttatacttgaatccaagaaatctttattacagaggtttattttcgttttgtttttaaaaggtttattttatattatgtttattttaaaagcaatgagcattgagttctggcactctgcattccttttttaaaaaataaattaaaaataaatgcaacgagcagaactagctcaagctgaagagactaggtaaaaccaagtttttgccatctacaattcaaagtcccacctacaactgatggtcattcaatgcagcaataatgcaaactgatatatatagtacatagactttttatataatttttggtagagacagagtcttgctatgtttccctgcctgatcttgaactcctgggctcaagcaatcccgctgcctcagccacctgtgtagctgggaccacaggcatgtaccaccatgcccagctatttttttaatttttttgtagagatgggggtctcactttgttgcccaggctggtctcaaactcctgggctcaagcaatcctcccacctcagcctcccaaagtgttgggattacaggcgtgagccagctcgcctgcctcatagactgtttttaagtcatggatgtgagttcactatatccctaaggcagctgaaaatgtattgagcgtacatttctacccatggaaaatctatgacttcaatcagcactacctgtggtttgaataaacctcacaaaccactgcacaaagatgatctatgattctgagctgggagacatatttcagaaaaagatatattgctttcaaatcagtgcaaaaatctcttatggtcagattcttcttcccttatcattaaaagaaatatgtgagtacaaagttcatcagacaagacatttcacacagaagggggtcccctcccaagaggaggccctggaatctcctagatgtttctttttcttttttgagacagagtatcactctgtcacccaggcaggagtgcaatggcttgatctcggctcactgcaacctctgcctcctgggctcaagcgattctcctgcctcagcctcccgagtagctgggattacaagcacctgtcatcatgcctggctaatttttgtatttgtgtagagacaaggttacaccatgttggccaggctggtcacgaactcctgacctcaggtgatccaaccgcctcggcctcccaaagtgctggtaggcgtgagccactgtgcccagcctctcctagatgcttctttaaatacagttcataagtttaaatctttttaaaaagaaatacaagcatatctctgagatggaaatcagtaatagaggtttatagcttggagaccaagctcctatacagatttgaaagtttcccccagctctgcttgcccaaatgacagtaggttcctcaacactgaaggaagggcggtggtcatttttaataagtccagagtaaagtttacacgaagttggattttttaaaccagtcttttttttttttttttttccaagacagagtcttgctctgttgcccaggctggagtacaatggcgcaatctcggctcactgcaacctccatctaccgggttcaattctccctgcctcagcctcccacgtagctgagattacaggtgcccgccaccatgcccagctaatttttgtatttttagtagagacagggtttcgccatgttggtcttgaactcctgccctcaggtgatctgcccgcctcggccttccaaagtgctgggattacaggtgtgagccaccgcacccagcccttaaaccagtcttatctgagtcatttctccatgatttcagatactatagtgacaagttctggttctggtcctctctgaataaagctttgtactttgaaagtctgacaagggggagaagccagaatttgttgtgaagactgaattcggattttgggctaagcccaatgctctcatttatttcaggaagaattaaacagtgcaaaataagctgaactaacagggaaagcgggaacactaacaataccctaaagactcagtaacctctgcaaggagacctggacactagccctgggagttgtcttaccccggtaagaggccaacatgcactgcaggtaggcatgcctcaccgcagatgtggaggttttaaggctgaaagcttttttgaaccattcagtgagcttcttgggcacttccatagtgaatcggttacaccagagagccaggactgagacagcgtgtaccaaggtcccttcatgaactagggcaaaaagcagaagtccagtcagtccaatgtcttataaccatgtcaaatcattgcaagcagtgcaaaaaacaagccagagtacaagcgggaggaagcagtgatatttcagacagctacgagccttgctctgagggaggtgtgtctttaggagaggtttatggaaggaaagctccaactgtgaaaaaccacggtcaaggatgagtacagaacgcatgctcaccatgttgcacagaattaccttcctgctgaaggaacgggatgaacagctcagccacgatcccattcaggacctgactggaaggtccagacaccacgtgatgactgacgctcccaatccctaaaaggcagattccctgttcagtctcttatcagcacagaaccacagaggcaagtcttcccactgctgccacctccgcactctgggtcacagacctcttctgtgtctccagcaggcatacctctcctttggccattattgatcttccttcaatgccccctctacacctcctgccttctatagaagccaagcctcctgctagacctgaacaagtccctcttgtcaagcaggcaagcagcagggtcctgggaggcaggctggacccaagatcgtcacaggagtcaagatgcaaagaaggcttcgccttacctaagaattatgttaaagcttatctactactaggccaggcgcagtggctcacgcctgtaatcccagcactttgggaggctgaggcaggtgcatcatgaggtcaagatcgagaccatcctggccaacgtggtgaaaccctgtctctactaaaaatacaaaaaaattagctggatgtggtggtgtgtgcctgtagtcccagctactcaagaggctgaggcaggaggattgcttgaacccgggaggcagaggttgcagtgagccaagattgtgccactgcgctccggcctggcgacagagtgagactccatctcaaaaaaaaaaaaaaaaaaaaagcttatctactaccagatcacagctctactcctggcagagaaatcctgtacctgcctgtaatcccagcactttgggaggctgaggcgggcagatcacttgacgccaggagttcaagaccagcctggccaatatggtgaaaccccatctctactaaaaatacaaaaaaattagcaggcgtggtggtgtgcaccagtaatcccagctactaaggaggctgaggcatgaggatcgcttgaacctgggaggcagaggttgcagtgagctgagatggcaccactgcactctatcctagatgacacagcaagactttctctcaaaaaaaaaaaaaaaaaaaaaaagaaatcctatacctgagaggacgctcatcttctgggctacaacagttagttttccttccgagcctgagaagagagacagcaaagattcacattcacatatgccacatttcccaagagagtgaacaatgcagtcacgtgtgtgatgccacgatacggtttctgattccagaagtagcctttgtgttgtgaagctgggtttaaagcaacttttactagccttttgctttctgactcaaaaaagaatgttcctacaaaaaacttgagaaacagaaaaaatataaagaaaaacatttaaaaggcactcatgtctccactactcaaagacatttcttttctggtgtatttcctttagttttttctgctatgcctacaaaaatgtgtatcttaaaaacaaaaaacctgagatcaccccatccacaccaccccgtgcacggttttgttcattcacacacattcacattccagtgtgacgtccccctggccacacagccttgccacaggcagacttggagcatcaagtccccttcagatcccagttgagggaaataccaggggccacgcctcaaccacccgcatggccaagaaggcttgctcacctccgaggatagcaaataggtgcttggtcagggattccatggccgaagagtcactgcactggcgtgccaggttccgcagtgccagcacagcttcatccatcaggcggggactgttggatttcaggtgacctgcacacacaaagccactgctcagaagcagccaacaactgagcatccagactttcgtctttgtcttttccatgcccccatctcttcagtattagctgtttgctctcattcaaataatctcaagaaagaaactgccaatgccaatgtagtttaggttagggccttattactaccctgagctgtcccctacccctgctacaacaattaggacaagtacaaccaaacccaaggtgacacttatgggctggagaggggctgggatactcaccagccagtcctttcacgatgtccatggcatactggctgaggtcaagcgtcactgatgccagcagactagaaatagctaagggggacagaaagcactgaccatgtcagtctaagcaataaattcaacagataattttgttcccctactccccagcaaatgccactaggcctgctgtctggcccttcatctctacaggctacatgagtagtcccaaagctctgctgaaaagctgtatacctccccatcccgatcagcaaaaattgcctttccaacatcccaccaacacattttactaagatacacagggacagagactcaaccctcagatcccatgatttcaagtgccacctccatactaagtccagaatgtctacagaggaggttcttaacctgaatcgtctccagaaagttcttttggggaggtggaggggtaagaggatattttgttttcttccactcaactctgaaagtgaacacttgatattttctgggaatcagaacaatggctagcacctccataaagctatgaactgatccagtgggttcttgaacccctaaaattatatgcagtattattaatggatatacttttgtgcattcttctgacaagacagcccatgactttttctctttctttttttttggacagagtctggctctgtcgcccaggctggagtgtaatggcatgatcttgcctcactgcaacctccacctcccggtttcaagtgattttcctgcctcagtctcctgagtagctaggactacaggcatgtgccaccacgcctaatttttttcgtatttttattagagacagggtttaaccatgttggtcaggctggtttcaaactcctgacctcaggtgatctacctgcctcagcctcccaaactgccgggattacaggcatgagccaccgcgcctggcctcttgttttttgagatagggtctcactctgtcactcaggctggatagagtgcagtgtcgccatcttggctcactgcaacttccacttcctgggctcaagctatcctcccacatcagcctcccgagttgagctcctgcgctcaagtgatctgcccactgccgcctcccaaagtgctgggattacaggtgtgagccaatgcgtctggctttcaacataatcgcaaaaggtccccaatctctctcccaaggtcccaacaaggtaaacaatgaatacatcccccttccctcccccctaccacacacacttcttgttgccaaatatcgagaatagagatataggcaactcatctccctcccaccatcctggttgacagcaacctactttcaataacattctctggactcctcagtaaggacttctgtatggtgggcagtatcagatccttaaattctgagtgggacaggtatcggagcagaggggcacagctatcctacaaagaaaaaggaataaggcacctagccctcatgggaacggaccaagaagcaaaaaagagttcagcatcccagaattgaaaatgggatcagttgtccaggtgagtaacgtccacctctcgctcaccaacaggtacttcggaggcttgactttgctcatcaggatgttcttcatgtaaaagtccagtagggcgctctagagaacacaaagctctggttagatcctgacattctcaagtatctcatcactggcctaaggggtccctcttgtgagagtgcctccaaaaaatacaaatcaatgccccaaatttcagtgttaagcatagaggtcccactgatcacgcaaccccacttaaaacccttccacagctttccatggcccccgggataaagtccaaagtccttcgtatggcttataaggtcctgcccaccactcagctggctgcgtctcactctaacccattcctgccactccaaccccgctcgcctcctctctgttcctgcccacaggctgcttcctctgcccaaaatgctctgcctcacctcttgaccttgctaattcctcttcactctcaaagttccttctttagagtgatgtgttctctgacccacagcctaaatcaggtccttccgttgtggagtctcacgacttctcacactttccctttgtagcacatactagttataattagctagactatctgtttaatgtcagtttctcagactcagttccatgggggcaggggtcatagctcccttactcgctggtgtacccccaacaccgagcacagtgcctagaacatggcagccactaaattgggatgaataagtgactgcatgaacaagcaaactatcacccaagccagaaacagaagggaaactttccagctcctagaagttcatgtatcatggcaaaaggccagagtctcacatgagaaaaccaacaagtttcagataaggtcaacagctagggtcaccagggcaaagcaggttcccattccttccctccagcgagctcccaacatccccaacatagcaaacccacagtcactctgccttggcacttgccttgtgctgactgaccacgtccatctccttgtgactcgtgcagaactgcaccagcagccccagcatgccagcatagttctggttgggctctaggctgagaatggctgacaagtactgttccaccagcccggggttctgaagaggaaagtgccaggcaggtgtttaagatggcagtgggggagtggcatggaagaagcaatgcccaccagcccctgcagtcctgtcacctctttccacagcttcgtgagtttcttcacagcaccatccacggcgtgcttgtgggagccacccagcacctccagcaagagcaggcactgcacttccacctgccaggaccagggaagactcaggtcaaggtgggacatgagactgagggtcccatggctctcatagcctgtaaagacctccatcagaccctccaaatcctggcttcatctccactcagcctctcccactcaactccagccagctcctcttccctccaccccacacatttagttctgtcctttaacgacactgttcccactagtgttcgtttaataaatatttggtgatcacctattatgaatcagacaatgaaggcacaaggggaggaagacagacatggtccctgctttttttttttaagacggagtctcgctctgtcgccaggctggagtgcagtggcacaatctcggctcactgcaacctccacctcccgggttcaagtgattctcccgcctcagcctcccaagtagctgggactacaggtgcgtgccaccatgcccagctaattttttttttttttttttttgagacagagtctcgctctgtcgcccaggctggagtgcagtggtgcgatctcagctcactgcaagctccgcctcacgggttcacaccattctcctgcctcagcctcccgagtagctaggactacaggtgtccaccaccatgcccacctaattttttgtatttttagtagagacggggtttcaccatgttagccaggatggtctcgatctcctgacctcatgatccgcccgcctcggcctcccaaagtgctgggattacaggcgtgagccactgcgcccagccggtccctgctttcatgtaccttagaattcagaggaaaaaagagatattaaacaaataaatacacaaatgaacatacaatttcagtgaggtttaagtgccatgcaggtaaagaattaagggtcctgtttcatttacttcttatctgccttgacctgtccttcattaattccacaaatacttactgaccactgcatggcaggctctatgctgagcactgtgaatacagaagtgcatcttgatatggggattcgaactgcatggagctcacaccgtccaacccagattgacatacataataggtccttgactaaaaaaatctcagaggctgccaggcctagtggctcacacctgtaatcccagcactttgggaggccgaggcaggcagatcacctgaggtcgggagttcaagaccagtctgaccaacatggagaaacctcatctctactaaaaatacaaaattagctgggtgtggtggcgcatgcctgtaaccaagctactcgggaggctgaggcaggagaattgcttgaacgcaggagaatcgcttgaacccaggaggcagaggttgcggtgagccgagatcacgcctttgtactccagcctgggcaacgagagcgaaactccatctcaaaaaataaaggccaggtgcaatggttcacgcctgtaatcccaacactttgggaggctgaggcaggcggatcacaaggtcaagagatcgagaccatcctggccaacatggtgaaaccctgtcgctactaaaaatacaaaaattagccgggtgtggtggcaggcgcctgtagtcccagctactcaggaggaaaatcgcttgaacccaggaggtggagtttgcagtgagacgagatagcgccactgcactccagcctggtgacagagaaagactctgtctcaaaaaaaaacaaacaaaaatctcagagactttatgtgccataaatgcccaaggtcactagtgagtcgtgtgaactgccaccctcagaaaacagatatgcttgtggccgggcgcggtggctcacgcctgtaatcccagcactttgggaggctgaggcgggcggatcacgaggtcaggagatcgagaccatcctggctaacacggtgaaaccctgtctctactaaaaatacaaaaaaaattagctgggcatggtggcaggcgcctgtagtcccagctactcgggaggctgaggcaggagaatggcgtgaacccgtgaggcggagcttgcactgagccgagattgcgcctcactgcactccagcctaggcgacagagcgagactccgtctcaaaaaaaaaaaaaagaaaaagaaaaagcaagcaagcagatatgcttgtggaaagcaatgctgataaattccatttgcatgtatacaaaatggcatatgtacaaggttattctttgcagaactgttagtaacaataaaaaaccgtaagcaacagaggactccctatatatagcatagtatagaaaggattactggctgggcgtggtgactcacacctataaacccagcactttggaagaccgcagcaggtggttcccttgagcccaggagttcgagaccaacccgggcaacaaaagaaaaccccatctctaaaaaaatacaaaaatcagccaggcatacaccagcatgcctgtagtcccagctactcaggaggctgtgacagaaggatcgcttgagcccaggaggtcaaggctgcagtgagctgagatcatgccactgtgctccagcctgggtgacagagcaagatctttgtctcaaaaaaaaaaaaaaaaaaaaagaagtctgcagaatcatggtgtgtgtataaaaaaattttttaatacatttttttaaaagtaggctgggcacgaccaggtgcagtggctcatgcctgtaatcccagcactttgggaggccgaggcgggcggatcacctgaggtcaggagttcgagaccagcctgaccaacatagagaaaccccgtctctagtaaaaatacaaaactagtcgggcatggtggcacatgcctgtaatcccagccacttgggaggctgaggcaggagaatcgcttgaatccaggaggcagaggttgcggtgagccgagatcgcgccattgcactccagcctatgcaacaagagtaaaactccgtctcaaaaaaaaaaaaaaaaaaaaaagtaggctgggcacaatggctcatacctgtaatccctgcactttgggaggctgagacagacggatcacctgaggtcaggagtttgagactagcctggccaacatggtgaaaccccatctctactaaaaatacaaaaattagccaggtgtggtggcatgcacatatagtcccagttatactcaggaagctgagggttgagaattgcttgagcctgggaggcagaggttgcagtgagccgagattgcgccactgcattccaacctgagtgacagaattacactctgtctctcaaagaaaacaaaaaaaaaaaaacaaaaaaaaccactcagtgcagataagccaatgagcttgccccttcttacaaggaggcttttggtaacaatgacacccattccctgaagcaaatccaagagagtcccagctcacaatacgtaatccttgaccctcaaggtttcagcattctaatccatcatcaatcaattatactgacagccattccatgtttgtccccagaggtgcgctggataagctcccagggatgcagccctctatctaaccagcaggctgcttcatggagcggtacttgtgtttcctaaggccggtcatcactggcacctacctgcctgggactctccagtttccacagtcatctcaaccctcaacgaaacctggctttgcgacaactctttgaggtggacagggtgagtagtattttctttcccactttgcaaatgaggaaatgggctcagaagttaagtgactcagccaagtctcatggacaagaatcagatccaaggcctggcaaagtggctcacacctataatcccaacactttgggaggccaaggcaggcggatcatctgaggtcaggagctcaaggccagcctggccaccatggaaaaaccctgtctccactaaaaatacaaaagaattagccaggtgtggtggcaggcacctgtaatcccagccactcgggaggctgaggcaagagaaacgcttgaacccaggaggcagaggttgcagtgagccaacaccactgcactccagcctgagcaacagagcaagactccgtctcaaaaaaaaaaaaaaaaaactactcctcatgacctacactaaaaaaccactcctcatgacctacactaagcctacccaggcacatgtctgctctgctcacctcccaacctggtgagcagacatggggaaagaaaaagaagagaatatggaaggagcaggtagagaatggaaagagggaatttaagaaccaaaaccaagacaaaaaatccattccattcaccagttcaacactgaaatcaaacacagggaatggaatgatcagccagaaaaacaccaagaggatttacactatgatattttctagtctacttgatttttggctgtcttcccaactctggcctgtcacggcttccacacatgccatgaaatcaggggcctcatttctgttgtgcatcactgcatttctagtgcctagcaccatgcctgacagagaagctccaaaatgtctaatacaccaaacaatgtgattatgctgcactcatggccatccaccaaagccacacacctcgggacaactcagagtgtctggtcacccagcacccagaaaagcacttggcaccaagaaggtgctgaaacatgctctaactcctggcagaaagctgacccttgctacttcagagacacagggaacctaccagtttgttccagatgtctccttgtcgcttggctctcgatggaaagacaatgcgcaccaggaggcaggtccaggtcaaggccagcaaggcggcagagccactgctcttactgcagagcagagttggggatgagttcagagcagcagcctccaccttgaggacgaacactgtccctaaggccccgcctggtaatgcaggaccctcccttcacctcatggaacagaacttgaaacaagttccccacaaaccatctgtggcaattcaggacaagaagtccaggcttcagtggccaaactcccatctcttggcactgacaactataaaaacaaacagatggcttccaccattaggggcctggtgggcaactggttcccctcaaaatggccttgcttccactgtttcccaaccctgctcctcgggaaagtggttttctccactaagcttgctatcctggctcctccctctggtgcacagtcaactgcatcagcttctcctgagcaggactgtaccaattctcagggggccacaacttttacctcttacctgggaacacctgctttggagcctataccagaagactgcagagagtgtagaaggttcttagcagtggcttctggctgggcctcagccaactgctggatggctgcctgcaaggccctgcgggaggctgcatctctagggggagaggcaaaggaaagggtgaacatgcagacctcaggcagaggcaggggcaaggctgctcaggccatacactggtctttctcaggagaaactgatcacaccatattccagtggataacagagaagggattaggaaataactagataaactcacctcctcctagagttctaaaagtatctcataagggcaaataagccattgagtgtgtaagggcagcacctacatttatggagcagttataagggtctcaaagtaggccagacgatttaacacacatgactaaatggcagcataaacacattgaccactatggcacagcaggcaactgttccaggcacctcacgcttactaacaaccacccatgagatagagaatggcaccatccccattctgcagacaaggaaactgaggcacagagaggttaagtaacttgcccaggatctaatggctaggatgtgacatagcccagatttggcaccaggcagtctggctctaatctgggctctaaccactactctaaatcccctctctgtacaaagtgctccacatatggggcctttggctgggactcacctatatcgatgcagagtcaagcagaacaatttgcagagccccttcactgctccctctggaagatctgaaaccagagattacacagacagcggtcaataaaaatcacttggtaagccgctggagtcaggtattctgcccagacatgatctcagcccactggacactccccatatatttaagaccttcctccccaagaggaaaaagcaacaacaaaacaggactctaggaaaatgcctggtacagaaaagctttgggtagacatttgctaaatgaacgaaactaagaaaataaaagtggcctcgaaacctcacatgccatcaagaggaggttcaggagtgctggaatggttctacttcttgatctgggtgctggttatactggtgtttaacatgtgatgattcagtgagctgttccattaggaggcgtacctttcttcacatacattctaataaacggtttaaaaaacagtgcaacactgaagtactatgagggaccagaaaagggaagaacacctataactggagtgtttctgaaagtctgaaggacacataagcttggcctatcagattagtaggctctggaaaaatggaaagagagggagatacatgtagagtgcagggttaagaaggcataatacctattcagaacacatgaagaagaagagaggactaataacaccctagctcttagtgcttacaagatgccagaccctgctctagatcattcatacacattcactcatttaatccatgtaaggtgggcagtgttattaaggcccccccgccttttatttttcagacggagtctcactctatcgccccggctggagtgcagtagtgcgatctcggctcaccgcaacctccgcctcccaggttcaagtgattctcctgcctcagccacatgagtagctgagactaaaggtgcgcaccaccacgcccagttaatttttgtatttttagtagagacagggtttcaccacgttggccatgctggtctcaaacttgtgaccttgtgatccacctgcctcagcctcccaaagtgctaggattacaggcgtgagccatcgcacccggattaagcccatttttaaatgaagaaaccaagttatgggaaaccaagccagccagtcagagtgaaacagatacaccctaactctggagtgaaacagatacactctaactctgggcagaaagagttcaactcttggttgaacaagagtgctcaatatggctgggggcagtggctcacgcctgtaatcccagcactttgggaggccaaggtgggaggataacttgaggtcaggtcaggagttcaagaccagcctggccaacacggtgaaaccccgtctctcctaaaaatacaaaaattacctgggcatggtggcacgtgtctgtaatcccagttactcaggaggctaaggtgggaggatcacctaagcctgggagattgaggctgcaaagagaatcgcttgaacccagaaagtggaggttgcagtgagcagagatggcgccactgcactccagcccaggagacagagcgagactccatctcaaaaaaaaaaaaagagtgctcaataatgttggaaagccaacctgtgacaagtgctgcatgacacagtgaagcacgcaaacaaaagggaggagcttctgaggaggaggaaatttaacctgcagtgtaagacagacttatactgggtgtaggaagaacctgagagcaggaggcccataccattcctcacacttcaggcacctgaatgatggaagagaaatgaatgaggtacagggacgcagtttccccagggccctgaccactgcattggtccatgtgatttggggctatttcagtaactggggaaaaagaatgactggggccagaaacaggttgtggctaagacaatgacaataacagctaacacacactgtgagcttaccatacccagacaatgcgttacatttactccaacctatcagggaagtactactgctatctccatgttcaaagcaaagaaacaggctcagagaggtgaagtaacttgaagcaggtcacacagcctgtaagtggcacagcccatctgagcccttcatcactgactgctgcactagaggcctgtgactggaaagatcggtatcacatggctgccttttctaactagagggctctgctgggaaagtgaccagaaaaaccgtcgaggatgccataaaactcatacattgaagcattaacacacaagagactctctgagacgctcacaaatagcaagtttacaagcttgggtatcttactaggcataagcaggtcagaagcagcaaatgagaagttgggtgaagtggtagaaataggaagtaaaagtggacagaaagggagacccaatctatatggccatgattttcttttttttttttttttgagacagagtttcgttcttgttacccaggctggagtgcaatggcgcaatctcagctcactgcaacctccgcctcccaggttcaagcgattctcctgcctctgcctcccaaagtagctgggattacaggtgcccaccaccacacccagctaatttttttgtatttttagttgacacggggtttcaccatgttggccaggctggtcttgaactcctgacctcaggtgatccatcctcctcggcctcctaaagtgctgggattccaggtgtgagccaccaagcccagccatggccatggttttcaaactttagtaaacataggaatcacctaaaggactcgttaaaacacaaatgctgggttctgtgcccaaacttttttttttgacacagggtctcactctgtcacccaggctggaaagcagtagcacaatcatggaccactgcagcctcaacctcctgggctcaagcgatcctcccacctctcaacctcccaagtagctggggctacagcacctccaggatttccgatttgagttgctccaatggagctgagaatttttatctctaacaagttccaagatgatgctgatgctgcctgtccagggaccacactttgagagccaatgctatacggtaaaaacaaacataccaaaagaaatgaaaaaaaaaaaaaacaaaaaactagaatttattgagtgaaggcaaaatggtcttactctaataagtcatagagctatcccttggttatggtgcagatcaggataatcagatatgctcagcatttcccaaaatgtgttccccagaccctcaacagattttcagcaaaaaagaggttcaaagaaaacactgaatccaaggaagcttaataaagtgaaaacaccttgttgcgaatattccaagaggacatcaaaaacatgacctctaggctgggcatggtggctgacgcctgtaatcccagcactttgggaggccaaggcaggcggataacctgagatcaggagttcaagaccagactggccaacatggtgaaaccccatctctactaaaaatacaaatattagctgggcgtggtagcaggtgcctgtaatcccagctacttgggaggctgaggcaggagaatcacttgaacccgggaggcggaggttgcagtgagcagaggtcgcgccacagcactccagcctgggtgacagagggagactctgtctcaccaaagaaaaaaaaaaaaaaaaaacctctcccaacttatttgatcttggaatcctttattggccaatcacctactaccatggtgctgacttccacggaacacagattgggaaaaatgatatcccaagtcataaaaaaaatgtttttggctgggcgcggtggctcacacctgtaattccagcactttgggaggatcacaaggtcaggagatcgagaccatcctggctaacacggtgaaaccctgtctctactaaatatacaaaaaattagacaggtgtggtggtgggcacctgtagtcccagctactccagaggctgaggcagaagaatgatatgaacccgggaagcagagcgtgcagtgagctgagatcatgccactgcactccagcctgggcaacacagtgagactccgtctcaaaaaaaaaaaaaaaagtttttgtactctgtatactacttgagaaaggttttagctatcttttttaaatatttccaaacaaaatggttaaaagtgtaaatagctttcacacctgaatggataaactctccatgaacccaaaagttttaactgttgcaattcacactatagcaaggaaataaagtaaaggcagaagttgtgcagggaggggggaagaaggccatggttccttttttatttgagacggagtcttgctctgtcgcccaggctggagtgcagtagcacgatctcagctcactgcaacctccactgcctcccaggttgaagcgattctcctgcctcagcctcctgagtagctaggattacaggcgtgcgtcaccatgctcagctaatttttgtgttttcagtagagacagggtttcaccatgttggtcaggctggtctcgaactcctgacctcgtgatccactcgcctcggcctcccaaactgttgggattacaggcgtgagccaccacacccaggcttttttttttttttttgagtctcactctgttgcccaggctagagtgcagtggcataatctcggctcactgcaacctccacctcccaggttcaagcaattctcctgcctcagcctccctagtagctgggattacaggtgcacaccaccacacctggctaatttttgtacttttttttttaatagagacggggtttcaccatgttggccaggatggtctcaaactcctgaccttgtgatctgttgacctcagcctcccaaagtgctgggattacaggcgtgagccaccgtgcctggccaaggccatggttctaaagaaaggcaatttcagctgggcccagtggctcgtgcctgtaaccccggcatttgagaggctgaggcaggcggatcacttatgatgaaatactgcatcgatccgaaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcggaggaacgctggatcacctgaggtcaggagatcgagaccattcaggagaacatgatgaagccccgtctctactaaaaatacaaaaaaaaaattagccgagcacggtggcgggcgcctgtagtcccagctactccggaggctgaggcaggagaatggcgtgaacccgggaggcggagcttgcagtcagccgagatggcgccactgcgctccagcctgggcgacagagcgacactccgtctcaaaaaaaaaaaaaaaaagagaaaccattctgtttctaagcatgtgcaattatgtctcagctccacgtcataccttttagtttgctgagctcgccaggtggcacagggaaccgggactccgaattcgcagctccagctccagctccagcccagcaggtggcagcagctcagagcaagctcctccaacgcgaggcagcgccttccttcgcgaccctacttaaaggcggctttccgttggctggagtggcagcgatattatccaatggttgcctgtattcgttcagctttgtctgacgggcgatggcgcagccaatagacaggagcgctatccgcggtttctgattggctactttgttcgcattataaaaggcacgcgcgggcgcgaggcccttctctcgccaggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatcgtaagtgcagggtgggtcgcctctgctcttcatgttgccccagcgcaaatagggacagtcagctgctatgtgctgagggtctactcacaccggctactgaattaggccatttttgggaaaatactgtttagttaacaatttcctgagataggtcccttctgttgcagataaacgggctcaggcaagttaagtgggtcctaagatgacagcattcgtatccaggtctgtctggcttctaaaagagcgcgctttatacttttttttttttaaacggagtctcgctctgttgtccaggctggagtgcagtggcttgatcttggcttactgcaacctccgcttcccaggttcaagcgattctcctgcttcagcctcccgagtagctgggattacaggggcgcgacaccacacccagctaatttttgtattttcaatagagacagggattcaccatgttggccaggatggtctcgatctcttgacttcatgatccaccttcctcggcctccctaagtgctaggattacaggtgtgagccaccgcgcccggccgcacattacagttttactccatttttgagaaggtctgaggtcaggaatgactcattgtaaggaagcaagctgttgcatatttaggacctgtcagccaagaaacttaagtgtccaatgacttttggatggcctttgaggtgggtctcccttgcccagaaatgctgactgtactgcgcttaagcaattaggcagcattgtagagcatagcttgtattacattttcccacacttagaaggttttcagacacaaaacccaaaggaattgtgtaacaatccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggaggtatatgctgtcagccttgccccctcttacactgatggttgagagcatgacaaggttcagactgagtccctgtaaccaaggactgtgttttcatctgtctacctacctcatctgtaaaatgtcagtaacaacataagattgttgaaggattttttttttttttttttggagacagagtcttgctgtgtcgcccaggctggagtgcagtggcacaatctcccggctcactgcaagctccgcctccgggttcacaccattctcctgcctcagcctcctgagtagctgggactacaggcacccgccactacgcccggctaatttttttgtatttttaggtttcaccgcgttagccaggatggtgtcgatctcctgacctcgtgatccgcccaactcggcctcccaaagtgctgggattacaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgatggggctgaattgctctgccaggagcatttggtatgagatgaaatggcctctcttgagactgagctgccaacctggcaattattgtctgctaagggttctctttattcacccttacttggacttcctttcctgtagggaatctcacgtaaaatgaaatcttccctcccccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtaaaaggatcccaccaggaccacagtgggcctgactgtgacaaattagcagggtgatgtggccttctaccttactgcttttatagttgtattttatatagcagataattttgtgaggggatatttgagaggttgggaggcagggaaggcgtttctcacttgagaaatgacaagagacccaaagagggggttaatgggcaagagctgggccttaggaaccctgcctcactaggccatacccaagctgtcctgcttgggctgcttctgacaggaaaggcttcacacggactttgatattgttggtccttaaactctaccaaggcaggagggtggtgggtaatagaggagtgtggatgaccattttgaccacttcccccctcctttcaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtctctggactcttaattttgtaattttttttcctttttgacacagggtctggctgttgcccaggctggagtgtggtggtgtaatcataactcactgcacccttgaactcctgggatcaagggatcctcgtatctcagcctcccaagtagctgggactacaggcacacaccatgacactcagctactaatttttaaattttttttttgtagagatattgcacaagctggtctcaaattcctggcctcaaggaatcctgcctcagcctcccaaagtgctaggattacaggcttgagccaccatgtgcctggcccttaattttgaggtttatagtgccatatgctagaaacgaaagccatggtaaaaccagagctttgtatttaggtgttgatgtttgggtatctaaatgaagctaccaatcaaacatcctatacagttttctagacacagttgtaactattacactagaattactgtttctatggctgctgcatacttggagtaggtttagtgtcagctgagataggcacctggtggatgctggggccagtcccctagagtaaagtttttcaaactgggtggtgctccaactcggtggtaaccaatttatattttcgagatagtctcaaatatatttgagactggggtgcagtggcttggacttggctcactgcaacctccgcctcctgggttcaagtgattctcctgcctcagcctcccaagtagctgcaattaccggaggctgccaccacaccgggctaatttttttgttgttgagacagtctcgtcctgtcacccagactggagtgcaatggtatggtctcagctcactgcaacctctgcctctcgggttcaagcggttctcccacctcagcctccccagtagctgggactacaggcatgtgccaccactcggctaatttttgtacttttagtagagacggggtttcactatgttggccaggctggtctggaactcctgaccttgtgatctgcccgccctgtcctcccgaagcgctggaattatacaagggtgagccaccgcacccggccttttttttttttttttttttttttggtatttttagtagagacaaggttttgtcatgttgaccaggctggtctggaaatcctaacatcaggttgatctacccacctcagcctcccaaagtgctgggattacaggcgtgagccaccatgcctggccccagtatttaaagagaaagcagcatctgctgagaataggtgtttttgttgtgattcctgtatttcacttagagatctgtctgctggaacatgatatattcattctaactaggtctgtgtcaaaggtttgaaagccactgctaacagggctgacaactaagctgtggagaccctgttccctaaattgcagccacgtctgcacgtagcctcttgccctgtggccttcaaaactcccagcctggggcgtccagcatttccccagggcaggggcctcgttcagttctgaaccttccctgacctccgtatccagccacgtttgctaaccctgtacaagtcatccgccaactgaactacaaactgaggacaaaagactagttcaccgactcttttacctagtttttagttcctgctatctaggaagcaacacttgtttttctaaagaacttagtcatcactcaggaaaggcccacgtagggctggccctgcgggctggaagtgggtcaggggctgcaaggcgggcccatagcgttacaccgcgggctcaccacgttacaagcgctagtctcccacgaggcgcccggggctgaagagcgggccctggggaggaggccttgtggctcgggcgcgggccaactttaagcccgtgatccggctgcccgggctgcagcggccgccgtcctgcccgggggcaccaagcccggggccctgcccccgctggctcccggcctcgccctgccgcgtgggccacgctgtgacccggaagcgttccggaagcggttccggagtcagccccggcaggatggcggcggacacgcaggtgaggcgggcggctgcggggccaacgcggccagggactgggtgcggacggtggccgtcgggcggggcccctctcgctcctcggcttaggggcgttggaggtggtggctgtggaggtcgtagtctcggggccgtctcaggctggactctcagggctgcgggcttggcccggcccgggcggcgcaggcagaccgcgggctcgaggagtccggggctcccgcctcgacttcagcagctggagctcggcggggcctttgcccgaccccagagttgcagaagttcactttaccgagcctctacttcttttctccaaagccctccggctgtgagccccgggccaacgccaagtcttccttaaactttgtattcagcaaatattctttgagcacctactatgagcagggactttgagtgtagtctttggattcatacagatctgggcttgagttcctgctcgtcgatttctgtgacatgccaaacaagtgacttaaccccgccaagtctgccttttcatctataaaatgaagttaaaacaatacttatcttaaaaggttgttgtgaaggttcagtgagataaaatacggcttgatatatgttggttgttatcagatccagggttagtgaaaagaactgtcctgtccaggaagagtgttacctatgggtaccttgtagttcaggaaggacctgggaaaaccttttcctccacccagttgttatgttttaaggtgaaaagacattgtcatgaggcaggggaagaacaggtgtctaaggacagctgggctgatttggtgtctccagggtgatgggattgatttttatgtgtaggcccagaaaatgaccacttaagcattcaaaaagacatttactgagactcctatgcaggtggctgatgttcaagttatgttgtactgaatactagaaagaaaagcttagtatgagagggttaggggaatacatgctgaatgtttaacattgatactcacttgagggaaaaatctctagagctgcaatgtccagtatggcagccacatggcttaagtttgttaaaattaaattaaataaaaaaattcattgtttggctgggcgtggtggctcaccctgtaatcccagcactttgggaggccaaggcgggtggatcagttgaggtcaggagtttgagactagtctgaccaacgtggcaaaaccccgtctctactaaaaatgcaaaaaattaaccgggtatggtggcatgtctgtaattccagctactcaggaggctgaggcatgagaatcgcttgaacctgggaggcagaggttgcagtgagctgagatcgcaccactgcgctccagcctgagcaacaagagtgggactctgtctcaaaaaaaaaaaaaatttagttcttcacttgtaccagccacatttcagtgcacagttagccacatgtagccagtggctaccgtattgggtggtgcaggagaatatttctgtattttataatttttgtatttttagtagagatggggtttctccatgttggccaggctggtctcgaattcctgacctcaggtgatccttctgccttggcctcccaaagtgctgggattacaggcgtgagccaccgcacctggcctgaaattattttttattattttattttattttttgagacggagtttctctcttgttgcccaggctggagtgcaatggcacgatctgaactcactgcaacctctgcctcccaggttcaagcaattctcctgcctcagcttcccgagtagctgggattacaggcatgcgccaccatgcccggctagtttttgtagagacagggtttcaccatgttgggtaggctggtctcgaacttctgacctcaagcaatctgtccgcctctgtctcccaaagtgctgggattacaggcgtgaaccaccatgcccggccttgtcttcagtattctttttttttttttttcgagacggagtctcgctctgtcgcccaggctagagtgcagtggcacaatcttggctcactacaacctctgcctcccgggttcaagcgattcttctgcctcagcctcccaagtagctgggattacaggcacccggcaccacgcccagctaatttttttttttgtatttttagtagagacgcggtttcaccatgttggccaggatggtctcgatctcctgaccttgtgatctgcctgccttggcctcccaaagtgctgggattacaggcgtgagccactgcacccagccttgtcttcagtattctaaaggaaaatgatttcaacctagaattctgtatttggccagaacattttcatacttgcaaggagtttacaaaatggaggctgtgcttcacccaaacacaagaaagtacatgttcagggtgataaactgtgccccagctgtagaggatcacatgcctaattggggcaggtcagaaaactctgggagagatttccttaggaaggtggaatttgatggaatacctgatctccctaaatgtactgagatttagacaaatggcaaaaagtttgggttttaattatttataagaacagataaaacaagtcaaactgaagtgaggtgggaaagggtaattattaacaccaggggcataaaaaagctgggaagaatcagagtttattaaatggatgttgaatgccatttacatataatgtaatcactgactactgacctagcctgtatgtgaaactggggacttccactggggaaatggggagggtgtgcgatggggtcacagcaggaaagggagctgtggtggaaaggtagcaaaactgaaaaatcaagaagcacatgcaagttacctccatatttagagatacttagatatatggaggtaactacccaaatatccaccagatcaacctaagggttgcccatggagagtgagggcaagggactggtttttatggcagacttctcagaactctttggttttgactctgtgtgcatctatgactataaaaacaaaagacattttaaagttaaaactacattatttatgtagaagacagttttggacatcagtttcttttattcattgccaatagaattatggcagggatttaagcacgaaaaactcagcattattttatttctgtgtgtacgcttgactcttacgctactgataaggcctgcctttgaaataccctcaaaagaaaaacatgataaccccactgtgttaagttacatgagccttatcatgccctgctctacggcttatgaatccacaacctgtccacttggtagcttgtagaatattgctcaagagcagattttcagggatgtttgcaaactgccccccatcactgggtcttatgcttatgtccctatgcaggggactgcagctgtggtaactcgatggctgttgaaagctaaagatttgttagcatcagtttatagacctgtttggtttcaaagttagtttcaaaaacgcaggtgctgtggctctcgaccccactctgagcagtgacttcctctcttggagatggtttcttcatcgcctataaaatggggatactgatgcctcccttgcaggctttttggtagtagtagccaactttttgcttgggatgagagtagatgcaccttatacgcaatctcatttaagctccataacagtcatatgaggtagctgctattgtccgcatcttatagatgagaaaactgaagattgggggagtgacattatttgactaagtttctacagctagtaaaaggcagagctgggatccaatctcctaacctttccccctttagccagtgtgcttatcctctgccagtgagttgccaggatgctgacattccctttatggggaggttaaagtgagataatgtaaagggaacatagttggcacgtaccaggcccttgctagattttgggtagttctgaagggatattttcttttcagaggtctttgcctttcctcttattgccaaagtttaaataaggtatattgatttgttgactagttgaattaaagcagtacatctcaagtgggagtgattttgcctgccaggagacatttgacaatgtcacaactggggcgggtggggaaggtgggctgctactgacatcgagtgggtagagacctggaatgctgctaaaaacacggcccccacaaccagaattacccggtgcaaaatgtcaccagtggggaggttgagaaaccccaggttagagagatccccaaattctacacccacccctcaacacacacactcatagttttatagtctgactagtgaatttttctgttgcttggccttcacaggtttccgagacactaaagcgttttgcagggaaggtgacaacagccagtgtaaaggaacggagagaaatcctcagtgaacttgggaagtgtgttgctggaaaaggtatttatttttcatccacataccctggacaatattcattgtttttctttctttcttttttttttttttttttgagacagagtctctcactgttgccctggctgaagtgcaatggcacgatctcagctcattgcaacctccacctcctgggttcaagcgattttcctgccctcagcctcccgagtagctgggattacaggtgcccatatcatgcctgcctaatttttgtatttttagtagagatggggtttctcgaatgacagtgttccatatcaaaaataaattttgtggttttttttgtgtttttttcttctttttgagacagagtctcacgatgtcacccaggctggagtgcagtggcacgctctcggctcactacaacctctgcctcgctgggttcaggcgattctcatgccttagcctctccagtagctgggattacaggtgtgcgccaccacacccagctaattttcgtgtttttagtagagatggggtttcaccatgttggccaggctggtcttgaactcctgatctcaggttatccgcctgccttggcctcccaaagtgctgggattacaggcgtcagccaccatgcccagcctagaggtcatgtttttgatgtcctcttggaatattcgcagcaaggtgttttcactttattaagcttccttggattcagtgttttctttgaacctcttttttgctgaaaatctgttgagggtctggggaacacattttgggaaatgctgagcatatctgattatcctgatctgcaccataaccaagggatagctctatgacttattagagtaagaccattttgccttcactcaataaattctagttttttggtgtttttgtttttccactgaaagactacgtgcaggtgacctcgaagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggggtggagtccgcgttggcgaattgctatatggattagaggttatctgctgatggtacgcgaagttgtgatgccagagtggaattcctccgacattcgggaacggtcattagtacaaagcgtgggtaatgacccaacagaggtaaagagatcgtcaacgatgatatatttcactttttaataatgcatgtctcatgtattatggctatgtttatatccattttttttctagtgttgagtcggagttatgcctctctctccaaaatgtaagccagtgtggctctcttttttctctgctacactctctgttcaggtttaagggctgtctcctttcaaaggggggggattacttggaatatcagcgaaaaaaaaaaatcgtccgggttgtttctttgtgtttttaacaacccatctttattccccgtgttggccgggatggtctcaatctcgttaccttgtgatccgaccccctaaaaatcccaaagtgtttggtttacatgcgtatgtcatcacgcccagcctgaccctgtctcttaaaaaaaaaaaaaaaaaaaaaaaaaataggccgggcgcagtggctcatgcctgtaatcccagcattttgggaggccaaggcgggcagaccacctgaggtcaagagttcgagaccagcctcaacatggagaaaccccgtctctactaaaaatacaaaattagccgggcgtggtggtgcatgcctgtaatcccagctactcgggaggctgaggcaggagaattgcttgaacctgggaggcagaggttgcggtgagccaagatcgcgccattgcactccagcctgggcaacaagagtgaaactccgtctcaaaaaaataaaaaataaaataaaaaaataaaaacagacacaaagtgctctccctcactggctcaagctctggtgattggagaggtgagaaggggggccaggtgcagtggctcacacctgtaatcccagcactttgggaggccaaggcaggcggatcacctgaggtcgggagtttgagaccagccttaccaacatggagaaaccccgtctctactaaaaatacaaaaaaaattagtcgggtgtggtagagcctgcctgtaatcccggctactcaggaggctgaggcaggagaatcgcttgagaccaggaggtggaggttgcggtgagccaagatcatgccattgcactccaacctgggcaatgagagtgaaacttgctctcaaaaaaaaaaaaaaaaaaaaaaaaagaggtgagaagagaaccaggagacactgtgtcctggaaaccaagaaggagaagcattttagaaggaatggtaatagacagtggcaaattcagcagatgagcaagggaaagtatagagggaaaaacgcaggtttgggcattaaggaaatcagcaggcaaggcatttgcagtcatgttaaggataaaagtgagctatagcagaaggttaggaaggagtgtataggaaggaaattgatgggctgggcgcagtggctcacacctgtaatcccagcactttgggaggccaaggagggaggatcacttgaggccaggagtttgagaccagcctgggcgacacagtgaaacaccgtctctaccaaaactacaaaaattagctgggcgagatggcgcgtgtttgtagtgcagtccctgccactcaggaggatgaggtgggaggataacctgagcccaggaggttgaggctgcagtgagctgagatcgtgccactgcattccagcctgggcaacagccagaccctgtctccaaaaataaaaaaaataaaatagaaagtatggctaaaatggggtggggattgtgtgttagggaaagaaagcagcgatggaagggctgaaaatggttggagatgaaacgtctctgacagctttgtgcctcccaagggcatactgttcagtcggcgtcttccttggttccagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatctgacttggcaagagtggtaaccaccccttgtgcgggattgggagtcctggagagacaccctgtttggtttaactttttctagatctagagaacctagacattcttatgtgtgtcttttctccgtgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgcttcatgaatttgtgtgtcattcttgcacaggggtcatactaacctctgtatcattccaattttagtatatgtgctgctgaagagagcactaaaactaatttttttttttttttgagacaggatctggctctgtcacccaggccgaagtgcaatggcctgacctcagctcactgcaacttctgcctgccaggttcaagccatcctcccacctctgcctcccaagtagctaggactacaggcgtgcaccaccatacccaactaattgtttttattttttgtagagacagggtctcactttgtcacccaggctggtctcgaagtcctgagctcaagctctccacccgcctcagcctcccaaagtgctgactttataggcacgagctaccacacccggccaaaacttttttttttgagacagtctcgctctgttgcccaggctggagtgcagtggtgtgatcttggctcactgcatcctctgcctcctggattcaagtgattctcctgcctcagcctcccaagtagctgagattacaggcacgtaccactacacctggctaattttttatagttttggtagagacgaggtttcaccatattggccaagctggtctcaaactcctgacctcaagtgatctgcctgccttggcctcccaaagtgctgggattacaggcgtgaaccaccgtgcccgggtgttttgttttgttttgttttgtctttgagatggagtctcgctctgtagcccaggctagagtgcagtggcatgatcttggctcactgcaacctctgcctcccagattcaagcaattctcctggctcagcctcccaagtagctgggactacaggtgcccaccaccatgcccggctaatttttgtattttcagttcaccatgttggccaggctggtcttgaactcctggcctcaagtgatccacctgccttagcctccaaaagtgctgggattacaggcatgagccaccaagcccggccagtggtcatctttccatgtcctaagtgctatggtattgtgactgataggctgatgttcacaagcattccctggaccctgctcttcgtttatctttgcattcacttgtttcatttctttacagatccctaaggagcatccgttttttctcaaactaatcaaagctcgctgagtgcagcctgtagggggcaacaaatcaacacctctctgccagcccatttctcaacccggcagctttcccagccaaagagttaaggtctaggctgaggagatttgccccagaacaaagactttttcaaagaagcagctgcattcatttcctttttatctcacctggcaggagaaatggcctgggacatatgtaggccagagtggtctctggagcgccaacccaaggatctcactaattttgtggggtaagggtagaaggaaatgactaaatttataatccaaatggttaagtgtctttaactgaaccattttgatataatttttgaaaaaataagcaatggccatgaattaattttttataaccaagagataaaggaatctttcaaaaatagcacagcagctgggcgtggtggctcaagcctgtaatctcagcactttgggaggccaaagcgggcggatcacgaggtcatgagatcgagaccatcctggctaacacggtgaaaccccgtttctattaaaaatacaaaaaaatgggccaggcacagtggctcacttctgtaatcccagcactttgggaggccaagacaggcagatcacgaggtcaggagatcgagaccatcctggctaacacgatgaaaccccttccctactaaaaatacaaaaaaattagctgggcgtggtggcgggtgcctgtagtcccagctactggggagactgaggcaggagaatggcgtgaacctgggaggcggagcttgcagtgagccgagatcttgccactgcactccagcttgggcgacagagcgagactcaaaaaacaaacaaacaaacaaaattagccaggcgtcgtggcaggcgcctatcgttccagctacttgggaggctgaggcaggagaacggtgtgaacccgggaggcggagcttgcagtgagctgacatcgcgccactgcactccagcttgggcgacagagcaagactccgtctcaaaaaaaataaaaataaaaaataaaaaataaaaatagcacaccagggccaggcacagcggctcacgcctgtaatccctgcactttgggaggcataggcgggtggatcacaaggtcaggagatggagaccatcctggccaacatgatgaaaccccgtctctactaaaaatacaaaaattagccaggcatggtgggatgtgcttgtagtcccagctactcaggaggctgacgcaggagaatcgcttgaaccagggaggcggaggttgcagtgagccgagattgtgccactgaacggcctgggtgaaagagaaagactctgtctcaaaaacaaaacaaaacaaaacaaaaaaaccacactaggtatgtggattgtatgtttatatatttaattatatatatatatatttttgagacggagtctcgctctttctcttttgcccaggctggagtgcagtggcgcaatcttggctcactgcaagctctgcctcctgggttcatgggactacgggcgccagccaccacgcccagctaacttttttgtatttttaatagagacggggtttcgctgtgttagccaggatggtcttgatctcctgacctcgtgatccacccgcctcagcctcccaaagtgtacctgtttgtcttttttaaaaaagattgcaaatgaggctcggtgggaggccgaggtgggcagatcacctgaggtcaggagttccagactagcctggccaacatggtgaaaactgtctctactgaaaatacaaaaattagccgggcgtagtggccagtgcctgtaaccccagctactcgggaggctgaggctgaagaatcgcttgagcagaggaggcagaggctgcagtgagccaaggtcatgccactgcactctggcccgggcgatagagcaagactccgtctcaaaaaaaaaattatatagacacatatatatacataaaataataataataggcccggcgcggtggcttatgtgagtctgtaatcccagcactttggagggctgaggcgggtggatcacccgaagtcaggagttcgaaaccagccagcctgaccaacatggtgaaaccctgcctctactaaaaatacagaattagctgggcatggtagccggcgcctgtaatcccagctacttgggaggccgaggcaggagaatcgcttgaacctgggaggcggaggttgcagtgagctgagatagcatcattgcactccagcctgggcaacaagagcaaaactccgtctcaaaaaataaaataaaataaaaataatagtaataaaaagtaaaaaaatagaaaaagattacaaatcaaggcttgcttaatgtaataaagactttctcaagaaaaattaaagtgcattatcctttcctctccttccccttaggaaaacagtatttatcgaacatttactatacaacaagcacttaggaagcatttacacaacatatttggacacttaattcccacaaccctatgataagagcactattatttcgggtaacctgcccaaggtcaccaagagggtgactaggccaggaatgaaggccagtctgtccagttctgagttcgctctcggactttctgctgtagaaacccggtggggtaacagcagctgtacctgcggaagaaggacaaagctcaagaaacttccagaagtgacccaggctgggttctgaaagatgaacatgccttcacgaggtaggaaaagggaggaaaccactcatgcaaaaagcatggctgttacaccaccaaatctcttcggttttttttttcccttcaatgtgggggtggaaatttaagtgtagatttggggcgcctcagaggcctgtggctcgcccaacatccccttgcctctctgcttggccacctctcctctcagctcccctttgttccctgcaccccactttccctaccccctaatccgtccccgggataaaagcaatgcaggcgatgcccacaggaaaccggcaggaggagctgggtgacagggaagagcgacccggagagtcacatccacgtgagttcgccctcttttcacactctagcgcccattctgtccttcctgctggattctggctcaggagaagagcgccgccaggaccccaggaagctgcagacaggagccgctgacacctccacctcacgcggacgccacctagtgtgaccattaccagccactgcgcctgcgcagactcgggttttctgtgcgcgccagaggggcggggcctgggccgggaaggggcagaagtagaccggcggctgggccgccattcaccaatagaaaagagagatcgagagccacgtgctcataagatatccaatcacaatcacatcctgtggcggcggattggggggcgtggactagaggttgatcgggttgggcacacagcatcacgtgacacgaaaaggtaaataaggccacgtggctttttctccttggcttcggcgaaacattacgtcacactaccgtctctgaacaattatttaatgaacttatgtgatgcgctagacaatgtgaagacaatgcggttgctagaaattgtaatctctccatcaaattactctgtccagcttatttccttgtttcttcattcaaatcatcctagacattcaactagttttccgtatcctactttcatacaaatgctcatttaaagataattaagggaatttattctctctttcccaagccttgataatgaaaaagaggtaggttattttgttgttggttttttgttttcttttttcttttttttttttttttgagacagggtctcattctatcacccaggccagagtgcagtctcactgcagcctcaaccttctgggctcaggtgatactcccatctcagcctcccgagtagctgggactacagccatgcaacaccttgctgattttttgtagagacgggatttcaccgtgttgtccaggctggactcaagcaagcctcagcttctcaaagtgctgggatttacaggcctgagctaccacgcccggcccaagagagatttttacatcagaggatatctttagagcctttagtagccctgtgactgctctctctctctcgtttgttctgtcatctaaataaataaataaataaataagaagaagtaagcaccattttcctaaaagcccacttttcttccatccaacagggacttgcaatttctttccactgaagaaatattttttatggccttcacagttcgttgaagattaaggccaggtctaacttgattttgcatcccttgaaattcttcatagcacaatatgcaaagaagggttcttcggtttatgcttgttgaatttgaatttgagaatagtcccattcttgcctgccaaagaattaaaaagacttaaaaagaattaattttaattaaaaagaattaaaaagatagcacttctctgaattatctggatttgggttccaaggtcagctatgccacccaggaattagtgacttttggcaatccattgcatctttaagccagtttcctcatccatcagatgtggatataacagtacctacaactatagaacttcaaggatgacaagataattgtgcaaaagacatgacaccgtctggagcatacagcataatatatacaaggatgccagtttgaagagtagggaagaaagtctcagagcagactgaattgtagacagatactaacactaaatcattgtcttgtggccagccccgaatacattgtatcctcagcattttgtgtggtgcctggcccagagtaagtgttcaataaataatcattgaatggatgaataaaatgagggaccgggcgtggtggctcacgcctgtaatcccagcactttgggaggccaagtcgggcagatcacgaggtcaggagatcgagaacatcctggccaacatagtgaaaccctgtctctaaaatacaaaaaattagctgggcgtggtggtgcgtgcctatagtcccagctactcaggaggctgaggcaggggaatctcttgaacccgggaggcagaggttacagtgagccgagattgcgccactacactccagcctggtgacagagtgagaatctgtctcaaaaaaaaaattataaataaataaataaatgagggagaaattatgccaaaagataagtccacacacactcccttcttcaaatggaaggtcttctattgcccaccacatacccagaagtggtggctgttctgtcagtttccagtggtctgaaactgcttaatggtgccttttgatagtggacagagtctcactgtgtcacccaggctggagtgcagtggtgttatcttggctcactgcaacctcttcctcccaggttcaagtgattcttctgtctcagcctcctgagtagctgggattacaggtgcacgctaccatgcccagctaaattttgtattttttagtagagatgaggttttgccatgttggccaggctggtctcgaactcctgacctgaggtgatctgccctcttcggcttcccaaagtactgggattacaggcgtgagccaccatgcctggcctcaactttgcttttctgcttcagttcccttctctgcctctccccacttgctctggtgaatttcttttttttttttctttctttggccgagtatcactctgtcacccacgctggagtgcagtggtgtgatctcagctcactacaacctcagcctccctggtttaagccattctcctgcgtcagcctcctgagtagttgggattacaggcctatgccaccatactcggctaatttttgtattttttagtagagacagggttttgccatgttggccaggctggtctcaaactcctggcctcaagtgatctgcccacctagacttctcaaagtcctgggattacaggcgtgagccactgtccctggcttagttctggtgaatttcaatgtaaatgtagtcataaatactcatagaggaattgggctgaagtgacttagtggttaaaagcttgggcactgccaccagacagacctggccaaatcctgattttgccatttgtgtgatcttggacaaatgacttaacttctctgaatttttagttccacatccatgaaatgggagcaaaaatatcaatatcacagagctggtttgaacatttaatgagatgagatgtggaaaactccgaacaaggaagtatgcagtaagtgctccagaaatgcaagctgttattggttttttgttttgttttgttttgttttgttttgtttgtgttttgtgtgtgtgtttgtttgagatagtgtctctctctgtcactcaggctggagtgcagtggcgtgatcacagctcactgcagcctccaactcctgggctcaggggatccttccacttcagcctccctagtagcttgaaacagggtctcactctttcacccaggctggagtgcagtggtgtgatcatagctcactgcagcctcaaactcccgggatcaagagatcctcctgcctcagcctcttgagtagctacgatcataggcgcgtgccgccatgctcggcttgttaatgtttattatatttcatgactacagtgtcaaaattagcctgtagagtgtggtgaagtcttttatttagaaaagaaagtcgtggccgtgtgcggtggctcacgcctgtaatcccagcactttgggaggccgaggcgggcggatcacgaggtcaggagatcgagaccatcctggctaacacggtgaaaccccgtctctactgaaaatacaaaaaattagctgggcgtggtggcaggagcctgtaaacccagctactcgggaagctgaggcaggagaatggcgtgaacctgggaggcagagcttgcagtgagccgagattgcagcactgcactccagcctgggcgacagagcgagactccatctcaaacaaaaaaaaaaaagaaagtcattgtagaaaaatggtttaatacagttgaaaatggaggcagaatcatgagacgggggcaaggtctggctcaaactaaagcctaccacttcaggcagggaagggcagtggttcagcatgtgttttctgttgttagacttgccgagttcaaattccttctctgctgcttactagatgatagcattggaaaagtgacctctcctattgagcctcagcttaggaaaataagatttgctaatagcgccaatacctcacagggctgtcaagaggatttatggacacacagtcctggtacagagtaaataatcagtagatggtgatcgttaatcattactcaggtttcaaggtgcttgcttgcttcctggaagtgtctttctaattcaacttagcttccaaggctggaagaaatgatactcacaaaagactaggcagagtagccaggcgcggcggctcatgcatgtaatcccaacactttgcgaggccgagccaggcagatcacttaagctgaggagtttgagaccagccagggcaacatggcgaaactctgtctctacaaaaaatacaaaaattagccaggcatggtggtgcatgcctatggtcccagctactcgggaggatgaggcgggaggattgcttgagcccgggaggcggaggttgcagtgaggcaaggtggcatcactgcactccagcctgggccacagagcaagactccacctagaaaaaataaatacataaaaataaaagagtaggcagagacctagtttatagacagagaataaaacaatatccaaacatgaggtctttcaacaaggtgctttattggagagtacagtgtgagatgaggcagatagaggtgatgcttttgagaggtgatattcaactctgacaatacttcttggtgtccaggttcttgtgtgccttgttatatggagcttttgaaaagcagatggcagcgttgcggtcgcagttgcaaatgaaggcctcacactctttgtttttgcctggagagggatgaaaggagaggactgagccaaggtggaccctgttttgtacaatctggggcaagaagaattaactggaataagctggcagccattccactgatgcacatttagggctgacagattaagtgaatacaagtacatcaggatgcccagttaaatttgactttcagataaacaatgaatgcaatatttgggacatataccccccaaaaaattatccattgcttatctgaaagtcatatttatctgggcatcctgtgtttttttgttttgttttgtttttaagacggagtttcccttttgtcgcctaggctggagtgcagtggcgtgatctcagctcactgcaacttctgcctcctgagttcaagtgatactcctgcctcagactcctgagtagctgggactacaggtgctcgccaccatgcccagctaatttttgtatttttattagagagggtgtttcatcatgttgtccaggctggtctcaaactccggacctcaagtgatccatttgcctcggcctcccaaagtgctgggatacaggcgtgagccaccatgcccaacctagtttctctactttaaagcatgtattttaaaaattatggaacatccttaaatggaatactacatagacatttagaaaaattaggtatgcctgcacatggaaattttcccaaataaaaaaagctagtgtatgccccaaaaatctggaggaatatgtaactggttatctttgggtagtaggattatagatgccttccactttccataatagatatttatgtagcgtttgaagttgcattacttttggcttgtttacttttataaccaaaataaacaataagattacagttaaaatgcatttaaactttattacatataatttacgtatctctgcttaccttcaggaatcttattagttttgtttctctccgatcctttattttatttatttatttttttgagatagagtctcgctgtgtcgcccaggctggagtgcagtggtgggatctcggctcactgcaacctctgcctcccaggttcaagcaattctcttgcctcagcctcccgagtagctgggactacaggcatgcatcactacacccagctaatttttgtatttttagtagagatagggtttcaccatattgaccaggctggtctcgaacttctcacctcaagtgatccacccaccttggacttccaaagtactgtggttacaggcttgagtcactgtgcccaactgagttatttttaattaatatgaacaaacatcctctaatgcaggtttcttgtcttagttgcaaacattaaaaaaaaactgtgtgtgagtgtgtgtgtgtgtgtgtatttctctggggagagggttcatagctttcatcagatttgtaaatttggccttctaaagtggagcaggaggatgtataagcaaattaagccatattattcagtgactaaaatagtaacaatgaaaaaacagtaacaataaaggtttgaggcaatatgaaaaagtcataacaaggtgataagtgaaaaagcagaatgcaagattgtatttattctgcaaagttgtcaagattgttttaaaaaaagaaaaagaaagtttatatctaggctgtgcattcatcaattatttattgagcacctactatatgtcagacactgctctagatctggggatatagcaataaagaaaatagacagtaatcggccaggcacagtgactcacgcctataattccagcactttgggagactgaggcaggcagatcacttgaggtcaggagtttgagaccagcctgggcaacatggtaaaaccccatctctgctaaaaatacaaaaaattagccaagcatggtggtgcacgcttgtaattccagctactcaggaggcttaggcaggagaatcgcttgaacccgggaggcagaggttgcagtgagctgaacggaggttgaggtgatgaagtgagactctgtctcaaaaaagaaaggaagaaaataggcagtaatccctgttctgtggatcttacattctattggaaagatggaatgtaaagaaataagtagccgcacatggtggctcacccctgtaatcccagcactttgggatgccaaggtaggaggattgcttgaagccaggagtttaagacaagcctggccaacgtagtaagacccagtctctacaaaaaaatttttttaattagccaggcgtggtggtgcacgctcgtagtcccagctacttgggaggctgaggtcagcagatcccttgagctcaggaggttgaggctgcagtgacctatggttgcaccactgtgctcatgcctgggtgacagagcaagaccctgtctctaaacaacaacaaaaaaaaacccaaactgtcaccacttacaagctgtgtgatcttgggcaaatagctcagccttctgagcctcagttttcttatctgttaagtgaggataattgtacctatcccatagtgttgttctgaggattaaaggagacactgcccagaaccaagaaaattaacactaaatcatggctgttgttactattatttccccccggcctactgagaaccaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcctgcactatggagctaccgtgttcatatattgtgggagttttaacctaaaaatcatttcctcagaaaactgttccctgacctgctgaactatgtcagccctgttattaaaatctttttttgggacaggcgtggtggctcacacctgcaatcagcactttgggaggccaaggcagatgaatcacctgaggtcaggagatcaagaccagcctggccaatatggtgaaactcccccgtctctactaaaaatacaaaaattagccaggtgtggtggcacacacctgtaatcccagctactcgggaggctgagggaggagaatcactcaaacccaggaggtggaggttgcagtgagctgagatcgcaccattgcactccagcctgggcaacagaacaagactccgtctcaaaaaataaaaataaaaataaataaaatcttttttttagcattctagaagcactcatcatgattataattaaataatttctggccgggcacggtggctcatgcctgtaatcccagcactttgggaggctgaggcgggtggatcacgaggtcaggagatcgagaccatcctggctaacatggtgaaaccccatctctactaaaaatatataaaaaaaaaaaattagccaggtgtggtggcgggcgtctgtagtcccagctactcaggaggctgaggcaggagaatggcatgaacccaggaggcagagcttgcagtgagccgagatcatgccactgcactccagcctgggtgacagagtgagactcctctcaaaaaaataaaaaataaaataataataataataataataataattccggccaggcacagtggctcatgcctgtaatcccagcattttgggaggctgaggtgggcagatcacgaggtcaagagttagagaccatcctggacaacatggtgaaaccccgtttctactaaaaatacaaaaattagctgggcgtggtggcgcatgcctgcagtcccagctactcgggaggctgaggcaggagaatggcgtgaacccgggaagtggagcttgcagtgagccgagattgcgccactgcactccagcctggtgacagagcgagactctgtctcaaaaatagtaataataatcattcctattaacttgttatttgtgtttgtctcctactagactgtaggcttcagaaaggtggagaccatttgctcattgttctatcccagtgctggcatacaacaggtgctcaataaagatgtgttgggtgaataacatttattaagcacacacttaatgaattagccttagcactgcattaactaaagttgggaagaaagaggttaagagaaaaaaagcagccgggcatggtggctcacacatgtaattccagcactttgggaggccaaggtgggtggatcacctgaggtcaggagttcaacaccagcctggccaacatggcgaaaccccgtctctactaaaaatacaaaaattaccggccaggcgcggtggctcacgcggctcctagcactttgggaggctgaggcaggtggatcacctgaggtccgcagttcgagaccagcctgaccaacatggagaaaccccatctctactaaaaatacaaaattagccgggcgtggtggcgcatgcctgtaatcccagctactcgggaggctgaggcaggagaatggcttgaacccgggaggcggaggttgctatgagccgagattgcgccattgcactccagcctgggcaaaaagagcgaaactctgtctcaaaaaaaaagaaaaaaaaaattacctgggcatggtggcacatgcctgtcatcccagctactaggggagctgaggcaggaggatcgtttgaacctgggaggcttgcagtgagccaagatcgtgccactgcactccagcctgggcaacagagtgagactctgtctcaaaaaaaaaaaaaaaaagagagagagagaataaaagcagatctagaagagtcagttccagagcttataatatacgtgtggacattttctttacaaaaccaatagttggtcattgtgggaaaacgtctcaaaaactcgaataaatggacaagcacagtggctcacacctgtaatcctagcacttgggaggctgaggcaggaggatcacttgagctcaggagttccagaccagcctgggcaacatagtaagacctcttctttatttttattttattttttattggatttcctttcagattcagacctacagatatcttttaaaataaaaaacttattttaaaatgaataaactaagatgaaaattaaaattatccataatccaaaactaaaagaatgaccagttgtagattttccagagcgttcttttacacacaaaaaacatacacatatatgtttttagatataaaacattaaatatatatttgaatatttttgcacactgttttgaaacttggttttctcatttacccatttatcactactttgttttttgtttggggttttttttttttttttttgggatagggtctccctctgtcacccagagctggagtacagtggtgcaaacacggcttactgcagcctcgacctcccaggctcaagtgaccctcccacctcagcctcctgagtagctgggactacaggtgtgcaccaccacatctagttattttttttaattttttgtagagctgggggcctccctatgttgtccagcctgttcttgaactcctaggctcaatcagtcctccagtcttggcctcccaaagaggtagaattacaagcatgagccactgtggccagtccagtgtgatcatcttttcatggcatttaacattcttctgaaacatcaattccttgggtaaaacagcattgcatcatataattgtaccaggatttacttagccaatctcctgataaaatttagttagttacaaattttcactataatcagcaatgctaggacaacatccttatagttaaatctcggaacacttccttaatgatttcctgcagatcagttcttaaggagtggaagtgtgaggttaagtgtcgcgttagtccgtttactatgtgttgacaaagtgtggtctataactgctgtatctagataaatatatcatgtatatttcatgagtactgagttgacatgcaacactgtagggtggtcccaggcataattctcccaaatgtagtgtgactaactgccactggtggaatgagaggttgtagctagtacaaagatttattattttatttgtattttttgcagacacagagaggtctcactttgttgcccaactggtctcaaactcctgggctcaaggaatcctcccacctcgacctcccaaagtgctgggattacacacatgagccaccatgcccagctcagttttttttttttcttcttttcaagacagagtctcgctctgtcgcccaggctagagtgcagtggcgcgatctcggctcaccgcaagctccaccccccgggttcacgccattctcctgtctcagcctcccgagtagctgggactacaggcgcctgccaccacgcctggctaattttttgtattttcagtagagacggggtttcaccgtgttagccagtatggtctcgatctcctgacctcgtgatctgcccgcctcggcctcccaaagtgctaggattacaggcgtgagccaccgcgcccggccagattccttattttaatagttacatatttatgtgttagaaaattatctaattagcacataaaacctgtgatggctccaatattatttatttatttattttatttattttaatttttgagacggaatctcgctttgtcaccaggctggagtgcggtggcacaatcttggcttactgcaacctccgcctcccgggttcaagtgattctcctgcctcagcctcccgagtagctgcgactacaggcacccaccaccatgcctggctagcttttgtatttttagtagagatggggtttcaccatgttggccaggatggtctcgatctcttgacttcataatccacctccctcggcttcccaatgtgctgggattacaggcatgagccaccgcgcctggcccagctccaatattattgtttaggataaagataaggtttttttgtttgtttgtttgttttaaagtgggtccacttaaagaaaactatgtagggacgggcacagtggctcacgcccataatcccagcattgtgagagtctgagggctgaggagggtggatcacctgcggtcaggagttcaagaccagcctagccaacatggcaaaacgccatctctattaaaaatacaaaaattagccagtgtggtggtgcaggccccgtagtcccagctacttaggaggctgacgtgggaggatcacttgagcctgggaggcggatgttgcagtgaaccgagattatgccactgcactccagcctgggcgacacagcaagacttcatctcaaaaaaaaaaaagaagatttgagctagaattccagttttcctcagttcccatttggggatcctgggagagtctctcagcctcagttttctcatctgtgagatggggatattgagaattcttctccatatggcatgcctgcctggaagggcttataaacaaagaattgtgtctgggcatggtggttcatgcctataatcccaatacttagggaagccgaggtgggcagatcacttgaggtcaggagttcgagaccagcctggccatcatggtgaaaccccgtccctactaaaaacacaaaaattaactgggtgtggtggcgtgcacctgtaattccagctacttgggaggctgaggcaggtagaatcacttgaactcaggagacagaggttgcagtaagctgagactgggccactgcactccagcctgggcaacagagtgagactcccatctcaaaaaaaaaaaaaaaaaaaaaaaagttaaagaaaacaaagaattataaggtcaaaaaggatctcaagagattcttcaaccttttctcaggtgaagggggctggatttccaccttcatcctcctctctatcacctaaggaccccatatgttgaccgggtgtccacctggaagtcatcctctgttcctccccgtcctcgctttccacacccagttctgcctgtccatctgcaaagtgtagcccaattcccacccccaccccctcattttcacctctgcaattatatctctaggtgcagccacgcactaccctctcttgcctgggattactgcatgaacctccaaactggacctctattgtcaattttctacccagaagccaataagccaatgttatctttttaaaaaaatttttttgagatggagtcttgctgtatcacccaggctggaatgcaatggcgcaatcttgactcactgcaaccatcacctcccaggttcaagccattctcctgcttcagcctcccaagtagctgggactacaggcacgctatcacgcccggctaatttttcttatttttagtagagacagggttttgccatgttgcccaggctggttctgaactcctaaccttgggtgatccacccccctcggcctcccaaagtgctgggattacaggcgtgagccacggcaccagcctaatgttattttattttattttatttatttatttatttcgagacggagtctcactctgtcgtccaggctggagtgcagtggtatgatctcggctcactgcaacctccgcctcccaggttcaagtgattctcctgcctcagcctactgggtagctgtgattacagtcacacgacacaacacctggataattttttgtatttttagtagagacagtgtctcaccatgttggccagtctggtcttgaactcctgacctctggagatccgcccccctcggcctcccaaagtgctgggattacaggcgtgagtacccggcaatgttatggtttttttgttttttttttttagtatttattgatcattcttgggtgtttcccagagagggggaagtggcagggtcataggataatagtggagagaaggtcagcagataaacacgtgaacaaaggtctctggttttcctaggcagaggtccctgcggccttcggccttcagcagtgtttgtgtccctgggtacttgagattagggagtggtgatgactcttaaggagcatgctgccttcaagcatctgtttaacaaagcacatcttgcaccgcccttaatgcatttaaccctgagttgacacagcacatgtttcagagagtacggggttgggggtaaggttatagattaacagcatcccaaggcagaagaatttttcttagtacagaacaaaatggtgtctcctatgtctgcttctttctacacagacacagtaacaatctgatctctctttcttttccccacatttcccccttttcttttcgacaaaaccgccatcgtcatcatggccctttctcgatggtcgctgtctcttcggagctgttgggtacacttcccaggcggggcggcctggcagaggcgctcctcacctcccagaaggggtggtggctgggcagaggcgcccctcacatcccagacgatgggcagccgggcagaggcgccccccacctccctgatggggcagccgggcagaaacgccccccacctcccagacggggtgtccgggcagaggcgccccccacctcccagatgaagggcggccaggcagaggtgctccccacctcccagacgggggagccgggcagagacgcccctcacctcccagacggggtggctgggcagaggcgcccacttcacagacggggcggccgggtagaggcactcctcccagatggggtggcggccgggcagaggtgctcctcacatcccagacagggtggcggccaggcagaggcgctcctcacctcccagacggggtggtggccgggcagaagcgctcctcacctcccagacggggtggcggcagggcagaggcgctcctcgcctcccagacagggtggcagccgggcagaggggctcctcgcttcccagacggggcggccaggcagaggtgctcctcgcttcccagacggggcggccgggcagaggctgtaatcttagcactttgggaggccaaggcaggcggctggaaggtggaggttgcagcgagccgagatcacgccactgcattccagcctgggcaacactgagcactgagtgaccgagactccgtctgcaatcccagtaccccaggaggccgaggcgggcagaccactcgaggtcaggagccagagaccagcccagtcaacagggcgaaaccgtgtctcctccaaatatacaaaaaccagtcaggcgtggcggcgcgtgcccgcaatcccaggcactcggcaggccaaggcaggagaaccaggggagcccggggcagggaggctgcagcgagccgagaccacggcagtacagtccagccttggcaacagaaggagaccgaagaaagaaagagggagcgggtgagggggagggggagggggatgggggagggggagggagctgttatgttttttttttaaaaatcaactttattgggctaagtgcagtggctcatgcctgtaatcctagcactttgggatcttgacatagctgatctcagatcttggcatagctgttcacgtgccacctctgtgggtcctgaacattttatctaaagtctccccgtaccccaccaaatcagactccttaccctggtatttgttgaggttcaccttctgccattatattctgcgtttatttgtgtacttgtttattatttgtctctgcctcccccattaaaatgtcagggctatgagaacagggactatgtctgtcttgtttgctgcttgttcaccagcatctggaatggtaggtttgagtaactatttttgaacgaatgaaagactggcaacatggagatgccaggagatgagtgagctgggctgcataattagttgtagcatcaggatgaaaaccccaatctcctggcccccagcccaaacctctctcctccttctcaggccattcacagatcttcccaggactgacacacaagacagtacaggggtcttaactgcagtggttttttttttttttttttttttttttttgagacggactctcctctgtcgcccaggctagagtgcagtagcgcgatctcagctcactgcaagctccacccctcgagttcacaccattctcctgtctcagcctcccgagtagctgggactacaggcgcccaccaccattcccggctaattttttttttgtatttttagtagagacggggtttcaccgtgttagccaggatggtctcaatcttctgacctcgtgatctgcccgtctcagcctcccaaagtgctgggattacaggcatgagccaccatgcccggcccgtttttttgtttgtttgtttgttttccccaagatggagtcttgctctgttgcccagagctggagtgcaatggcacaatctcggctcactgcaacctccgcctcctaggttcaagcaattctcctgcctcagcatcccgagtagctgggattacaggcgtgagccaccacacccgggtaatttttgtatttttagtagagatggggtttcaccaagttggccaggctggtatcgaactcctgacctcgtgatccacctgcctcggactcccaaaatgttgagattacaggcgtgagccaccatgcccagccgcagtgctgtttttaagagcatgagactggaaacgccctaaatgcccatccccagggctctgttcaactcactcacacacagccttacaacccgcctttcttctcgcccccgtaatccaccaccgggggcttccctgtaccctagtcgtcacagccctccatgagctagcttacttcccattcgcacgaatcgctccacgggtttccaatctcccgtgcggatctcgatagcggtatcccccgttcacaccgttctgaactgtctggtcgcgtgttgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttttttttttggtctcgtccgtctgtggggggtgttgccgccccccgccggtctcgggttgggtctggcggctccggcctaaagtacccacactttgggaggcctaggcgggcggatccccaggtcaaaaaaacgaggccattctggctaacatggtgaaaccccatctctactaaaaatacaaaaaattagccggccgtggtggcgggcgcctgtagtcccagctactcgggaggctgaggcaggagaatggcgtgaacccgggaggcggagcttgcagtgagccgagatagcaccactgcactccaacctgggcaacgagcgagactccgtctcaaaaaaaaaaaagagacagggtcttggccaggcgtggtggctcttacctggagtgcagtggcatgatcatagctcactgcagcctcgaactcctaggctcaagcaatcctcctgccttagtcttccaaagtgctgggactacaggtgtgagccaccacaaccagcctcatttttctccttttagttctagtcagccatcagattatgttgattttcttctcttaaaagaacccctgtggccaggcatggtggctcacaccttgtaatcccagcactttgggagcgtaaagcaagagaatcgcttgagctcaggagttccagaccagtctgggtagacagcaagacgctctctctacaaaaaaaatttttttggcttgtctttgttttttgagacggggtcttgctctgtcgcccaggctggagtgcaatggcgcgatctcggctcactgcaacctccgcctcctgggcttaagcgattctcctgcctcagcctcccgagcagctgggattacaggcgcctgccaccacgcccagctaatttttgtgatctgcccacctcggcctcccaaagtgctgagactacagacgtgagccaccacgcctagccaaaaaaaattttttaattagctggagttctaattaccaaggagttctaggttacagggagttatgatggcaccattgcactctagcctgggtgtcagaaccagaccctgtctaaaaaagaaaaaaaggccaggccgggcacggtgactcacacctgtaatcccagcaatttgggaggccaagatgggtggatcagttgaggtcaggagtttgagacccgcctggccaacatggtgataccctgtctctacaaaaatacaaaaaaattagccgggtgtggtggtgcacacctgtaattccagctactcaggaggttgagacaggagaattgcttgaacccaggatgtagaggttacagtgagccaagatcatgccattgtactccagcctaggtgacagagcaagacttcatctcaaaaaaaaaaaaaaaaaaagaaagcgggcacagtggctcatgcctgtaatcccagcactttgggaggccaaggcaggcagatcacctgaggtcaggagtttgagaccagcctggcccaacacggtgaaacccagtctctaccaaaaatacaaaaattagccgggcatggtggtgcatgcctgtaatcccagctactcaggaggctgaggcaggagaatcggttgaacccgggaggtggaggttgcagtgagccaagatctcaccactgctctccagcctaggcgacagagtgagactctgtctcaaaaaaaaaaaaaaaagaaaagaaaaaaaggcccctgtgaaatgtcaagaagtcctggattgttttaaaatgcttaagaagagacagaatggataaagtagacatgacaaaatcttgataaaaccttggaatctgggtgatggtatatgagaattcattatacaattctctttacttttgtgaagtttgaaattttcattattaaaagaacagattttcttcatgaaaaaaattgtgagttttttttgagacagagtttcactcttgtcgcccaggctggagggcaatggcacaacagtcttggctcaccgcaacctccgcctcccaggttcaagcgattctcctgcctcagcctcccgagtagctgggattacaggcatgtgccaccatgcccggctaattttttgttgttcttgtacttttagtagtgacagggtttctccatgttggtcaggctggtcttgactcccgacctcaggttatccacccgcttcggcatcccaaagtgctgagatgacaggcatgagccaccacgcccggcggaaaaaattgttttaatgaatccataagcatcattaactcaaattccctggataccaccttagtctaggtctttcaggctgacctccctgacctgctctttttaatcctgtttagccttcctcaaatgctatttttatcatgttgcttgcttgctcagaaaccactaataaacccctttggtgtctcacagcagacccaactgcactgcctgattttcaaatgtaaccatgatttgggcctaactttcccagacaatctggtttctgcaagtcccaggtccaaacctctacagaggccaggccagactcctctgggatctacaacttcccttcatttggaaagccctgtttcccgctcttgcctagacaaacctgagccaatctcaagccccctgtacccataaaagctttcttggggcaggcgctgtggctcacgcctgtaatcccagcgctttgggaggccgaggcaggcggatcacgaggtcaggagtgagttcgagaccagcctggccaacatgatgaaaccctacctctactacaaatacaaaaaattagctgggggtggtggcaggcacctgtaatcccaactacttgggaggctgaggcaggagaatcacttgaacccaggaggcggaggttgcagtgagccgagaccgtgccactgcactccagcctgggcaacaagaacaagactgtgtttcaaaaaaaaaaaaaaaaaaaagctttcttgggccaggcatggtggctcacacctgtaatcccaacactttggaagatcaaggcaggaggagggcttgagcttaggagttcgagaccagactaggcaacacagcaagatcctgtctctatttaaaaaaaaaaattttttttttaaaaagctttctcaactgattattccaatctttactaaatctgtttatttgaacatgcacagcatataaatcaagaaccacacaatttcacaatcatgcgttgtcatttatcattaattatgtgcttttctttgtttgtttgcttggttgttttttgagaaggagtttcgttcttgttgcccaggctggagtgcaatggtgcgatttcagctcattacaacctctgcctcccgggttcaaatgattctcctgtctcagcctcctgagtagctgggattataggcatgcaccaccatgcctggctaattttgtatttttagtagagacagggtttcactgtgttggtcaggctggtcttgaactcctgacctcaggtgatcccctgcctcggcctcccaaagtgctcggattacaggcgtgagccaccgtgcccggccaattatgttatttttgtgtcttcccaaatattacaaagttcttgcatataaagtgggccatgttttatactttggtttttgtttgttgtttgagacaatctccctctgtcgcccaggctggagtgcaatggcacgatcttggctcactgcaacctctgccacccatgttcatgcaattctcctgcctcagcctcccgagtagctgggactataggcgcccgccaccacgcctggccgatcttttatttttagtagagactgggtttcgacatattggccaggctggtctcaaactcctgagctcaagtgatccgccccctcagcctctcaaaatgctgggattataggtgtgagccactgagcccagcctatactttggttctgaccactaagaagcacagtagttagtgttataatgtactacatagtgtaacgtatgtacaccatacattctaggcacccagtaaatatttcagcattggcagactgacttcagccctcagaggagcctctctagggcttaaagaaataagtctccaattagctacaattattgccagacccataagcatgataccctcccatgtatctgttccctcattattgattgagttctgactactgcccggctacgttatggtctatgtatctagccatcctaggcattggaaacccagcagtttatagcacatgctattggtgttcagctcatattttcctcagaacatgctaaaggccacgttcgaacagtttcctttctttttgtttttttattgagatagagtctcactctgttgtccaggctggagtgcagtggcacaatcttggctcactgcaacctctgcctcccaggttcaggcgactctcgtgcctcagcctcccaaatagctgagactacaggcgtgcgccactatgcccaggtaattttttgtatttttagtagagatggggtttcaccgtgtgggccaggatggtctcgaactcctgacctcaagtgatctgcctgcctctgcctcccaaagtgctgggattacaagcatgagccaccgcacccgtcccagtttcctttctctgtttttttgtttgttttttttttttgacggagttttgttcttgttgcccaggctgcaggctggagtacaatggcacaatctcggctcaccgcaacctccgcctcttgggttcaagctattctcctgtctaagcctcccgagtcgctaggattacaggcatgcaccaccacgcccagctaattttgtatttttagtagagacagggtttctccatgttggtcaggctggtctcgaactcctgacctcaggtgatccgcccaactcagcctcccaaagtgctgggattacaggcgcgagccaccgtgcccagccaatttcctttcttaaaaaaattttttgtagagacggagtctggctgtgttacccaggcaggtcttgatctcctggcctcaagtaatcctcctgcttcagcctcctgagttgctgggatgacagatatgaaccacagcaccctggtggacacaattttctttctttcttttttttttttttttgagacggagtctcgctctgtcacccaggctggagtgcagtggcgcgatctcggctcaccacaagctccacctcccaggttcacgccattctcctgcctcagcctcccgagtagctgggactacaggcgtccgccaccgcgcccagctaattttttgtatttttagtagagacggggtttcaccatgttagccaggatggtctcgatcaactgacctcgtgatccgcctgcctcagcctcccaaagtgttgggattacaggcgtgagccgccgcgcccagcctacacaattttcttacaagcagtttcctgtgtctctcttgcctcagatgttctctgcccacggaagcctccttgggaggagcagagtcaaaatgttagggaattaattcccctagagtgatcctggacccatgagggatgagagatggtgaataaataccctagcttcaaggccaagcacagtggctcacactagtcatcccagcactttgagatgccaaggcaggaggatcacatgagcccaggagttcgagaccagcctgggcaacatagtaagacttcgtctctacaaaaaataaaaattaaattaaaaattagctgggcacggtggcgtttgcctgtagtcccagctacttaggaggctggggtgaaaggatcacttgagcccaagagattgaggctgaagtgagctataatcacaccaccacatcccagtctgtgtgacagagtgaaagcctgtcatacacacacacacacacacacacacgtgcacacacaaacacaaaagaaaataaaagaaaatcaccctagcttgctcaactttcttttttttttttctttttgagacggagttttgctctgttgcccaggctggggtgtggtggcatgatctcagctcatgatctcagctcactgcaacctctacctcccaggttcaagcgattctcctgcctcagcctcctgagtagctggaattacaggtgcgtgccaccacttccaacagatttttgtatttttagtagagacggggtttcaccatgttgaccagattggtcttgaactcctgacctcaggtaatctgcctgccttggcctcccaaagtgctgggattacaggcgtgagccaccacacccggcctcaactttctttaaaaaaaaaaaaaaatatgtgtatatatatatatatataaaatttactttacttatatagagacagagtctcactgtgtttgccaggttggtcctgaactgttagcctcaagcaatcttcctgcctcagccttccaaagtgctaggattacaggtatgagccactgtgcaccatcctcaacttttttttttctttttttctttttttttgcactgttgcccaggctggagtgtagtggtgcaatctcggctcactgcagcaacctctgcctcccaagagattttcctgcctcagcctcccaagcagctgggattacaggcatgtgccaccacgaccggctaatttttgtatttttagtagaaatggggtttcaccatgttggccaggctggtctcgaactcctgagctcatgtgatctgcccacctcagcctcccaaaatgctgggattacaggcgtgagccactgcgcccggccccagtcctcaagtttcattgagacaaccctcaggcatgtcctagacagttggagggtccctcacaggactgaaccccagtgcccaaggcagtaacccactcattaacacacactttcttggctttcctctctttcctgttttacatccttgctccgtcaatgaatttactggaatcaactgcaaaataaacaacttgctctgaaatccttttctcaaggtctaagactgtggtgatcaagacagccaaggtccctactctcccaaaacaacacacgggtttgcgttcaaaccgtgtacagctcctgcacctgtccatgcatccgtggagctctgtcaggcgccgactccccgccttggtgtgcaaagcatccacattttgggtcaccaaccagtacagctttccgagtttctcccaggtgctcaaagcccagtgtgcagggttaggctggtgggaggagaattgaggccagcctacgaagtttctcgcccagtaccgctggcggattggggcactccggacaaaatcaccatgctggatgggcctgcggtcagtgcgggcataaagccccactttttctgacctgtagtctggtatccccgattcggtggagattcctgccccagtcatcacaaggagtctcttggaaagggtgatgaagcgctgtaactctttgaccttctcagggtccagaggaggacttgctggcacaaataacccaatggaggctttcgagcacggctggctggggtttgcgatccaacggccttttgctgacctgaaagtcaacgcaaagctcatcttcattctagagaaaaagaagcctcatgtgagaaactggggtggttttttttttttctcattttttgtttgtttgttttcgttttgttttttgagacagagtctccctctgttgcccaggctagagtacagtggcatgatcttggctcactgtaaccgccgcctcccgggttcaagtgattctcctgcctcagcctccagaatagctgggactacatggccaccatgcccggctaattattgtatttttagtagaggcagggtttcaccatgttggccaggctagtctcgaactcctgagctctagtgatctgcccgcctcggcctcccaacgtgctggaattacaggtgtgagcctctgagtctggccctaatgagtcaggttttgtttgattttgttcatgtaattaagcacacacacgcattccttttattttttcatttcccccttattttagtttaccctccactgcaagctctgctacttggacacatcagagagacaagacccctgcccgtcagcttttctagctgtaacaatagagggccgggtgcggtggntcacgtntgaaattccagnattttgggaggntgatgcaggcatatcacttgggatcaggagtttgagacatgcttggccaacatggtgaaaccccccccctctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagatttgagttcgactgcaagtagttcattatcttcttggctatctgtgttccatgggaaggatggaaaataacatgtttgagatttaaatgctgctttgacaggttattaagattccaatcactccaggtgcggtggctcacgcctgtaatcccagcactttgggaggctgaggtgggcggatcacgaggtcaggagatcgaaaccatcctgtctaacacagtgaaaccccatctctactaaaaatataaaaaactagccgggcgtggtggcatgtgcttgtattcccagctacttgggaggctgaggcaggagaatggggtgaacccgggaggcggagcttgcagtgagccgagattgtgcccctgcactccagcctgggtgacagagagagactctgtctcaaaaaaaaaaaaaaaaaaaaaaggattccaatcacaatctgcctactctccctgatcgagcgaagtccagaaaggtggcagaatgtctctaaagcagttacacacacacacacacacacacacacacacacaccccaaaaaatgccagaaaagatggaagagtaagaaaatcaggccaacatgaataatttggtaaagtggtgggcggggcggggggtggtggcggtagcaggttttaaaccaagacacttgcatggcagggtatattggtgcagctgactggcataaaattccctgaacagaatttagatacgggtagctcaagtgctgtcaatctcatcttgttctaccataaatcagtagctccaactgagacctctgtgggaggccaggttcttattctctgaaattagagcctacccactgtatgagatttcctaccacagggctagctctgttgcaagcagtagggtactgactctgatttctctaaagtcctttgtaaattttttgtgttttttgagatggagtttcactcttgttgcccaggctggagtgcgatggcgtgatcttagctcaccacaacctccgcctcccaggttcaagcgattctcctgcttcagcctcctgagtagctgggattacaggcatgcgccaccacaccgggctaattttttttatttttagtagagatggggtttctccacgttggtcaggctgatctcgaactcctgacctcaggtgatctgcccgcctcagcctcccaaagcgctgggattacaggcgtgagccaccgtgcccagctgtaaatattcttctaatgacgcaaatttcaccatggtgggcacaagctcgagtccttggctcacacccttgtttccaaggctttgttacgttaaaacatggaggcttctatggtgagggagactggggaatcactgcaggatacagaactagggagttgcaagaattacaggagtcagagcactctgaaactatgcagactgaaatatgtcaaaaatgactgtctttggtatatcacaagggtttgccaaactatagctcatgggccaaatatggctactgtctgtttctgtagataaagttgtggccgggcgcagtggctcacgcttgtaatcccagcactttgggaggccgaggcgggtggatcacgaggtcaggagttcaagaccagcctggccaagatggtgaaaccctgtctccactaaaaatacaaaaattagccgggctcggtggcagccgcctgtaatcccagctactccggaggctgaggctggagaattgcttgaacccaggggatggaggttgcagtgagccaagattgtgccactgcactctagcctggtgacagagcaagactccatctcaaaaaaataataataaaataaaagtaaataaataggccaggcacagtggctcacacctgtaatcccagcactttgggaggccgaggtgggtagatcacgaggtcaggagatcgagaccatcctggctaacacggtgaaaccccgtctccactaaaaatacaaaaaattagccaggcatggtggcaggcgcctgtagtcccagctactcaggaggctgaggcaggagaatggcgtgaacccaggaggctgagcttgcagtgcgctgagactgtgccactgcactccagcctgggcgacagagcaagaccccatctcaataaataaataaataaataaataaataaagttttattgggacatagccttgctcacctattcgtttacacattgtctatggctgtcacaaatgagtggttacaacagagactgtgtgatccccaaagcttaaaatatcgactatttagagtgagactccatcacaaaaaaaaaaaaaaaagaaaaaagaaaagaaagtaattacagaaagtcatatagcaacaaaactctccaggaagggcttaaaatatcgactatttagagtgagactccgtcacaaaaaaaaaaaaaagaaaagaaagtaattacagaaagtcatatagcaacaaaactctccaggaaggtacttattaggatacctgttgaaagaggcagtatgtatcgtagaatgagcatcaactttgaacctagatttgacccatatttctgctttttattgggccgaacaaaccttgcctcacagagttatcagggttaagtgttacgatctaactcagcagtccccaacctttttggcaacagggaccagttttgtggaagacaatttttccacagacaccagggatcagaggggagtgtgatttggggatgaaacttctacctcagatcatcaggcattagattctcataaggagcgtgcaacctagatccctcgtatgcagtttgcaatagggttcgcgctcctgtgagaatctaatgctgctgctgatctgacaggacgacaagctcactcactcgcctgctgcttgcctcctgatgtgcggcccagttcctaacaggccacagaccagtactggtccttggcctgagagttagggaccccgatctaactgacaatacttagtactcactaaactgtcatgttcttccttccagtctctttgtcttcatcgtttccggcactgatgtgagcacatcataagcacaagacctggacacctttacaatcagaggtagcatctgtctggaactgtatcttgactctcactggtgcttttcctttggttgatgcaaagcttttgaatcctttagggagatgtcattgtgagtatctatgatactatgctactactatctatgatcattgagagtatctatggtactatgatactactatctatgatcattgggagtatctatggtactatgatactactatctatgatcattgtgagtgtctatgatagtctcctgtgccttcaaaatctttgccttctccatagaactttcccaactagcttgtaagatccaaaggtgtgagacacactgatccagaacattcagggagtgtagtgaggggaaggaaatataaattgtctcgtcagcagttaatttttattttattttattttattttttttgagatggagcctcgctctgtcgcccaggctggagtgcaatggtgcaatctcagttcactgcaacctccgcctcctgggttcaagcaattcttctgcctcagcctccagagtagctgggattaccggcacccaccaccacacccagctaactttttgtatttttagtagagacagggtttcaccatgttcgccaggctagtcttggactcctgagctcaagtgatctgtcggcctcggcctcccaaagttctggggttacaggcatgagccaccgtggccggccggcagttatgttttgatggccttttgagaatggaagcctgtgtggattccgttgtctgccttgctgtggatcctgaaaggtgttctgttggcactgggcgctgagccagggggcaggctgtggtggtccaatgttcagttggcatatttccacttgtacttcaggcacccaacttccgccatagcctagggcttcagtcttcaccctgagatccctggttccatcaagatgctcagctccattcggcaacccgcggacacccgagatctctttttaatggcaatgtattactgcacacttcgtattgtcctaagtactctgtgcacattactgaagctaatctttgcaacaatcctctgaggagatacagtactgtcagtactcccattttatcgatgagaatactcacaggaaggttaaataatttgcccaagtctctcagccagtaagtgaaggcttcagaactgaaatctaggaggaagttcaaagcccctgggcctcactgtgctatacagtccattccaaaccctgagtcagcctccctctgaacgcacttttccaagtatatacatatgcacaaggtacatttccaaggacctcctggctctgatgatataaatatcatctctaattgtagtacatcaatataacggaataccatgaagccattagaaaatggtacagatctatatttattgacatgggaaaatatccacaaagcaaagcgaaaagcacattacagtgaaatataccatacctggccgggcatggtggctcacgcctgtaatcccagcactttgggaggtcgaggagggtggatcatttgagatcaggagttcgagaccagcctggccaacatggagaaaccccgtctctactaaaagtataaaaattagcctggcgtggtggcgggtgcctgtaatcccagctactcaggaggctgaggcaggagaatcgcttgaacctggggggcagaggttgcagtgagccatgatcgcgccactgcactccaacctgggtgacagagtgagatgccatctcaaaaaaaaaaaaaaaaaagaaaaaaaaggaaatataccatacccatttctagaaataaaataaatccaacatgggctggaagaataaaccaagttattctcttgaactcctgggctcaaatgatcctcccaccttggcctcccaaaatgctaggattacaggcatgagccacagagcctggccccatcattctctttgggtgagcgttgaaggtaattttcacttctgagctcactatagcatgggaagagtttaaactagaattcaacatgctgcttttggagaaccgttccaaacaacagggaagctgtgaagacacagctcaaggttaaacaaaactgcccaggaagctctaggacaagcttgtccaatccatggcctgtgggccacatgcggcccaggatagttttgaatttggcctaatgcaaatttgtaaactttctttttttttttttttttttttntgagacggagtctcgctctctcgcccaggctggagtgcagtggcgtgatcttggctcactacaagctccacctcccgggttcatgccatcctcctgcctcagcctcccgagtagctgggattacaggcgcccgccaccatgcctggctaattttttgtatttttagtagaaacggggtttcaccgtgttagccaggatggtctcgatctcctgacctcatgatctgcccgtctcggcctcccaaagtgctggaattacagggcaaatttgtaaactttcttaaaacattatgagatttgtgattttattattttttttctagttcatcagctatcattagtgtattttatgtgtggcccaaggcaattcttctttttccaacatggccccaaggaagccaaaagattggacacccagctgggcgcagtggcccatgcctgtaatcccagcactttgggaggtcgaggcaggcagatcacttgggatcagcagtttgagaccagcctggccaacatggtaaaaccctggctctactaaaaatacaaaaattacccgggtgtggtggtgggcacctgtaatcccagctacttgggaggctgaggcatgataattgcttgaacccaggaggtagaggctgcagtgaaccgagatcgtgccactacactctggcttggatgacagagtgagactccatctcaaaaaaaaaaaaaaaagccaggagtggtggcttacgcctgtaattccagcactttgggagccaaggcagatcacttgagatcaggagtttgagaccagcctggccaacatggtgaaaccctggctctactaaaaatacaagaattatncnnnnnnnnnnncaccctcctctccccccttctgctcaggaggctgaggcaggaggatcccttgaacctgggaggtagaggttgccatgagctgagatcatgcccctgtaatccagccaaagagatagagcgagactccgtctcaaaataaataaatacatacatacatacatacatacatacataaaataaaataaataaataatggggcttggtgtggtggctcacgcctgtaatcaaaaaaaaaaaaaaaaaaaaaaaaagagagagagaaaaagactaaagccctaatcctaatcccatgagggtatcaaaggaacttcctagcacttgagaagtcttgttacctacagtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcccattctcctgcgtcagcctcctgagtagttgggtcctcagggcagggactgttgtccccagatgcagcctgtagggttgacctgaggctctgaggggtttggctntccaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtacctgccatctggcctgggacccacatgtcggttagagaattgggacccggctgtggttaggcggtgggatactaggggtggagttggacaatcagggccctgaaagcccagttcttgttaaggattcaccccctctcgcaggggagagcctggtttatagtcaggaacactcctggagagggagtttctttgttactttgttctagtagacctcccagatagtttcatttttttctactcacctggtttatagtgaagaatgcccctggagagggagtttctttgttactttgttctaatagacctcctagatagttccattttttctattcactaacgtgcactgggaatccaaagggaaaaaaaataaaaggtcaggctttctcttatgtcaagcctttctctggccctctacatgtgatggatgtgcgttacaggtgcattataatgttttttataagctacagcgcaaataaactcctttttctttgctatgaaaaacacccatgcatgtatatataaatatatatatatttatatatatatattttgtgtggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctagggtaccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtaggcggttcgaatccagtttttcatcaaaaacaaaattagccaggtggggtggcgcatgcctgtaatcccagctactcaggaggccgaggcagaagaatcgcttgaacccgggagctgtgagctctgcagtgagctaagatcacaccattgcactctagcctgggtgacagagagggactccatctcaaaaaaaaaaaaaaaaaaaaaaaacctaagtcagctcatctccttatctgcttaaaactttccgtttcctacagagtaaaaatctaaaacctaaagtacctacaaggcccttacctatctgtccctcacgcccactctgatcatctcagatgttttcctcctcacttacttgctttctacccagatgatgctctgctgcttttccagagcaggctttacttgggggcttttgcattagccattccctcttcctagaaaactagccaacaaacatccatagaataattcacctccatcaaatctttttttttttttttttttttnnnnnnnnnnggggaaaagcagtctcactccgttgcccaggctagagtgtagtggagcaatctcagttcattgcaggcttgacctcctgggctcaagggatcctcccacctcagactcctcccgagtagctgggactgcaagcacatgccaccatgccaagctaatttttttactttttttgtagagacagggtttcactgtgttgcccaggctggtctcaaactcctgggctcaagggatcctcctgccctggtcccccaaagtgctgggattacaggtgtgagccaccagcgcaggccacaaagattttttaagatcgtttattattattactattattttattttatttttgtagatggagtctaactatgacacccaggctggagtgcagtggcgcaatcttggctcactgcaaactcgtcccctgggttcaagcaattctcgtgtctcagcctcccgagtagctgggattacaggcatgtgctaccgcacccaggtaattttggtatttttttgtcttaacagagacgagttttgccatgggggctttttgtnnccacagcacgnnggtttnnncaccaagtgccnnctaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatggggtcttgccatgttgcctaggctgatgtcaaacttttgggctcaagcaatcctcccaccctggcctcctaaattgctgggattacaagaatgagacaccttgcccaaccctgagatctctttttttttttttttttcactgaaacctatggaattatgtattaaatgatccccaaagaatcagctatttcaaaattaaaaattattacaaagagcttcatacatcatgttatatcctatatcacacaccataaaactgtcagaagtaggccgggtgcgggggctcatgcctgtaatcccagcactttgggaggctgaggtgggcagatcacgaggtcaggagatccagaccatcctggctaacacagtgaaaccccgtctctactaaaaaataccaaaagttagccaggagtggtggcgggctcctgtaattccagctacttgggaggctgaggcaggagaattgcttgagcccaggaggcagaggttgcagtgagctgagattgcgccactgtactccagcctaggtgacagagcaagattccgtctcaaaaaaaaaaaaaaaagttagaagtagctcgatttcacgttactgtatttctttttcttttcttttttcttttcttttcttttttttttttttttttggagacagaatttcactcttgttgcccagggtagagtgcaatttcgtaatctcggctcaccacaacctccacctcccgggttcaagtgattctcctgccacagcctcctgagtagctgggattataggcatgtgccaccatgcccggctaattttgtatttttagtagatacggggtttttccattttggtcatgctggtctcgaactcctgacctcaggtgatctgcccgcctcaaacatcccaaagcgctgggattacaggcgtgagccaccgtgcccagctgtaaatattcttctaatgacgcaaatttcaccatggtgggcacaagctcgagtccttggctcacacccttgtttccaaggctttgttacgttaaaacatggaggcttctatggtgagggagactggggaatcactgcaggatacagaactagtgagtcgcaagaaatncaggagtnagttgcagancagcntcggntaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccggtattttggtatgggggcaggcctttcctgtgctgttctcatgatattgaataagtctcataagatctgatgattctataagggggagtttccctacacaaggtctcttctcttacctgccaccatgtgagacatgcctttcactttctgccatgattgtgaagcatcctcagccatgtggaagtgtaagtccgttaaatctttttttcttcccagcctcagaagtgtctttatcagcagcatgaaaatggactaatacatatgaaaatgcctggatgtccaggcagaagtctgctgcaggggcagagccctcatggaaaacctctgctagggcagtgcagaagggaaacgtggggttggagcccccacacaaaatccccactggggcattgcctagtgcagctgagaagagggccatcatcttccagaccccagaaaggtagatccactgacagctcacaccatgtgcctggaaaagccacaggtacatagcccctgaaagcagccatgggggctgtaccctgcaaagccacaggatggagctgccttaggccttaggaacccaccccttacatcagtgtgtagggtccagccccacagggtcagtgggtctctccccatgtgcagagacgagagagtgtagaaataaagacacatgacaaagagataaaagaaaagacagctgggcccggggaaccactaccaccaagtcacggagaccggtagtggccctgaatgtctggctgcactgttatttattggatacaaagcaaaaggggcagggtaaagagtgcgagtcatctccaatgatacgtaaggtcacgtgggtcacgtgtccactggacagggggcccttccctgcctggcagccgaggcagagagagagagggagagagagagacagcttacgccattgtttctgcttattagagacttttagtactttcactaatttgctactgctatctagaaggcagagccaggtgtacaggatggaacatgaaggcggactaggagcgtgaccactgaagcacagcatcacagggagacggttaggcctccagataaccatgggcgagcctgactaatgtcaggccctccacaagaggtggaggagtagagtcttctctaaactcccccagggaaaggggagactccctttcccggtctgctaagcagtgggtgttttcccttgacacttatgctaccactagaccacggtccacctggcaacgggcgtcttcacagacactggcgttaccgctagaccaaggagccctctggtggccctgtccgggcataacagaagactcgcatnctgtnctgccgtttcacacctnccctcagtgcccgttatgtnnccacaaagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttcgctaaaagtgctgtcaacactagcttcaaagcaacgagtgcataagagagaggcaccacattacaccccgggtacctcacgtgtccccccagccctaggatctccaattctatgggttccaaagaaaccaaggtttctaccgcacgactgcccgcctttttcttccaccgcggcagccccgccgccccccctagcgcggagcccaggccctcgattctggttctacgtaaccaccgcctcccgtgttcaagcaattcttcgctccacctcccccagtacttggtttttcagtttgtttttcttcaggtcgggtttatttaccctgtattcatagtacacccgtggtttcccctccttgcccaggttggtcttgaactcctgaccgtgatccaaccgcctcggcctctcaaagtgttggcattacaggtgtcagcctccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagatagtaaaacatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggngtcttgccatgttgccccatatggtctcanactcctggtctcaagcaatcctcctgcctcagcctcccacttcctcaagaaagttttttttttttttttgaggtggagtcctgccccatcacccaggctggagtgcagtggcatgatcttggctcactgcaacctccaccctccaggttcaagtgatttttgtgcctcagcctccggagtagctgggattactttttcccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggatcaaaaaagtccattccttttttttttttttttttttttgagacggagtttcactcttccacccaggctggagtacaggggggcaatctcagctcactgcaacctccacctcctgggtttgagtgattctcctccctcagcctcccgagtagctgggattacaggtgtgagccaccatgcccagccaacactgaggatatattgaattaaataaaatatattattaacattaattttatctattctatttattcattttgagtgatgaactactgtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatctatcttgaaggtacacaggaaaccggctctaggaagaggaactgaatgcaagactttactatacattcttttgtactttttatatttttttcatgttttatgtgatcaaaaataaaataattggaaaggaaagaaggaagaaggaagaaaaattttagaccagttgtgtttctctataacttctaccaagcaagtctaattctaacctctggttaattcttcttgtatataacaatccttcagatctttgaaaatgtctctcttttcccctttagttttctttttaatttaattcaattttgttttattttattttattttgagacaaggtcttgctctgtcacctaggctggggtacagtggcacaatcatagctcactgcagcctcaacctcctaggcccaagtgatcctcccacttcagcttctcgagtaggtgggactacgggtgtgcaccaccatgcttggctaatttttaggtgttttgtagagatggggtttctctatgttggccaggctggtcttgaactctgacctcaggtgatctgcctgcctcggcctcccaaagtgctgggattgcaggcgtgagccactgtgcccagcctcaactttgtttaaagctttccttactaccctttgcacttgcagtatcagccattttagcaggctcatattctccctctggctttttatcaggaccacactaattgccaaggtcttgttgttagttttcttccacagtctttttcagcttttttcttgataacctttcaattctatacagtgaactttataatatatttatctccagcacaaaaccatcttcttgacaccaaataggctttgcctattgaacatcaacaactgaatatgttacctgctaaccaagctcattctccctacccctacattaataatttctttagacatcccaatttttattactggaagcactgttccccctgttcttctaactcacatctttaggaagggaaagaaatgaaaggagcactctgcaatgatttctctaacctcaatctctttgattctacaaccctattatttttacagattacatnctaccttattattttggcacaggtgaaagggtagctgtgggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagtttagatggggtccaagacaggaggatgatgtagatcctccccctttcccagtctccttcccttcccccagtcagtgggaggcaaagcagcccaggcactgaactctacttgctttaattacagcctctagcaaaaggaaacctcaattagaggaaaagatctgtagccggagaggggagtccagtctggttgctgtcctcctggccttttacagaaagggatgaggcttttgcttccccatcttgtcattttcctccctcccatatttccttctctagcatcttctctgtgcctccccagtttggtcaaggtcttgctgtgtgatcttgggcaggcaacttcacctctctgagcctattttcttatctacaccatggggatcttaccatgcagggaatgttgggaggacaatggagcttaataaatgcaggctggtgcattgagatgatggtgattgaaaagggttttcagtggggttgcagaaggaaagttgtcccctgtgcagggagcaggttgaaggtcaagcctggagtgggcaagagggcagtgggttgccagagcccctgttccttggtggtagtgggttccgctggtatctgctgggtcctccatggcgggctgtgtttcaggtggacgacgccatgctgatgtttgacanaaccacaaccggcaccgaggtgagtgtggccccctcccccttccnnagctgggcccngtggtcagccagggggctgcaggtcacagctggcctttcatctcgccttctgacatnctatccccctggatctgcgtcctctcccagctgggccttacagaaggcttttgtcccaccatttcctgtgctagaaacttgccgaattgcagacacacgagaggaacagaggagtacccacccccccagtccctgcaacccactgagtctcctacccccaccctagtggtgtctgcctctgcctttttttaccttgnccctggtaaccagagcttaggccaggccgcccagggtcaggctgactccacagccccaggcagtcacctcctgcccagcccccagcccccagccccgttgcctctgaacctgtgagcatctgggccacaccgtgtgcgtgtgcgccacctggctgtttttctcccgagggccttaccttctgagaaatccctttccagtccctggggcacacccaggaggagacagggttgtttctccagttgtttcaggacttttagtccattttgggagtggggtatgtgctctgtgtgtgtgtgtatttgtatctgtgcaaaagggggtatctgtgcctaaatatctgtttatatctggtatgtcagggtaactgcatgtgtctgcgtgatacgcaggtatctagatgtgtgcatgcgtgaatgtgtgtctatgtacatttgtatgtttggacatgtacacctttgtgtaagtttaaatgagtgtgcatgtgtgttccttcttccctctttggaaaacacctgaggactagaaaaagcatgttgagtgtattctcatcacagctctaccactttctaacttgctgtgtgaccttnggcaagttacttcacttacctgaaccttattttcctcatctgtattctgggaccttgaaaccctgtctcagtggatagntgagaggaattcagggctgtgagcagagcctttattaactcttactcgcccagaaaaagagaagcggggatttgggaccgacctgggggtgaggttttgcccctgcgctctgggtctgacccttgccttatcctttggccacctttaagggtcggggtttggcccctttgaaaagagagaccttggggggaaaggtgggaaatttctttttctggaaaacacaacaaaaggggagatggtgtcccgccccccggggtcacccccttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacagacattacaatatacacacacaaatacacattgtctgtatttatgcagtggagcaatcataactcactacagcctctaccttctggactcaagggatcctcccacttcagcctcccaagtggctgggagccaccatactcaaggcatgagccaccatactctgctaatcttttatttttagtagaggtggggttctcagtcttttgcttaggctgctctgtcttgaactcctgacctcaagtggtcctcctatcttgggctcctgtctagctaggattacagggacatgcacaccactctcagctaattttatctctgcatttctgatgaatgagagggggtttttttttttttttttttttttttaaaagggaatttcactctgtcgcccaggctggagggcgggggggcaatctcagctcactgcaacctctgcctcccagtttcaactgattcttgtggctcagcctcccgagcagctgagcagctgggattacaggcatgtgccaccatgcccagtaattttgtatttctagtagagatgaggttagccaggctggtctcgaactcctgacctcaggtgatccgcccaccttggcctcccgaagtgctgagattgcaggcgtgagccacctagcctggccaaatgagttttttaatttaattttttttctgcccccgaaaccaccctgaatgagttctattctgcatcagttaaccaataatttaatgttgactcaacatcatggtggacactagaggcaatagttgggccggtggtaaatacacagttcagccaacacaagtacccactggctctcctttgaggagtgcccacttctctgtttctgcttttccgacccagcttagatgccagccttccctttcctctccaacccactgtactccctccctcccttgagcttccaaagctctcttaaggctctcatactttgctttgggatataatttgtccctttactggagcgtaaatgcctcaagaactgtcagncagccttattcaggtgtggatacctncagagtacctgacacggtgggaaaggcacatttgattcattcactgagaagagaagagcanagatgtagccgctgagtactagctgtgtgaccctggggaaaataattcttcctttgatctcntagttatccataaagcagagggggcatcagaggcttccaggcagccttcctcacctttttaaaatggacactctgatgaaggcatccccgtgactatgcttcatggggtcaaaaaaaaggcggattttggtacccaagtttcctcttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacccaaaaacaaaaacatggtgagttgggattggatggagcgcaggcacagagaagactggggctccttgtggggcctgccagggaagctatgaggttctaaaggcaggcagaggggcttcgagtgagtggaggcagagccagttcttccaacccctaaaaacctagacagggaggcagtgtcacacggtagttaatcaggcagatgacctcccttctctgagcctcagtttccacatctgtcaaatgggactggaaaagctcctccatcatagtattggtagtattggtgtaagcattcattgaacgattgcatgcaaagccgtttacacactccccagcacatagtgagtgctccatcagtggtaaccatgaaatagttttcagctggacagtgaaattaataaaattaataaaggggctttccagggaacaagagggcaaatgactctagctctgtgggaaagactaaccgccaggtctcattgcaggtggaatgtaagaaagctcagccaaaggaggtgatgtcgccaacgggctcagcccgggggaggtctcgagtcatgccctacggaatggacgccttcatgctgggcatcggcatgctgggtatgcgcgagccttttcctgcggcttctttctgccagaactgctcccagggctagcaggggctgtgtgggtgttgcacctcccctgtggtctgccctcctcctgtctgagtcattgagcaggagtggggacaagggatctgtcgggtctggcagtcctacccaaggtggggtggtttggttggggggtgctgccctctggtggtagccagcagaaaggtccaaccatattcattggtcctgtcaatctgtccattctctcgtccatccatccctccatctgtccattcctctatccattcatccatccagtacacagttattgagcaactctatatgccagacattatgccaggaactgcaacaatgactttctttacaatctggcagggaaaacaagtaagaagataaaatagatttcagatgcagaagtgtagggtgccgagggagtgtggtcacagggaacttgaccgtgacttggagaagtgggaaaagaagtacatttaagttgagtctgcgggtggagtaggagccagtgattgggaggctggagagacnggaaggggaaaagtgttccaggcggaaggaacagcatttgcaaagcccaaggctttggaagaggcaaaaggaagctgcctgccttattcttccgggatattaattggacacacttgaaaaaaagaccctgtttcatggggtctccttaaagggaaaccgaaaaaaggccct

SEQ ID NO: 713 - DNA, 153284 bp, Homo sapiens
ctgcgagggacagcctccccagctttcagccctgtggtttgggggtgctaactgaacagtcacacggtcatatgagtgaatccccctctacagggtctggctcagggagggcacaggtccagcctgagtccccatcgtcctccaggcgcaggcctccgtctcagcaggtgggacagggactcccccgtgggcctgaacccctgccgcagccattcggccaccagggggcagagtcgacctcggcctgaagccaacactaaggatgcgaaggcgagctgggcccggtgctgcaactgccaaagaattcctgcaacgccagggcttctgagctccggacttcacagtcagctgcgtcagtgagtcccccttctgcttaggccagtgcatgctgggatttctgtcacctgcaatcggctgggccgtaagagatgcaggtcaggacacccccgatggcagtgagttgtgtggctggaatccctcccagagaccccgccccttctccaggcggggcagcccagagcacaccaggacactgctctcccttgcaccttccctgatgtgccagctgagggggaacctgttatcatcccgttctgcacgtgaggaaggcgaggtgctgaggggctaaactcgctgagcccagcagatggccagggcagatgcgggactggcaggggctttctggctctagaatcttccccgttgccgccccccagctgctcatcaccctggggtgaagaaatccctaggagaactccgtagactccgttcttctacacatgggagctctggggctgggtaaaggccctgtcctgggtcacgagagccaagcgagggcgtgaaaccagagctgccctgagatggcagggacacggagcaagtggaggactttggtgccggccacaggaggcaggagtggctatctctcctgtgacctcaaagcatcctctgggggcagaagggccgtggcactgctggcagcctgaggtcaacttacttgaaggcactggggtctccatggatcttgtagttgtcggcgctgatctgtgagatgactctggtcacagcgatgaggatgccaatgttgacctgcacaagaaaccatggaggaaggtgaggggggcctgggctgcacctgcaggagagctgcgtccgcctggccactgccctcaccacaggctacccctgcccagccagggctcctgggacacaggggcatcactgggacaaatctcaccctgttccgtgggcttttaccaacacacacaacatgcaagcttgcctctgagagcacctgcactgagaagacagcagagacgagttctagtcccaggaacacatccgggcatgagggcatgagcctgggccagacctcatcttagcatttgcttcgttagtgtgaccctgggcaactcacccaggtcctcggagcctcagtgccccaggtgatgagaaggatagtgcccactgtgcaaacgactgctcaatgtgccaggccccggcacaggagctggctctcatctcccgccccggcccaggcctgcggctgtgcgagccacagaagctgcggcagaggggcatcatctcctgccagcacccctccttgctgggaaactgctggaaggctcctgttgggacctatggggctgggcggggcactgaggggccccggcagaggcttcagcacaacctgcccctcacctgggcagctccctcagtaggaggctggcgaggcaggcacagcatggggaagaaccccctagtgtcctctggctgcggggttagggtgagggttagccttctcccttgtgtctgaaaaattctgaggccgtgtacagagtcagcaaggagtccagttccaggataaagtcctctgtgtgaactctcaggctcgaactttcaggcaatgaacagggctctacctcgccggcctcacagggcagctgctgtccccacgccagcctgggcgcggccagagcctggcagtctctgaagggagctgcagtcggagggcagccactggggccccgcacgggatggccagcttcgctctccccccgcacgggatgggccggcctcgctcttcccccgcacgggatgggccagcatcgctgttccgcacacctgcacccctcgcctaggtgcccgcgccaggcctttctgaagcaactgctgagcccgcctcaccctaggggccttgaagccaccttctgtgcccaggacttttccactgtgagcccttccccttcctcctcgcgcagctcccgagcccatgaatcagcaggagccctccgcccagggctctctcagcaggagaccggccctgtctgcacggaggcttcagaccctcctggtgctgttctttgggagagagtggtgcgtggtggggccgccccctcctgcctagccccttaggacactattgtggcagtgagcaccccaactgttccctcctcggctcctgtcttcactgaccacctcaacacctggaagctcagctcacgcccagctcagctgacagtcggatgcaccttagttgcccttattttcccatctgtaaagtgaggctaataacagaagtgtccaaaggccagggaagggaaaagaagtcaacacattagccacccagcatggtgtctgcacaaagagcatgtccagaaacgctgatgccccccagccaacctcactgtgtaacgacgagaagaaagccacactcaactaggagcagcaagcgggagcagcgtggatgacaggtcagtggttttcaaatgcagtgatgattcaactaggacagtgacaaacgcgtgactaatgtgcagttattacttcgagtggggatttcaattgcagatggctgatggtcactgatgtgtgagtgcggcccatgccctcggggcaggctggccttggccatctgcctgggaagcactttcgtgcctccagtggtggctacagcatcacacagagagggaggtggagatggaaggtgccccaagtcaaactgccacagaccctgcctgctcttactgagattcagaagtttttcttgaataaatgcttttagtgtgcatgcctttgtttctagaattccgactattttttcaaaacaattcttccagttctttccttgttttgggagtggagatttccccaggtcctgactctgccattctgcaactcctgcccctttcccttgagggatttctattccgggtacctcacccactgacacaggcgggggcctcatctgtaacaagattggaaacaacctgaacgtccacaccgagacagcagggcggggctgtcactcacacccagacagcagggcggggctgtcactcacacccagacagcagggcgggcctgtcacacccagacagcagggcgggcctgtcactcacacccagacagcagggcgggcctgtcactcacacccagacaggagggccagcctgtcactcacacccagacaggagggcaggcctgtcactcacacccagacagcagggcggggctgccactcacacccagacaggagggccggcctgtcactcacacccagacagcagggcgggcctgtcactcacacccagacagcagggcggggctgtcactcacaccagacagcagggcgggcctgtcactcacactcagacagcagggcgggcctgtcactcacacccagacagcagggccggcctgtcactcacacccagacagcagggcggggctgtcactcacacccagacagcagggccggcctgtcactcacaccagacagcagggcgggcctgtcactcacaccagacagcagggcggggctgccactcacacccagacaggagggccggcctgtcactcacacccagacagcagggcggggctgtcactcacacccagacagcagggccggcctgtcactcacacccagacagcagggtggggctgccgtccacacccagacagcagggcagggctgctgcccacacccactctatggaacactttgtgggtctgagacagactcaggcagctcttccttggcgaagaagccacaccccacatacactgaaggccgccatggggtgggtatgtagttacagtccccctatctgcacaaaaccccaggatacccatgaaaccagcatcacgggttgcctgtttggagggagggtggaaaccagggaatgcaaaaacatacataggcagacacatttatgcatagattcttaagcttttcctgtaaattttgtgttgccatttcataaatcagattctttaaattttagttttaaacaattataaattaaaaggaaataatatgaaacccatttcctgtgaatgacggagcagtgtccttggggtcaggtggaatagaaactcagccatgcagtgttccagtgattcaggggatggagaaaccgtgaagcctgggacccatgagagggatgcctggagatgctggagaggatctcgagcaacttgagtgagtgcagagttcccatcaaccaacaccccacctgagctcagggtcccatcacaaccaacccaaccaacaccccacctgagctcagggtcccatcacaaccaacccaaccaacaccccacctgagctcagaatcccatcacaaccaacacaatcaacaccccacctgagctcagaatcccatcacaaccaacacagtcaaacaccccacctgagctcagaatcccatcacaaccaacacaaccaacaccccacctgagctcagagtcccatcacaaccaacccaaccaacaccccacctgagctcagagtcccatcacaaccaacccaaccaacaccccacctgagctcagggtcccatcacaaccaacccaaccaacaccccacctgagctcagggtcccatcacaaccaacccaaccaacaccccacctgagctcagggtcccatcacaaccaacccaaccaacaccccacctgagctcagaatcccatcacaaccaacacaaccaacacctcacctgagctcagggtcccatcacaaccaacacaaccaacaccccacctgagctcagaatcccaccacaaccaacacaaccaacaccccacctgagctcagagtcccatcacaaccaacacaatcaacacctcacctgagctcagagtcccataacaaccaacccaaccaacaccccacctgagctcagggtcccatcacaaccaacccaaccaacaccccacctgagctcagggtcccatcacaaccaacccaaccaacacctcacctgagctcagggtcccatcacaaccaacccaaccaacaccccatctgagctcagggtcccatcacaaccaacacccacatgagctcagaggtctcatcatcactcctgctttgcctctggaggctataaagcgtggttctgccccggacctctcagctgtaaagctgaaagatgcacacatgactgttcccagacttttctgacaaggccaccgaaaggatgatcaacttgcagcaaaatgttttgccaacatgaaacactacgagtgattaatttgagatttcaagtcctttactttatcttgaccgctttgcgttaagatgcactctaagtgtttcataacagttaagctgatcacattattacttgtcagaattcatcatctttcctttttctccaaagattttgctgggtctttttttttcttttagcctgggtcagtctggtttcattttccaggcacattttttccatcttatcaggatgatacatttgctgtggcttcctaagaggaggagcggctcaccatggcctccaatcctgcatcggtgcggtgggggactttggctgcgagtggcacaaatctgacatttcatgaaaatataatacagaatcaggcctggcccccctcactccatttcactcatcctcatccatgccttgctgtatggtacacccacactcgactacaaatcggaaaatgccctgggactgaggcatgtacagtgtgagtaccatggatattccagcagctaagcatctccccactaaaggcagatgtcaaagaaacaactcacaggcctcactgcagaagaaaaactggaatgcacatggaggcagtagaactgtaaagcaaaggtctcgtggctactatgaaggccaagatcacggtgatctctggtgggaggagggaggcaggactgcataggaatcctggtgttctgtttcttgacctagctcagggtcaccagaatgttgatttgtgaataaacactgagctggacaccactatttcacaatgaaagggctatacaggtacatacacacatacaaatagctagtttacacaacagtgggtgcctcagtctgttttctgctactataacagaataccacagactgggtaatttataaagaacagagatttattacagtttgggagactgggaaatccaaagttgaggggcctgcatctggtaagggacttcttgctacactgtcccatagcagaagtcggaaaagcaagagagcacagagagagagaagggggcaaaactcatcttttcatcagaaacccactcgttcaataatgaaaccactcccacaacagcagcattaacttattcacgagagcaaagccctcacaacctaatcagctcctaaagttccacctctccgaacctgtcgcactggaaattaagttacatgaactttgagggaaacattcaaaccacagcagtatgtctctgtctgcctgtatttaggtatccgtatctatgtatcagtatctacatgtatctacaggcagttcctaacttaggaaggttcgagtaataatttttcaccttttcagtggtgtgaaagcaagacatgtcagtacaaactgtactctgcaaacctatacaactagtttttcacttccagtattcaactcatttgatattcaacattgcattataaagaggctttgtgttagatgattttgcccaactctaggctaatgtaagagttctgagaatgtttgaggtaggctaggctatgatgttctgtaggttatatgtattaaatgcattttcaatttatggtattttctgcttatgatgagtttatcaggacttaatcccattgtaagttcaggagcatctgtatatatctgtatctatatttatgcttatctgtacctatgcatctatagcaatgcatctgtatctatctctgtatttgtatctgtatccatgtatctgcctatatctgtatctacatttccatctgtgtatctgtctctatgtatctgtttgcatctatacctctgtatatatatctgtaaccatatctctgtctctatgtagacacatagctaccctggcttctccccaagggagacaaagattttaaatcagagactccttctcttccccagacctggaggcactctccttctttcctcggtggggccagcacagaacaagccattttgaaggctcaggctaaagtgcccctgacatccagagtccctgttctttgggggaacggggtgtctaggctctgtggcttctggaaaatcaggcgttatgggctgaactatgtcccctcaaattcatatgctgaagccctaagcctccgtacctaagaacaagaccacttagagacaggttctttaaagacataattatgttaaaacgaggtcactagggtgagctttaatccaatgactggcttaggcagtcacttattttaagaggagattaagacgcagacatgcacagagggaaaagcatgtgaggacacagggaaaagacagttatctacaagctaaggagagaggcctcgggagaaccaaccctgacgacacctcgatcttggacttctggcttccaaaactgtgagaaaataaatttgtttaagctgtgcagcctgtggtcccgtgttacagcagccctatagactaagacaccagggaataacgggcctatggccatgttcgcattttgtgtaactagaatcaccgagtgaatgaaaagccatttccctgccttatagccaagaacaattcgagaaggggcagtgggcagtgtgtgttagagccgagaacaattcgagaaggggcggtgggcagtgtgtgtgttacagccgagaacaattcgagaaggggcggtgggcagtgtgtgtgtttggctgtagacgcctggtggggggtgttactggaagtggctaggctctgcccttttctcctcaaccctaggcccagcaggccccacagtgaccctttactgtctcccaaattcttgccttttcaggatgaaccttgccaggacacagggaagctgatgttctaatgtaaacacacagcttcctaaaagtttttaattttcaaattatgcaggcaatacatgggtgtttttaggtgcatataatcttgaagcacatactccccaaacccaaacctctccttagggaaccattattttgtgtgcatctgtctgggcattttcttattcagttatatgttcacatgtgggtgtgtacccatatagagcttttaactttttaaacaaatggggtcatgctatacttgttatcccaaaacctgctttcttcatctggaaataaggctgatgacttgtgggtaaatgaggaattggcccagatggcacaaaccctgggatcctctgaagacgtgagagggacaagacccccaactcccctccacggcactccccgcaggggtaggctggaacctccacggcaccccctggcccagaggttgatatgccttctgccaagagccagttagtatttttggctttgcgggccacgcagtctttgttgcaactattcggctcagctgttttagcctgaaagcagccacagacaatgtgcaaatcaatggacgtggctgtgtgccaagaaaactcgatctacaaaagcaggtagtgggccacactgctgcagtttgctggcctctgcacttgaacctggaaccttttttttttttttttgagacggagtctcactctgttgcccaggctggatggagtgcagtggcgcaatctcggctcactgcaagacccgcctcccgggttcacgccattttcctgcctcagcctcccgagtagctgggactacaggcacccgccaccacgcccagctaatttttttgtatttttagtagaggcggggtttcactgtgttagccaggatggtctcgatctcctgacctcatgatccgcctgccttggcctcccaaagtgctgggattacaggcgtgagccaccgcgcccagcctgaacctggaatcttttaaggctgccccattcagctcttgcctcccttccaatctgcctgttgctaccaatgtcccaagagggcatgaggacctcaagccagctgtgctgagagtcacctggaagattctaaaggccaacaagccgaaacttcaggaggtggagcttagacaggaatactcttaaagcttcccagggccgggcgcagtggctcacgcctgcagtcccagcactttgggaggccgaggcgggtggatcacctgaggtcaggagttagagaccagcctggccaacatggtgaaaccctgtttctactaaaaatacaaaaattagctgggcttggtggcacctgcctgtagtcccagctgaggcaagagaattgcttgaacctgggaagcagaggttgcagtaagccaagatcgtgccactgcactccagcctgggcgacagagcgaagactctgtcgcaaaaaaaaaaaaaaaaaaaaaaaaaaaaaaaaaactccccaggtaattcaattatgtaatgagtttgagggctcattctgtcctccaggaatgatggccactgacaacaaggagtggggtagggggtggggccctgaaggtaatgtcccctcaggaatgacaaaagggactctagtgaagctgggagacacaggggtgctgggttcctggcgctcggccccacgccgtgtgggtggtgaaggagccaggcagagccacctcggaaccccagctgtcactgaccacggtcagacatgaaagccagatgaccaggacagtgtctgacacaggggcctgttctgcccaggccctgcggttctagagggtttaagtcagtagagagaaagggagaacaaggaacagcagagacttgaatacaacttacccttcccaccctctgtcactaaacgtcctttaaagcccctcccaactggccatgctccggccaggagtttgatgactggagtccgctctgaaagcgtttttgcatgttggttggcaaaatgaatggtcctcccagacccccagagagcgcggggacctctccctgaagcctctgacactctttaaagggtagagtcggtaaagcgatggcaggtgatcctcacgcagccccggggaggcgctgcggcccccagaccctaagagctcaagcgcgcagccccaaaggcgtcccctctgcagctgacagcgattcactgaaagaaaaaccagccctgctcggagctctgtagacgctgtgagggaggctctgatgccacaagcctttccctcgcgaccacctctgcttgcacaaagatccctgccctcggctcgtggcgccccgcgcaacacccctgggcccctgacgcccctcagtccagggagctgctccagttcactgcggggccctgacccagcctgcagacgggaagcctgggccaggacgcgcagcccgggcccaaccagccagggccctcagagacaggcacgtggaagtaccgaagggaaagcacagactctgctgaggtcacaccctctgatcacgaccccaccataccagcagctcctggtgtccaccggtgctaactgcacaaagaaatcatgggaggcagccctgaccaacattcgactccatcccatttccctgattggttctgggacggacacatgactcaccgcagccaatgagaaccagcctgggacttgcgatgggagtgctgggaaaaagcctccgtttccatccggggaggcagagaagatgagggacgagcctcatgccagtgcaggtgcaggagccctgggcccagcctccccacagatggtcctgactcaggaacctgtaaatccccatccgtgtttaaacactgagttggggccaggcacagtggctcacgcctgtaatcccagcactttgggagacagaggagggcagatcacctgaggtcaggagttcgagaccagcctggccaacacggtgaaaccccgtctctactaaaaatacaaaattagctgggcgtggtggcgcatggctgtaatcccagctacttgggagagtgaggcaggagaatcgcctgaacccaggaggcagaggttgcagtgagatcgcaccactgcactccagcctgggagacaaagtgagactccgtctcaaaaaaacaataacaaaaacaacaacaaaaaactctgagttgggttttctgtcacttgcaaaccactgtaactgtaactgttatgtgtggttcccaggaggcttctgctgagattcccctctgcagccttggagtcctggtgactcctgagcaaggagctagccggtgggtgagaaggcaccggaggatggggaaggacgagcccgcgcctgtgctgttctcagggctgtgtgcctgcacctgccgcctcgactggaagagccctggggcctcgagtggacccgcctggaaagcaccgccttcctgagcattccgggaaataagaccctcagtcactggcccagaggagccctagcgaggagtgaccgaggaacgacgctgcatccttcggaagctcctcagggagccccccgccatctccagagccccacaccctctcctcctgcccctccccagccccgctctgcgcccacaagggtaggaaacgtaccacgatgacaaacagggcaggggctacaaaggcccagatggcgccactcgccaacgacagccagcaactgcggagggaagcagagccgttacttcaacaacctcgttccacctgccagcgtaccttcatccaaaagtagttgctaaggtgatgtctttctcagctacagggtccacctggggcagtcatacaacattcctaatccctgcaaatgtatttttatccatgatgatcccacgtctcattcttggaaaggattttccaggtttgaagaccaggacagcaacctctggagagtttagccaaaatccagaatagatttcaatttcattaggaaatagacctttgctggggactggctttcctgcagagcacttcaagtatgacccaataggggccttctgtgagggattcccatcctgatgagtcgtcagcgatgcagcacctgaccattcccatatgcccaaagctcgaggtcagttcccctctctccgtgccctccaactgagaggaaaggttccagagggtcctagtgattgctctgatgtcctgagaggagggtccagtttgaggatctggcctctgagaagtgaccccaagaactcgggcaaaaaaaagccagctcctccacaattttatctccagagcctacggcactgtcaagagccgaagagtccctaggacctctcatcttgactcctggacactgtttcccaaggacctggagtgcctttaattggatctgggcaggtgcgtggcgcagtcctcactggcacccaatgtggtgtctccccggggctggcttatttcatccctccgtgactgctcactgagcagcaggtctgccccacagcacaacaaactccatcatctcatttaatcctatgctgcccctgaggtgggcgctatgatcactccaatcctgcagatgaggaatctgagccctaaatagctcaggtgacttcagagatcactgtcagcacactgcctccctgcccccattcctccccaaagcctcccggaccaggagatggcaaatgccccaaaacaagagacagcacctgcaagaggctcattcatggctgcacacccagagcacggagaggagaaacctctcatctgaggatgcactgtttaaaaggaaaatgcactgcaagtctgaatggtacctctgcaaaggtgcgattcaaaccaggctctccggagagtaggatgcttctgcaaagagagagattgtgctttccagcacttcatgcagaattttaagtcgacgaggggcttctggtagatactctatcctgttcagaaacctggtgagcttcctgaacctggctggtgctgcctggctttcgggcatgagtgtgggaaaaggcttgtattacggtcagaccccgggactcaggactgtgggtccagcatccccaagctccagatgggataaaagggaacaaatgccattgagctgtgtttgaggagaacattcttcttctaattagtccctcaacttctaacagcatccagaatgaaaggaaggccagaacagtggtctgcgtaaccatgcttgtttcactgtgcgctcagacactgccttctacaaatgcttcgccttcagggaacctgcaccaacgtggaaaaggctggatttctcccagtttcactattcgtctgtactattatctcattctgaagctgtgaaaatgctcaacttcctttctgtttgtaagcaccgtcaatatttattttccatgttttcactcagtggtttctcagcgtggctaggacaggtagcagcttccaagaaacatttgagtgaaagctcttttacttgtaaggaaagaaaatcatctttctggaacgtgaacagctgatctggtccctcagcaccatcccatcctcttcctgacacaactgtggacccatgagctgcatttcaagtggcaacaggagatactggacatcataaggtccatcccctactacccaagcaatgggaccctcaagaccacctgcctggtgcacagcaggccccacttactccaacatgcatgtgtctgctccctgtgagttactgggcacacggtctgcacagtgcgcttgctggccaccccaagaaagggtgaaagggccacaattcagcctccgtggatgaccagaactgtgtctgagaagaccacgtgggtgaaacatttccaagcagaaactcctagcaggccccctgctattcctggaggcgctctgtggtctttgttgctagttccgaggccccaaaatgtccagagcacagctgggttgtttctccctctccctggaccacgactttctcaccggctgggcctgtgggagccagctttgcacagcacccctgcacccagaagagcacaggaaggcaagagccacggggctctcgccacaagctgttccatggaacgcctgccaaaagcaaggcaaagccctgcacttacttgttgcttgttccgtaactgtccatggcaaatgacagtgaaatgatgcagatcagaagaggaaaacctgcagaagattggagaatatcatgttcacttgctccagttttcttccctccctcccgcctcccccatccctcccttcctttcttcattccttgtacacctcatacatgtatacagagggggaactatgtgctaattgttgggacacagaacagcccctatcctcaaagaacttttagtctaaacaaaggaataacacacacacactcatactcacatgttcacacttctgtactagacaacaaagtgtatgagtcttcatcaaaacaaaccatgtgggtgagatgtggcattgtgactggcaggaaggtaagctcagcttggtctatctagacctgtggttctcaaccagggccaaggtggccccacaagagacaactggcaatggcttaagtcatctagggttgtcataacgggatggaatcaggcaggcagaggccagggcttctgttaaacaccctacaatgcacaagactgccccacaagagtcacccagcccaagtatccatagtgttggttgagaagccctgttctagagcggcggtggaaaggtgtgagatcagctgggactgaggggacatcggacatggctgactttgccatgcacacagtccacattcttacagtatttgagcccataatttccttagggaacctatcacactccatctttccatgaggtccaggtgggctggttccttcctggctctgaggcatgtgacccaggactggctgactggaacatcaaatcccccagccacagctattggttcaaagatgggcatgtgaccctggctggcccaatgagactcaatcaagggctttcttcgaaactgctgagaagaaactctcttttctacggagcccctaagaggataaggatgtcagtgagcttggggtccaggcagccattttggcaccacaagagatcagatctgagagacggaaaaagaaaacaaaatcttgattatattacttaagctcatggatcaagccatatctgaagtccagcatcttagaacttttttgttatatgagccatcacattccctttttgccttagccagttcaagttggatttctattacttgaaactgagtgtgacaaattaaatgtgtttaatatttgacaaagccaagtgagactttgggggtggtgatagaagggaggcccacgaatgaggtagaaagcatctggatcacagcagtccccagagcttcatcattctgcaacgaaaacactctatggccacactacttgtaggaattgacctaacccaaatctgaactggcctctactttcacttttaaagtgcagaggttttgtatgctaatgtgtcttatgactctccaaaaggaagatcgcattgcaacactcctcaagctcagccatccacggaatttgtctggaaacatggctctgcttccacacgcacgtgtgagctttgaaacagatcctgcacgaatgggaatctgtttctgaaaagaacacacttctcgttattcagaaagtggggcatcatccacggggcctgctctagtgcagccaccctgagcacagcagcctctgtcctctgctccctctgcagggaaggatgggagagagatgagagactgcaaaggaccagctccttactccacacctgaaccttttccccaggaggatgctcaagagacacagctcctggcacatctcggatccctgggatagcagggtgggggatggaagtgcacgaagagcatgtggctctctgcctccgtagctgaagtcacacaggttctgggagatttctgctccagaggaaggaggaggagggaaggtggctcctggcacccacccgaccgcctccaggccgcagccctccagtgccctctgggggcagagtacacgccgtgcctgcccttccaaacatcagggtttgggtttcaagttaattaccctggaaagacatttcctggacagtcttgtctctgaaatacttggttttaaatgtcaaaaggacttaaatgcattgcagaatgtctgggcaataaagttgtccagaaggagaccaggcagcctctgtggaagaggcgcacagttggggcccagcagtgactgtgggcctttgtcatcctgtcactttgagtttccctatgtgagctcctctgccatttcttcccctgcatctacccctgtgtccagcagaggccaagccatgggtaaggacaaagggtctgagaacagggtggggcccactgtctgctttctccaaaatgagctgcaggagctatgaagtctgggtgagtgcgtttgtggggctttttaagaagaaaacattcctaagtgggaggataaggagaggggcagtaagatggagaagacagtgagtgggaagagcgtgggctttggggccagaagacacctcgttctattcctggggctgcccgggaccagctgtgcatctacaaggaaccagccgaaattctgtgctcagaccatgggaacgtaatgagttgccttcctcactaggctgtgaggatgacatgagctgtctatgaatgatgagcccctcgatgatgaagctgatcttgcaataatctgtatcatcaaccagctcagacctcacccctttcccaccactgctgtcatctgaaactctcacacggtaacctgggcagacctggaacatgcttctgcggacaatgtgaagtccctctggccctgtcatcagagacatttactttgggtgctcctctttgcaacacggtgaccttcagagggaccagaccggtgctgtccttggcatctgccccctaagattgaggggcaggtgaggagcatgggttatgagagattaaccgaggtgggtgaagcgaaggcctgggaggatgggcgcatgggcaaggggtctcgacagatggggtggagggagacaataccagggaactgtggaagtcactggtgccacctatttccagatgccccacacgcgggcacaggggaggtccacacccctgcccctcggggctcttgaggccacggggctggttctgggcactgagttgtgtacagaagggacatgtgtcttatgggctgagcacatgatttccagtgcagtgtcctctctgaccccttccctcacatagctcgaggcggtgccttctccgtcagcctgggctcttcactgtccaccaccacgggccaccatggacatgtagcgtgcataggaaaatgacgtttgttctttaaaaccaaagagggatggaagctgtttgttattgcagccttgcccgcctaccctgacggatccccctcctgtgatcatggcattacgcaatctctctggaatgaaagtgcagcttcagagaaagggggggcctggaactaagattaagttttgtccctagaggaacaggagctcacaaaagaaactaagttgcaataaagaaaaataaaacgagttacattctcttcacctctgagtttgcaatcagagtttcttgtctgcttcagtgatgtgtaaactctccaatgcttgtcactctgccctcctggctaccttgtgggctccttgaggacagaggttatctgtccctcccttcagagttcctagcacaagtctcgcagtcaacaacaccttaaggtaaggtgtggatttgatgcccccccaccccacctcagtttccaaaaaataatattgctcaaaaactagagtaaggccaggatgaaatctgcaggaagaagccacctcccaggggctccccccaccatgctctgggtgggcctccagctccttaattaaaaactgaaggtcgagagagcccaactgcctgcagacccccccgacttcagcttgtagccagctccaatccatttggaatgaaagacacagttcttgggctcctgatgaaattaattaagggaaagctgacagggagatagatggaggttgcaggactcacagaaccagccagcgctccatttgcaagagctgtgtcagggactacaagctcagtctcctactggggctgcattggtatcagaaaccacacagttctggccactgttgtcaaggaggaatataaactcagggcgtcggatctcctcatttttcaaaagaactttgtaatcttgtgtaaaatccctcaatcttaaaatattggcaaataattcattttttccctccagcattgtgcagatcaaataaaacatccttccaggctggattggtttggcttagattctctgtctgtcaaacacacacaccccaaccccatcctatcggcgacacagacagccccgctacatacattgctctcactctagcaacaaatcctgcagacacttttcgttcacccagctgtcttttctgtggcttatggagagtgtgagtgtgtgtgcgtgtgtgtgcgtgcacacatgcacgtatgcctctaaattacatgactgtatccataaagaaactataataaactctagatagttggccatcagtcagcctctaaatcctccctgatgaggtcagatatcatcagaaggagcagctctcctctctggggcgtcacagaggcctgaagaagcaggtcatgcgtgacctggagggagggcagaggacacgggcctcaggaccagcgtgtgcaaaagcatcctcgtgatgatacagcatgagcagtgaggcaggacggaggacgtccgtggtgactcggggagctccctgcatgaccagccgcagtctggaggtggctgcccaagtggcctcttcagtctccccagggagccacgaggggagcacaatttacctccacttaatcctcagataaattacatttgccaactcaaagcacaaagtaagcctgtttacctgctacttgcataacaaagactgtgaaaattaaacgtatttgaaacaagtagcaggtccctcatgtctggtcagtgttttacaacaactgcgagaatgctaagtgtcaatgcacagcccaacctagagcctccagtgctcactgggaccccttgggatgggcaagggcaaagctcagcaaagaagccacatcactggggagctgacttctagaatgacagcacaagtcgctcagcagacccctccccagagacagctatcactgaaaaaaaaaagttttaaaaaacataatcatttaaagtctctgtacattttcctaagggtttacagcaaattgagaaaaactggctcaagaaaatctactaaatcttgttaagaagactgagtctgtggcacttcagccaaaacctgcttccctgcccagcttggtgtgagagaggctctgctccaagtaggtgtgggcaagaagacagggctccactccctccagctcccagtccagggctacggtatctccccaggctgggggaggtggggaaggctgcccgcatttctcattccccccaactttgtgctttagaagctctactccagataaaagcagctgaaaggttgggactcccttcctcctccaactcatagtatgcagggtgtggcaggctcagaacactggggcctcactgccctcatctctgttgactcattgggcagaggttctacactgggagagacaagctctgaagattcgaagcgatttcccccacccagtgccctgcatgagaggcagacatgtcactccacaaaaagtgggccactgtccttgcctgcagctccagagcagtgcctcaggaattcttcccaggaaaagaagctacccattaggttagagaactccaaagtgctccccatgggaactgatttaaagcagagtggagaagttcaagcctaaggtagtctgggaaagaacggagctttgcagcagggaacgaagaggaagctggtggctccgcgacaacaccaagataaaccatattccggctggtttactggagacagccagggaagagacagctcagaagagccttcctggggtcagaacaaacctcaaagactggcctcaaaaatacccctacgaaggggcctggatttaatcagatcaagctgtagagcatcatgtgccccaagctattgttgggaacaacagagccataggctggcaatgagtggaacctaacagatggtgtcatacaaacataagtagagagcttgagagagaggccatggaaagagacagagagagccctgctaaaaccactgccatcccagggtgactgtacatgcctaagactgccctctggggagtgatgtcagaggaatcacaccacaggagaaacagactgtgctaaatagtccagccaagttactaaacaaataaataagcaagcaaggagaagccatggaaggagggaatcagaatcaagggtggctacaatgtgtcatctaagatgacaagtcttcaacaaaaaactatgagatatacaaagaaaccagaaagtgtgacacacacatggggaaaaatccaggcaatggaaactgcctgtgagaaggctcagttgtcgtatttatcaaaaaaaaagagacttcaaaacaatcactataaatatgttcaaagaactaaatgaaactgtcattgaaaaagtaaaggaatgcataacgaccctgtctcatcaaacacagaatagcaacaaagagatcaaaattctaaaaaaagagccaaatgaaaattctggagtcgaaaagtataataactgaaattttaaaaatccactagaggggttccaaaatagatccaaagtggcagaagaatcagtgaacttgaagagagataaagaaagattacgcaatttgaagaacaaagaaaaaaaaaacaatgaagaaaaatcaagagtcttagaagctgtactgtaagtgtactctaaatgtggaacaccattaagcacaccaacctactcataatgggaatattagaaagacaggagatagagaaaggaacataaaaagtatttcaataaataatggctgaaatgttcccaaatttgataaagagaattaatctacacatctaagaagctcaataaacaccaaaaagtgggccaggcatggtggctcacgcctgtaatcccagccctttgggaggctgaagtgggcggactgcttgtgcccaaaagttcaggaccagcctggacaacatggagaaactctgtctctacaaaaatacaaaaattagccaggcatggtggcctgtacctgtggtcccagctactcaagagggtgaggtggaagcatcacttgaggctgggaggtggaggttgcagtgagccgagatggtgccactgcactccagcctgggtgattgaaaccctgtctcaaaaagaaaaaaaaaaagtaaacacaatgagatacacacccagacacatcagagttaaaatgctgaaagacaaagagaaagtcctcaaagaatcaacagaaaaacaattcttcaaatacaagggaccccagtaagattaagttttgacttattatgagaaacaatcgagccagaaggcagtgagatgacataatcaaagaacgaaaagcaaaaaagaatcttatatctagaaaaactactttttaaaaatgaaggtgaaataaagggatttccagataaacaacaaatgaatctgttgctagcagacatgccttacaagaaataacaaagaaagttctccaggctgaaagcaaatgaccccaaaaagtaatcttaacacacacagaaacatacatacacatagcaagcaacaccaccagatggaaactcaaattcacaggaaaaaatacagagaaccagaaatggaaatcagaaggttaatgtaactctataaatatgtacttgctctccttttatcccagcttctttaaaagatacaagattaaagaaatagttacaaaaatgtattattgaattgtgccttatacagatgtaacatgtatagcaataatcagagaacaaaggaaaagagaatatgcctatataaaaataatgtttatatcttataatttagtataaatttggaatagattctaatatgctaagatgtatatagtaagcattaggtcaatcgctaagaaaataaccaaaaaaaaaaagtgaaaaaaatcattaagagaattaaagtgttacactaggaaatattcacttaattcaaaagaaagaagtaaaggaagaatagagaaacaaaacagatagtagacatatagaaaacaaagagaaaaattgttgatgtgaatccaccctatgtgtcataacattacatgggaaaggattaaatgacccagccaaaaggcagaaattgccagacaattttttaaaaatccagttgtattctgtttacaggagatataccttaggttcaaagatacaaataagtggaaagtaaaaggatggaaaatatatatgctctgcaaacagcaactgcaagaaagctggagcgagtctactaatcatatgggacgaacagactttaaaacaaaacataatactagagatgaagagatgttttataaatgtaaaagggtcaactcatcagaaagatgtaagtataaacagaaccccaagcaacaggaaacaacatcaacaaattgaagggagaaatacacaatacaacaagtggtgacttcaatacttcagtaatggacagaacaactagaaaaaggatcagcgatgaaatagaagacttgaacaacactataaaccaacttaggcctaacaggtatctgtagaccactccatccaacagcagaatatacattcttctcaagggcatatggaacactttccaggatagatacttactaaggcataaaacaaaccctaatacagttaaaaggactgaagtcatacaaaatatgttgtctttccacaatgaaataaaattagacatcaataatagaaaaaagtgagaaactcatgaatatgtacaaattaaacaacataaataatcaatgggtcaaataaaaattaaataaatttgaaaatactttgagatgaatttaaaatgaagacacaaaacatacaggatgcagctaaagcagtgagtagagggaaatatataactatacatgcctatattaaaaaagaaaatctcaactcagtaacctcaactttcacttcgacacactggaaaagaagaagaaactaaagctaaaataagcaaaagaaaggaaataatgaagattgaagcagaaattaaagaaacggataatagaaaaacaaaaaagaaaatcaaaccaaaagttggttctttgaaaagatcaccaaaattgataaaccaagtcaggaatgttggaaatgtttccaagtgatggggactttttgcctttgattagccagtggattctccttcctatttgggtctctaggaggcaccaagaaggataatatgaagatgaaagcacatctgactttccctgtcccatccgatcaaaccccattcccacctccccccatccccacctgccccttctgtccccacttccacctgtctcatcctgtcctacctgccccatccccacctgtctcttcctgtccctcccgccccgccatcccacctgccctgccccacctaccccatcccatcccatagtagtaacggtgcttgctgtcctccgacccaaagaccttgatcaccatgctgtagaggtgcagcccctccaccagcatccatgcgaaggcactcaggaagaagtagtgtaggagcacggccatcacttggcagggggtctaggatttaaccagagatgggaagtgagacagctctggggtgggccctgggcgtggctatgatcccagcctcccagtatccatgtcctgggtggtcttttggtcatgtgaccatgtttcttcccagggtatcttcctgttgctcaagcccagggatttgggtgtagcgcttgactcagggctagccaattacagcaccatgttgcccccagggatggtgattggttcaggagagggcacaggactcaggcccaaccaatcagcaaaactatccattccttgcaacaggattggctcagggatgggcacatgactcacctggtccaatcagggtggattctggggctaaggcagggactatggaagagtttccctcccttcaagtgaggactggagcaaggaactttggaagccacgtggctcccagagaggtgtggagcctgccgcctgccatgtggctgaaccctacatgctgggacttctagttctaactaaattgactgcagcttccaagttgtagttacccagaactgaaaggggctcaggcgaccatgctgctccataggcttcccctcaatagggctcagggacagaaaggcagggccttgggaacctctccattccttgcctggggcctggaggccccaggtgcccaggacggagagagttgggccctgcacagtgcagcctcagatcctcctggggctccactcctctgctccctgtgagtccaggtgctgggaacagccagggcgtgtcccttagctctagataaaaggtccaggaaaccagagcccaggaaggaacacaaaccaaggaccccaggacaacccagctctgctggcgctccaagttctgtccttcagatacgcccaaggcagttagttctcagagaagaaatgtacaagccactaaatgtgtttcttgtcatcatgatctgttatatctagatacaaaataagacatacctattatttttgttggctcagcaacccctggccctgtgtcttccaggaccagctgccccttttccttggggagcagccccttcctaccccagaggctctggtgggaccaaccattacaatcatcctctcccatctgggcacaaaggtttaccctgtaggcatatcactcaaacaggaccaactggagcccttccctgggattctgacccaggtctctgggagagcgggacccatcagagcccttccctgggattcagacacgggtctctgggagagcgggacccatcagagcccttccctgggatttagacacgggtctctgggagagcaggacccatcagagcccttccctgcgatttagacacgggtctctgggagagcgggacccatcagagcccttccctgggatttagccacaggtctctgggagagcgggacccatcagagcccttcgctgggattcagacacaggtctctgggaaagcaggacccatcagagcccttccctgggattcagacacaggtctctgggagagcgggacccatcagagcccttccctgggattcagacacaggtctctgggaaagcgggacccatcagagcccttccctgggattgagacacagggttctggaggaaagatgctctcccagtcccctagggccaccagctgggattatagacacctggagctgctgcagacctgcctcccctcctgctgccagcacacagtgggaccttgctccccagtatggacttgaacaggcagcgtcagcatcacctgaatgattgatagaaatacagcattctgagctccacccagagctcctaaaccaaaatctgcactgtaaggaatcctcatgggaggtttcacaccggagcctgagaagcgtccagcaggagaacatgaggccagtgcacaccccatccattccacggtgcatccaggaacttctcagatgctcccgagtctgaggtggggtgccctgtgagggaggtgcttgctgccacatgaaggtgggtctgtccataggcagcagccccaggacatgcatggggacaaagggctctgctgggcagtgaggaggagaggctctgctgacccgctaggcatgggataaagcgttcatcttctgttggccaatcctgattgcaccctaagaccacaggcttatcctgctgggttcctaagagcttctgccagaaccagctccctttttcctcccacacatggagcaggcagccctctgtttttctcttccatcaactagcttacaagcccacatcattccactgctgggtcacttcagagagtctcagctctttgccttctgtgaggtctaagacttcttagggccccagagaaccccccactccatgcaaagggcagggaaagatggcatctaggtctgcaggtctgcttcgctgaacagaggtggcacaactgtttgctgtcaagcagctgatgaagggcacagcctgcagccaataagagtcttggtctgcccacaccaggccgtcagcttggccaaggactgtgagccctgtgccccaattcctttatctgtaggctgagaggatgacagctggttagagggtgacatggcttcacagatgcaagcccttgtcatggtgcctcgcgcgtagctggtgctaggcagtgtgagtgggtggcggcagcggcagctttacccgaggctggcgtgcagcacagaaaccagctcatgcacgtcacgatctctgcttcccccgagaaaaccacagccctggttgtctggggagatgggttctgaaatttgagttgaaaaagctagcagaaggtgccacccggtgacatccgaggaggcaagggaaggacagcgcaggaacacggagctgcgcccactcaccgtgcccggctcgaggcggaaactaatgagcagcaggacctgggccaccagcacggcgaaggacaggttggcgtggatgtggtagcgctggttccggatggtgctcacggagctgaggacagaggcagggtgtgaggcctgggccctgcgccgacccagtcccccaggctgggctccctggccccacgaagtccctatatccattcctccaagagcagccagaggggttgctgtcactccctgctgtggaccatcgatggctccctattgctcttggatctgaccccagctccttccatgcccacacagccctacacagtctgaccctgggccatggctctgctctgagttcctttctttcccagctcatgttcctgcttctcaaagccccagcttattccagctgtggggcctttgcatagctgttcccatgcagtaaaccctctcccaggtccccgcatggcggcccaaatgtctccctcagcgtaagcttcctgaccactgctgggacctagctgcacccctcgctctctgccctgctgcctcgtggcgtgatcacagtgaagatgtttgttctcgcttttgtttacttggttattgtccagcccccatccaagcatgttctcatctctcttgggcacagtcgggccctcaaagccgaccacacgcctgtgctgaggaacgtgggagcgagagtgaatatctgagcacagggctgaggtgtccccaggcccatggccatccccttttgcctggctcgggttccaccagaattcctgtgcctgggctgggggcctttccagacctttccagctaagcctggtgctcttacctccacagcccctcccctctcccgtgtctcttccatcttgagatctgggtgcaggcaggggccgagagactgttgggtggattagaaaaggggactcacgacagcacggcgaaggtgaccagcgtggccaccaggcagagcacggagagggagcagcccacatagctgatagacgacagcgccacctggtgtccgcgtgcaagctgcggggagcagagcagaggcgtcagcagcaggcccaggcaccccatcggagcctgaagctgcagagggcccaggtgggtgcacagctggtcccctgtgagtgtggtgctgaccaccaagcctgcctcccagcccaaatgtctgttgctgccaccgacagaggccggtgctggggttgcagccctggttctgtgcgtgcatgtccggtgccccgaggtgccctacagaacactgaggctccctcagccacagtctccagactgtggctgcctggcccgggcaggcgctgagcctcctgtctacactgcaatacacagggctgcagactaacagtcagccccagagccagacctcccgggttcaagtcccagctgggccacgtcctggctgacaatctgggccatgtgacactcggctgtgaaatgaaaataatgacccctctccattcccacagtggccgcaaggactccatgaatttacaaacataaagtgctggagcagctagggaagagctggttaccgccccggcctgaggccacgaccctcccagtccccgcacaaagtagtgctagggaagagctggctaccgcccccgcctgaggccacaaccctcccagtccccgcacaatggctgccgcctgcacactgtgggcctcaggaaagctctctaaatggacacggtggtgatcgccagcacccgtgtctgctgggtcccaacaccttgtgggaatgaggcagaacagaacacacctggggattaagcggctgcagggccacaaaggatagaaccgaagccgcagttcaccgaccgcacaatccagacggcgccccctcggttctgaagtcggggcctcaagctcagacacatgtgaccctgcgctccaggaggctccgggctcctaagccacaggcctggaagggcagcctcccagctgctcacgtgcaggagggcgccacgtgcttcctcctgtggcccatggctcttgtcagaggcccagctgaagcctgaagcctgcatcatgctgtccctgtccggcactgaggccccagaccccagacccacgtccccccgtcctccgagacgcctgcctccagcttcctcctgtggcatgcgggtagggggagtctaaatgccttctccccgatcaccaggacaaaggaacaaaaggaggccactctgagtgtgtaaggagctgttggcaatgagggaggagatgccgcaggcccagggggccccagctcagggtgaggcaggtagtgcactggaccacggggagcaacctggggccagggggccatgggaagcccgaacactcagcaagcaccgccttcaactgtgattcacagcggagtgggctcacgcccgaggggctacagacgtgctagattcctgggtgcgtggggctggggtaggggcagcctggacgccacagcctgtgcctcccattttagcaggagctcattttcaccctgcaggccctggtatcttctctgagaaccagtgcttgcagaaggcagggccttggcctggcccccttcaggagtgaaacagctgttgccatgacaccagcagcatttcccctggaggggcccttttgtgctctccggctcagggacaaggcagagaggctgagggctgggcagagccacctgtgctgaacgccggctcaggcctcagcaggcaaggacctgcgcacaacttccaatttcccaggggctggacttccctctccacggacgttgtggctatcacgggaaaggtgggcactgcgtggccagggccagggagacggaagaatcccccttccaggttcatgatgccccagggagagaggaggggcagtcacaggggagcccatcagtatccctgaggatgagagggaactttgaagaaatggggcccccgtcccctcaggagaatggctgcggtttcttgttcttgtttctggttattgcagaatcatgcagttaggggtaggagagccccactactccttctcccatggataaacctttttccttcaactcctgggcctggcctcccatatttgagaagaccttcaggctgttgacctctgacccctgggaatcacagccatgcccgtgggcttccctgcagcaggtgccacgatgtcccctgggtgtgtgcctccatcttggcttcccctgaccctcatgggctctcctgcactgggcttgaggaactcaaggtggagactttggtgaactcacaccgactctgcccagagcccactccctatcgctgcctggcaacacccagggcacctgggacgctgtgggcgaacaggggcctcccgggggcccgaggctgcccagtgctgcccatctctgctccaccaggtgggagctgaggtcacaggcatcttctgccagcagaaggggccttgtgggaggggtaggcactcatcagtcacctgccgagtatgtttggcaaaacaagttcctcaacaggcgggtgctgccagtgcattcccaccgcagcattctcggcaatggaaacaaacatctccacctgcagaccgacgggccaagagctactcccattaatcgcatagccgcggtgggtgaagggaactcagtttctaggccacattccccacgctaagtgtgtgacactccagtttccgcatgacattattagcaaattgtccatgaaatgatgtttctgctttcagataagtttggaaaaagctccattctctgcaccccttaaaagactttttggatgaatataaagccacttaagagttctgaggattctgcaggtaaaataaacccccctgttcagctatgttcaacttggcatctcttaaactctttggaggaggaagggaagagacccaatgacagcaatagagatgtggtttaagaagtgctgttttagaggaagtgagatgtttcagaaactaagaataaaaccaaatacaggacacactgacattatactggatatgcaatctttctaagacaactgaaaagtcttgtctctcacactgatctctgcctagagatggaagtaagggtcagttacaagagttttgggcctcagcagagggaatggttcttggaaacgaacgtccagctcttcagcagttaccaaactgaattcagttaaaaaccaatggaggccagacacagtggctcacgcctgtaatcactctgggaggccgaggcgggcagatcacctgaggcgaggagtttgagaccagtctggccaacatggtgaaatcccgtctctcctaaaaatacaaaaattagccagacatgatggcccacacctgtaatcccagctactcaggaggctgaggcaggagaatcacttgaacccgggaggtgaaggttgcagtgagccgaaatcgtgccacttgcactccagcctgggcgacagagccagactccatctcaaaaaaaaaaaaaaaaaaaaaaaaaaagaaagaaagaaaaagaaaaaaaataaaagaaagaaaagaagaaaaatcagtggaaacactgctagtaaaggaaagaaagcagtggtgtccaaaagcctgcctggcccactgccctgggaagccccccaagagatgcaccccacacaggtctccaccccacaaagccctggctcctccccacccctgatcatctctgctctacccaagtcatctcatgtcccaccagagggatgcatatcactctcggacaccatagctgcatttcatggggcatcgtctctcccccagggacacgggaagccctgaggatgcattagggaagcttttcctacctcatctcgcagctctaagaacagcagtgagcagtactgggaacaatggtaaccagaggtatttgctgaaggcgtcaggggagaaagagccctcacatctacccatctgactctgccactgattcaacagacagatttcctaaatctacatcactgattaatatcttttaaattgagaaaataaagctttagctcatctatttgcaaatgcagtgaggttccagtgggctgacatgagagttcgctgcacactgggctgcagttggtcagccaactctctaaaacatcttaatctccgttcttggccacccattctactgggagtttctgacaaatgggagtctagccctagccccagacccacacctacccacttatgccttaagccttccaaccatattatcgatcaaccttatcgccaaccaaccatgccatcaaccaacccattatcaatcaacccaccatcaaccaacccatcatcaatcaaccttaccattaaccaagcctaccatcaaccaaccttacgttcaaacaatgcatcatcagctaatctgactataaaccaactccaccatcaaccaaccttaacatcaaccaacccatcatcaaccaactccaccatcaactgaccttaccaacaaccaacccatcatcaaccaacttcaccatcaaccaacctgaacatcaaccaaaccgaccatgaaccaaccttgccatcaaccaacccatcatcaaccaatctaccagccaattccaccatcagccaaacccaccatcaaccaaccttaccttcaagtaatccactatcaaccaactctaccatcaactgacgcatcatcaaccaaactcatcataaactcaccttcaaccaacccactaccaactaacctaaccattaaccaacccattaaccaaatgcatcataaaccaacctatcaatcaacctgattatcaatcaaacccatcatcaaccaacccatcatcaaccaactttatcttcagccaatcctaccctcaaccaacctactgtcaaccaaccctatcttcaaccaaacttaccaccagcaaacctcaccatcaaccaaccccaccatgaaccaaccccaccatcaatcaagtctctttatcatgtacttttatcaaacccacccaaagccagcatcatgccaggcacaatggggagtactaaaaagaaagacatatggctcttcccttgaactgagctaatagcctgaccaggcagccttgaaatgattgtaagaaacataaggccagacatattggagggtcacatggtacatggtgcttgagttataaggtgagcccataggtaaaaatgatagatgatcaaaatgacctttgaaaactcctgagatctcccataaactggagtctccatggcttctgcatgtaacgttatacattcttcttccacacaatggtctgaataatgaggccgacttcaggagggatcaagaagaaatggcatgcacacgtcagggtctgcaaacctcactgcttcaacacagctttcaagtccacagagtggactgaggcagaaggtgacaatctaggtgatcctgatagtggctcactgccttctctttactacagggactttctagttgtaacacacattcagccatggatttgtcattgtattacttaaccctgcaacctgtgttaaatgttgactccaccacgacctgcacacagccttaggaaactggaagggagggagggtgatctgaaggagggggagagaaatactgagtgggcgttaggagggagagggcttcacacaggcctcaatgcttgggcaggaacctgacagacaggacaggagacagccttctagaccagagtgatgtgagctctgacggtaagttccatgaagacaggtcgactgtcttgtttaattctgaatccccggggcccgacagaggatctggcaaactctaggcatcatggagaatcacagaagagtggttggaaatgacagaaacgaggcacctgctgcttgaaggcatcgactcctcagagcaagcctgtgagtggacagcatggtttccctttacagatgaggacactgaggcagccgcagtaaatgactgcccaccaccatgcagctggcgagaggcagggctggggctgacccgtgatggcccctgctacagcagcaagcatgtattcagcacctactgtgcaccatgcacggaagtctcattgcagtggggaagcgggtgatgaacaaagacgtggatgtgtaaacgtgaataaatacctaaggctgccagtgtcgtgttgatgaggctgtgatggaaacacacaggggcggtggcggaggtgactgcagagggaagagggatggtggccctcacacggccatgatctgagaaaggccctgacccaggcccttccctctcccttggagcacccacctccgagtcctgctggcttctcaccactggccatctgtcccaatcctctttctgatggatttctagagcctctgccttgatctcttcagcctcctgggcttccctggtctccccacagcaccagccccatcctctaccatgtccctcctggcttgggttccgctgtacactggagcctcgtccctcatggctcaccccctccatagcgcctgagtctcagactcaaacccccattcccccaccatggcttctgaggccccgcatgctccagccccagcccgtgcctctgacctgcctccatccaccctctcccttcatcatgggaaagcaagaccctccccgctcgggattggacttggggagctggttatgaaggtgagggaagccctgaaaaagcagagaaggcagtgaggcagcccagacagcagccactgcgggagaaggaagtgaggcccagacagcggccaccgcgggaggacagtgggagaggggacagcagcagagccaggccgggccaccagcagaaactggaaccagaccagcctgcccaggtgaggctggcgcgggggtgcaggggagggtctgcatgcaggcgctggagccacagggggacgcccatgccagcaggagcccaggcaggaggctggccccttcgcccaccccagcagcaccatctctccttggttggacttggcaggaagccaagcgtagggcagagagcagggtgagcagaggatgggctcccgggcacaagagcaggaactccgggctaggtccacactccacccccacaccagcccttgaaccaaccatctgctccccaacctttgacgcccaccctgtcccggccaggctggctcctgcctgtctctggtctctccgcggctggcatccaggctctcacggggcctgtctcccctcagggcagccctcagcccctggctgggctgcactcctgcccttggctcctggacagcacgagtgaccaggccctggcggatctgtgactccaggcatccctggtttggcggccatccctggccgtaggcagccgtagcatgtgccagcagcatgcagccagcctcccccgggctgggtccagttgctggcacatttcacgtccactgatggaaatgaaccgacagcccggggacaggtagaaatgagctgcttggccacttgaggggtgctgcaggacgggagaggactggccacaggcaggagatcttccccgaggacccagctgggctgctgtgtgtttgaacagatgctgggactggcctgcctcgggtcacagtgaccttgttgaaagtgtcagctggggggaccatcaccctcttgttttccagaccaggaaccctgggggctcctgctgtctcccctggccgcacagcttgtgcatcagtctggggccatctgggaaaacagaaaccactccagcctttcaaagagtggaacatttgactcagggaattgctaaccctcgggaggggagagaaagggggacctcataggggtagtgaggtggcccaggaatgagcctcgccacaaatccccccgtggaagccagatccatagactgtccagcagggctgcagccacagcagaggcgtggccactgcccaaaaagccacgtgtaggggcgagagaagagctgctgggcctcctcccctcccatcacctgccccaagtgacagacctgcaactcagcacagtggtcggccgtgggaggcagagccgggcagcaggaggcaggtggatctcagagcagaacccaggactcaacatgactgggaactcagggctgagtccccactgtgccccagacgatggctgctttaaacagttgtggcgatgtaaacctggactggcagtgccccacgggaacccatcctcacagatggaggcgggatataaaactggaccggcagtgccccacgggaacccatcctcacagatggaggcgggatgtaaacctggaccagcagtgccccacgggaacccatcctcacagatggaggcgggatgtgtgcataggatgctggttatttgctgcggccaaagaccaccatgacttcagtgtccacccgcgggagagctatgcagtggttaacacgggagatgtggctctgtgtaccctgagaaggagcaacctccaagatacgtgcatacattttttaaagtgtgctatcttgccaggcatggtggtgcacacctctagtctcagctgcttgggaggctgaggtaggaggatctctggagcccaggaggtcaaggctgcagtgagccaaggtggcgccactgactccagcctggaccacagcgtgcaaccttgtctctaacacaaataaattgtaaataaaaataaagggtgcagtctttatgcttcactaccctttgtttaaaggaaggtttgcatccattgaggtacagaaaattttaaaaacaaacaaaaaaagaacaaagagcaaagcggggccccaggctcagcaactgcgtctggaatgacagaaaagcaagcgcgtgtctaggccgctgctctgggcagggccgggaggcaggaatggtggccgtgaccctaagccgctgctctgggcagggctgggaggcgggaacggtggccgtgaccgtcagtttccacactctgccttctgtgttcttgcattttcccacatgcgtgtatcatctttacaaacaattcaacctacagaacccctctgtctcctgacaccccagcttcctgtatgtcccaaaaagaaccctcgagctcctgtcccactcctaacacgggggctggcggcttctcaaagacggcccacatccccactctaattcccaagattcaacacactcatgacaaaaaatacgtgttgaccagaaacctggcctgcttcagacgtcaagccctgaccacagccttgcagcccacagctgccccgcaaagcgacccgatccctcggccgggctatgcgtccatctgccctgggaacgtccagtctggcccctgaccatgttcccagtcctggtcacccggcccaccctcagccccacagagtaagaccccaattctgagggtagccccgaaagaagatcccccaagacaggaccaccccagaggctgctgcagctccctctgcagagcggctccagcccagcacactccagagcagacacttcttcaggagaattagggaataaatgaagcaacatatgcttctcctctaaaaggagcagcctgggtctggttggaggaggcaacggcaattgaatttgtcaagaggggcaggggtggaaccctcagaaccttgaagctacgtctccctgcccccaggactgcaaggtgcccaggcagggctggggctgagctgacagcaaagctgagtcccggcagcaactggctgctgctccacctcgaagtgcaggtttttacctcttaggcccatttcccaatgtcccaggtggccagcagcctgagagtcggggggactgaagggagagatgggggtggcaggtgtcagccctgttcccagggctcactcagctctccactcagagaggcacaggccacagggtacaggggagggccctgggggctgagagggggcgtctcgagggagactggaggggcatgggaaggggtgggtagggcaggagacgggagggggtggaaggacgcatgcccctgcgcctcccccgggtgagctcccagctcccatccccagcccagctctcagcagcccaggacagggctcaggaaaactcatctgtaaggcggggcgggaacagcgtgcacccgtgcacctggagggcttgctggtggaatggtaaggagcccatgcagaaggacccagcaggctttgcccaccaccctctccttctggaagaactgcacaggctgggaaatcagaagggatggtgacaattttctgggtctctaagaggatggtactgaggatgcatgccctccccactcagccagaagacactggtgaaccacagtattgcttggggagtcgggggggcgctgctgaacaaaccaacttccttgttactcctgggcaaggcaggaccctcttctgcctccaggattagaggggtccagggatgggtggaggggcctctccttggagcccctccagcctccacagttacccccacccccatcaacagggcaatagaccgtcctgccccggtgcccacagccacaggactgaaccttccttatgaagagtgaatggaaggagacttgtggccatgaacgggtcaatgctgggatggctgcagtcccaggtgcagtagccaggcctgctccaccccaccccactcccactccactctcaggggtcctcagggccaggacatccctagggacctcatactcatggctcactgtgacttcactctgtcaggcagtgtttggggctgggtgctgaggctgggtactgaggctgtgtactgagactgggtgctcagggctgggtaccgaggctgggtgctcagggctgggtgctgagactgggtgctcagggctgggtgccgaggctgggtgctgaggctggggactgaggctgggtgctgacgctgggtgctgaggctgggtgctcagggctgggtgctgaggctgggtgctcagggctgggtgctgaggctgggtgctgctgaggctgggtgcttgggcctgagctgtgcttacttctgcctcctcatcaccaccacagctccacaaggaaagggtcccacccatgtcacagcggggaaactgaggctcagagcaggcacctgcccaaggccacctggcacatcactgggagggacctgtgtgtccagctggctgggaggcagaggggccactactaaccccagctgcatgcaggaggtgttattgggaggtggtctggctaacattcacacagagaccccgtggagggagcctgtttctgacttgagctgtacatgctgcggctgccggcactgcagttggcacagtcccgcctgtgacacaccctcgggaccgcaaatacagctcagagtggttctcacagctcccagcaacaccgtgtaattcaggcccctgccactgcccgccctgtgcccttccctggagccagggcccatctgagaggctcaaggctgcacctggctgggtaaccgcggggcacggggcctagaaccatgggtctgggcggaggctgcactgccgttcctgcctcaggaaggcgtggtgtgcccccacggtgcccttcctttcccacccatagctagatttagaaatgcccagaaaagcctgcagttggtttcaggacacggactcctctgactcagaaactacaacctcaaatgcctcctgagaggcagggcatcagctcaggaggccagtgggggcctgcagacataaccaccaggtgggactgtgctgccaaaacaagcatcctccctcccacagttctaacccaagtccttctcagtgcatatgtcactttcccaccaagacaagagcaggaagcatttcactgtctcctaaaagcagaagagcgatgcgaacgtgatgaggaggggcagctgcttgtggtacggggaggccatggggaccggggggccctggggacctcgccctgagtgcaggggtggtagccactcgcctccagcatcgtttccagccagagggggaagcccagcgtggccacatcttcctcttcttgttttatttaaaaaaaaaaaaaaagaaatcccaaattttagataaaatgtctgtgttttggaatactgacaaccaatttttaaaaatttaagcctctgtgggctaggagaagcccagtcactggccagagtcagccttcagaccacggttcatgaccgtcctattgaaatgctttttccctgtgaccaccaggccccaggagcgggtgctcggggactggcattcccaggtgctcctgtactggcacagggctcctgcaccccccaggtcagagccaccccaaggcaggtgcccatgcctgggacgcttcccatgcctgaagcctgggaagtggccgcctgggaggaagtggccacctgcaggaagaaagagcgcaccgtggcgggccctgggactcctcccaacctcccacacgctcctcgaccactgcccttcccactgggtgcagccttggcaggactgtctatcaatatcgggggctctcccaccttagacaaccagaccacctccctggcctgcacaccctgagcggggaacacaagcgccaggagtaggtgcagctgaattttccctaaggccaggcccaaatgccttccacggcaccagtccccatgcccagcaccttcattgggtgtgtggcttcagcaagaaacgctgagtagtgcacgcctgagccctcctctcggtccctggctgagccagcccacacctgcatccacccctgtgttaacctcaggtcctcactccctcgcaccctgccagccagtccttagggaggacagaaagttgagctcccacctacctgcggcagtacagaccagttgtgccagcatgactgggatccaccgactaaaccagcacgcatgtggcattctggcctccaaggagaacacatctctttccctaagttcctctcctcttgtggaacagactcactcctccataccctcattcatacagcaaacacaggcatgggcgtgtctcagcacccggacatcaggaaggcgcagtgaacatgaaacaccacccctgggtagcaggcctcagaaacacctctgccagcaggctgactttactcatttgatcatatcacacaattccacacaaatacacacctgggtcagagcccacaggctggtgtttacagtcctttctctccccagctcctgccactgcctcacctctgtggccccctcctcgccccggcccactaacaaccttgaatgcactgcccgtgcctttctgataatcacataccaagatacaaatgttgcatatttaaacacatatacagaaacacacccacgcataggggattttggcgtggctttacaaaaatgggatatgtatcactctagtctacgtcttgtccttttcacacaatgttaccttggaaatccctgcaaacgcactggcatggtgacaaccccattctttcacagttacaccgcgtttcgtgacttcatcattcctcttttagtatagagatgaataatctcccttagcgtggatgtattagaatttacacaatcattagtgttatgtttattcatgcttctgttatttctactataaataatgtcaatattctgattttatacttttttatgtcatcttacttgctgattcttttaattctctgacatagattctcatgggtgtactgagaagttacagggtctgttctggatgaattctctatctgttccaatggcctacttttctaggataattttatccaattaaaagaaaaacttgccttctctgggttcttactggatctggggttgctaatttcaaaggggcagaaatcaggcctggggagtggagcagttggggtggtgaagggtgggtctggatgcagatctactggacagcccaggggttcgttcccctgcttgaactgcactcagcaggagaagttagaagcacccagagatgacgccatgtttctgtgactcacatgtaaagcaaagctacccattcttgaccctggctggaggagcaataaattggtacacggttcccagagtgcaatgcggcaatgtctttcaaaatcaaaatgcctgtgccctttgcccacagattcacctgccaggaatttattctaaagaagcatgtgcagggtcatgcactccggaaccactggaagtcgccagatgctggaagccatcgcagtgtccatcagcagatgccttgacatggctcctcagggcctgggccctaatcaccatgttgacagcagcatgcaaagacagagtgtcgttttggggtctccctcccctggacagcagccctggagcccaccccagctaggtccagttcactcaggtgaactctgttgtctgataggctttccacaaaaaggacactgcccacttaggaggaagagggcttcccgaaacaaccgccaaggaggaggctggatatggagaaaagccaggggaaaacctcggagagagaagggacacgatgaggatgtgagctcctgagcagaaagcctgcaccaggaacccaaagaccagcagtgcgagcccagggccccgtggaagacatgactccaggtcacagaaataaggtcactggtgctatttttattaattctctgagtatgctgcaaatttggtttctacttatgatatcagccttaactttttttaatgttgatgagaatgttcatttttagcacagataattttaaaccattttcaaatcaaccttttctggcaatgaatagatgcgatttgctcccacgaagacacccacagactgtcaaaatccagtgtcactgagagggaacggtgacggatcgagaccgtaagtcgtctctgtcccaggttttttactcgctggactgggcccttcccttccttcctctaccacaaacacacaacacacaaaaacacagttttcagctgaaagtgtaactccccctctctctggccatgccaagaaggaagtcacactgggctttagttctcagcctatagaggatccagaggaggaggctctgctcccaggcagctgatgctccagagcatgggcacaaccccaacattcgggatttggctcaaggctgggctctgccccctgatgtgacctcagggaatcacctatgactcttgtctgtgatggccacatgacagcacctcactcgtgtggtgtggactgaaggagagggcaggcctgaatgcaagccccaatgaggcagggagcatccacaggcagggagcccccataggcagggagcaccttccaggcaaggagcactcactggccgggagcacccatcaggtagggagcactcactggccaggagcactaccaggaagtgagcacccactggcagggagcacttgcaggcagggggtatccaacagttaagagcatctacaggcagggagcatctgaaatggtgcctgttactgtcttccccttactcccaggtggtcggctgtgtgaaggccacaatcaccagccagcattcaataaatggctcccggcagccagtggggccggtgcccactctgcagagctgtgcatgaaggaagacgttccccgttccctgaaggcaatgcctgtgtccagaagccccgcccactggcccttggttcgggctcctttttaacccatggtctatttcttttgtctctgaatcttccaggttctctcttcactcacttccaggctgaggacctgtctctccagttcccccctcagctcctgcgacaagggaagttcttcacatgccaacgagcacacatgtggggccggactatccatcctcagatttggtaacagttgctgcagccgggtcccatgacacgaacagaaatgcgagctgatgtttgcagactgggcgcctgtgcctggggctgctcagagggtggtctgggaccggtggggcctcactccacccgggccttgtcggaaatgaggatgccaggccccaccccagaccccctgaatgtggggtctgcatcttcacaagaccccaggcgtctggtcagcacacagatgacctctcacatatggctcagaagtaataactgacgacacctctaacagtcagaagatttcgtgggagaaacagatcgccagctttcttagtcgaagatggggcaaccctggtcatctgcagtgggactcgtgcccctccacccccgccacaccagcgggctgccgcttctcgagtcaccgcagcagcctccgccacctctcctgctccccgcctcctgcccctcacgacccctgggcctggagcccctgcctccgccctggcgtttccccgaggaccacccctggctgctccctccttgccctccgtccccaccctgtcctctgcccggactgtccttgctcagggccgggaggctccatcctctccaccctgagatgtaaaatccaccgccaccttctcaggcaggccctcctgggcttccgtctttcaaacagctccggcatcaccaggactgcgttttagagcctaattatccacaagtcatccgacatgatctcccgcgtggcccttacggggcaggacgtggcgtgcactgacttgctgtgtctctgtgcgtgccacagcatcctcactgccaggtccccatggcccgggtgctacctaaacagcccaggctctaccggtaattcaataacacgctgttgaacgacgggcgaccaccagcaagcgcccccctctctctggggctcagtttctctgctggtaagacgagcagccttggccacagcaccgtgcagtccgcccatctccaggaacgaacaggtgctctccatgggggcagctctgcgccttctcccctgggctgctccctacgacaccacgagggaagcccaaagggagccctgtgggccgggccctggcgggaggggagaggagaaacggagcccgtgggaggagagagaaggcgtcacggccgtccgcagaggacggtgctcctcaaactgaggcctggtccatggcaagaaatttaaacccaggaactgtttctacgttcaccgccctctggtgtggtttcatttactctgtttaattttctttaaattgccgccaatgatccaggtcatggccctccccagccgcgaagggcccacctccacatggaggctgtggggtctgcaggccaggagaagaggggccactgggaaggcatggggggggcgtggggactgggaaggggcagtcgctggcggggcagctgctctaggggaaacactccttaaggaacatcccctcgggattatctggcgggtcacagctgcctgcacaatatttaccactgaagggtgcgggcaacgggtgggcttgggtcccaccagcctcacaacagagccgccccttcggaacctctaaaaccccacggccctgagccggaaagccccggcacgcaagggcttggcagttccacttgcttcgtggccggcccttcttgggggaccctgcggcatggaagctactgaggaggctgccggtcccctgtcacctgacatttcatctcacgcagcgccaagggctcctgggtccaggctccaaagcacgtaggtctaggatgctgggtgtgtgtctgtgcacgagggacccgagggtgaatggtgccccctcctatccacttaagatatgtctcagagcctgggccacaaagtgaggccccatctctacagaaaattaatacatgcacataaaaaagctggtgcagtggctcacacctgtaatcccagcactttgtaggctaaggtgggaggattgcttgaagccaggagttcaagaccagcctgaggaacatggtgagaacccattgctacgaaaaaatttaaaattagccaggcgttgtggcatgtgcctgtagtcccagctacttgggaggctgaggtgggaggatagcctgagcccaggagttcaaggctgtagtgagccatgatcaaaccactgcactccagcctgggcaacagggtgagaccctgtctctaaaaattaatttatttaatttaataaaaataaaatatggcttggacatctctctgcagtctccataagtaattcacagtgtgacatcaagcatgcattttgtgaaaagaaagggccttctctttggaaacaggaatagctgtttccctctggcgtcttctgcagagtgaggctcatacgcgctcacgtgagcagctgcccgtcggccagtgaggccgggatcacactggctgcaggtgccacgtgcgtctttcgccctgtgaggggctgcagctcaggagcatctgccattttattttccatggaatttaaagatgaggttatctccatctgccccagcagcattacaagtcacttccaaaaaccagggccctgtctccattgatctgagagttaactgtggtccatcaggcctctgcacacagaaccccgtggcttaggtttgctggtggtttctgttagggagcgaggggcgcctgggctgagcgctggatccgtgactgtgtcgcagtggactcgtgtccttcccacagcacccctgggaggctgcattcctgggccctctttctggaataggaaaagtctcccaggatgggagaaggcgaagctaggattctgcctccgttacaccttgaagagttctgtctcctggtcaacaggacagtggaagcccaacccattcaacacccccaaaacccacacaaaaccacgcaggacacgcggggcagcatcaccctctggcccagtgcagacactgcggacgctggtggattcaggtagattctgcctgtccacagccttgataaatgtgaccacagaggcaggcagtgacccaggcagggacgggtgttcaagccctggtgacaaagtgcctgctgggaaccacctgagcttggtgccccctcccgggagctgctgtgatcagagacatcctgactcctcccaaagccaccctgaagagccctagactggggacgagcctccagaagtcagtggccacgatgagcacatgaggctctaaaagaccagggctccgcacggaagatgagtctcgtgacaaatctgtccgggagacgctggaggcgtcactgcttccctgcctgacttaccctccagcctggccctctctcaggccccaaaatgcccaacaccagccacaggttacagcccagcatccaacagatcgccgtttcccaacacatctgccaaacccagcctggctcggagcagccacatctatgctgtccaaaccagcccttctgtgagcgcaaccgacagacgtgagtgtgggtgtgcagtgtgcagtgtcagcagcaacacctccttccactcctggtttccacctacatgagcgtctacgtgccccaccccaaacccagggtagctcagaccaagctgctcccaggcacagctctccaaaggcttcgtatgcatctagaatgaaactcacgctcctccctgaggcctggatgctggagccgagcctgctcctccctgcctcccgcctccccagggccttggagctcagggtgctccatccacggccatgccaagccccttcctgccccttgtcctgtgcacttgctgtttcctggcctagaacattctgcccccaggccttcaagacatcagcttcctctggccattcagacgccacatcccggagacacctctcctcaccgctccgtgaagacgccccgctccccgctgtctcctcaccactccgtgaacacagcctcgttccctgaggtcatcttctactgggctgttctcttccactttcttcctccactgattcaaagtgactaatttatctgctggtttgtttattatctgtctttcccactagaacacaaactcctcaagagcaggactgtgttgtttttcttgtttacagcggagcccccagcgcccggctcccagcaggcgcccagtgagaatctgccagagggacagatggagggatgaggggtccctccttggatccccccaggtgcagtctgggcgttgctgtgcgaagcacaccacactggactcgatttacacaatcatgggctcctcggatatttgctggcacccaatacatgcaggaccctggactacagaagccaagagaatggattccgtctgtaaacacaggccccatggagtaatgtgcccagggcccgtgggcactggcgggcaaagcatcctcccgcccccacctgcagcctcatggtacgtcccccaggtcccgcgacccctgaggcctggctcttacctccagcgggaccacctgcatgaggatggcaaagttggtgaggtgagtgcagcggcagacggagtaggtgaggtttcctctcgtgagcgcacagccgtggttcgaccagaccccttctccggagctgaggacacaggagaaaggatcagaggaggtagcaccgcacccttggcaggcaggggactgagagcagcaccccccataacacatggccccgtgaactcatggcggcgcccacacctgccacgccaggaatgcacacccagaccgtggtgtgggggttgggaggagagattctggccatcaggctggcgagagctggagagtgtctgctgctggtcaggccacaggaagcaaggccctccctctgggacagggaagggggagctgcttcgcacaatcaccctgaaaagcacctggaccaagcccagcacaaaatgaaacgcacatggcccacagccctgcgcctagagaacgggcagcggcacacgccagggaccacattcaagcccagtcactgaatcatgagtgacggtaacataaatgcccatcgggggaaacgggtgagtgcagtgtgggagagagaaatatgataaaagacctcgcatcggttaaaaagaacatccttgaccaatgtgcactgataaggataaaataccaaaacacaacgtacagtgactaaccacgacgcaaggcccgtggagccaacagcaccacacacttcccacgaacacagctatgaccggcacagagactacagagaaaacgctcacacagaaactccccacggtgttaccgccagagacagggtggcgagatcaggatgagacgtaaaggtctaaggagacccttgcttttttatgttttactttttacgtgaataacgtgtggatatattacttgcgtaactttataaaatataaagccagacaaaaatgactggaagcaaacgtgctctcggttaactgtggttaaacctgttggtgtgaatattggtgaatatcattttcttctctacatttctctatattttcttttttgtttgtttgtttgctttgagacagggtctcaatctgtttcgcaggctggagtacagtggtgtgatcatagctcactgcagtcttgacctcctgcgctcacgtgatcctcccacctcagcctcccaagtagctgggactacaggtgcatgccactgtgcccaattaatacttttctttttatttttgtagagatatagtcttgctatgttgctctggctggtctcaaactcctgggctaaaacaaccttcctgcctcagcctcccaaagtactaggattataggcgtgagccactgtaccctgtcttctatattttcaaattaaaaaaaaaaaaagatttaaatggttcttccctgaagttggaacctcaagttatcagtaaagacaaatccttacttcagccaaaggcaatggcccttgggggaaagcattcataaaggcgaataaattaaaaggctctagtttgtatttgctttgaattcactttcaactgcggtgtcagcatggatgtggcagatgagaactgtggctgtccgatggcatgaccgatgaagaccccagcttgtacctctctggccaatgtctaccagatggaacacgcaccagcagcctcgggcaacggtaaccctgcgttagccctgggcgacgtggagcgcgagggaggggttgggacggtctttccgacatgacccaggggtggctctgagtttgaggatggagactcagacagcagttcagtggtgattttcatgattaatgatctgctcttctaggggagggagaaggcatttagcagagagcagaggacaaagcgagagccactcagacgtaccaactgagaggagcaaaaccccattaataacttcagaattgatgggacttaaagacagggtcatgtcctcctcctctccctccccaccccttttgatctaattttcccaggaccttggagggagtcagcaaaaaccagctgttgtgttatatattgcgcctttgtctgtcaattggctgcataagtaccatacttcaatttgaggggggggcctgaacattaacaggcattggattaggtgaacgtagccacgggtatgagctgccccttctgcttacacaaagggtaagctaaacaatatgaaagtcacatcgctcagatggagctgcaaaggtgtgacgatgacctagttagccagaggagtagagccttcagtggcatcaatgaagatctacttcccagggactcagcgaaaacaaagaggcaggcttgcagcttgtgcataaataaatctgctatggaagccagatgaagcagtatcaatagcattaaagatatgtacggccctatgacccaggaagtctgcatctaaacagaaaaatgttcagtcatgcatacataaaatgtaacatgcataaatacggtaaaaaacatgtgtgtccacacaggcaaaacacagaaacaaaaggtggaggaaggatggaagacacattgaattaagcaacaccatatatttcctatgattataaatataaattatatataaattattgaaaaaacacataaaaaaccctcccaccgtggttattactggggaaaggggtggagatcaggataagaggtaaagatcaaagggaacacttgcttttctataatgttttacttttgaacaaaataatatattgatatattacttgtataatttcttaaagtatcagtctagaaaaaaagtggcccagaattctaagcccaatgaaaatctttcaagactaaaagagaatactttttcaaatggtaactgaatctattgccagtggaccagaactgcaagaagagttaaaggagtatgatactagacaaaaatctacacaaagaaatagaacagctggaagtggaataagtgaaggtaaacaggcaattattattgtcttaattttaattgctctagaagataactcattatccgggggaaaaaatactagcaatgcattgcgtttatggtgtctgtacaaaggtgaaatgtactacaacaacagcacacagaacgggcaggaggaagtgtgaacctattgttacaatgtcttagaatatatttggaatgatatcatagtacttgaaggcaggcatgaatgaattagacatatatacactgtaagcttaggtcaaccactatcaaaaaagttaaaaggatgtatacattagaaatcatttatagtagagataaaatagcatcataaaagatatccaacaatccaaatgaagtcagaaaaagacaacattttaaaaagatagaaaagttagaagacatctagcaaaatggtagattttaatccagccacaccaatgattacatgaaatataaattgtctaaacatgtcaattaaaaacagaaattttaggactggattaaagaaaagacacgacccagctacatgcagtctaaaagaaactcactttaaatataaatatataaataagataaaagttaaattatgggaaaagatacagcactcaaacactaatcaacaaagctagagtagttttatctaaattaaactaagtagacttcaaagtaacgcatatttcccagggtaaagagggacattatgtaatgataaaagggctaatcttccaagaagacataacaatcctaaacatacatgcacctaataacagaacttcaaaattcattaaagaaaaattcataaaactaggccgggtgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaacggcgtgaacctgggaggcggagcttgcagtgagccgagaccatgccactgcactccagcctgggttacagagcgagactctgtctcaaaaaacataaaaaaaagaataaaactagaagtagacataggtaaatccaccactaaaattggagaattcacactcctctctctttaattgacagaacaagttgacagaaaagtagtagtaagaatatagaagacataatcttaactatcaatcgacttggtgtaattgacatttatagaacactccaccaagaatatactttttttcaagtgcacatgggactttcatcaaagactgaacatatatgggggtgtcataaaaacttttaacaaatttaaaagaactaaaattatacaaagaatattttctgatcataaaaaaactatttacaaatcaacagcagaaagctctctggaaaattcccaactatttggaattaaactacacacttcaaaataacacataggttgaagaggttgaagaggaagtcacaaggaaaattagaaaatattttaaatttaatcaaaataaaaacatatcaaaatgtgtgcaatgcagctagatcagtgctcacagaaaaaatatagcattaaatgtttatattagaaaataataaagcttcatagtaataacctaaacctacattttaagaacttttaaaatgaagagcaaattaaactcaaagaaagctgaaggaagtaaattaaagacaaagaggataagccaatgaaattgacaacagaaacacaagagagaaaaatcaatgaagccaaaagttatatctttggaaaaatatcaataaaattaataaacctatagtaagagtgactcagaaaaaagaagacacagattatagataaaaaagtgaaatgggaacatcaccacagacccttcaggcatgaaaaaggctaacaacggaataccacaaaaaactctgtgcctataaattaaacaactttgatgaaattgatgaatatttcaaaaaaacataaactgcttgaacttatttaaaaagaagtagacgacctacatagtcctgcatccataaaagaaactgaatgtgtagttgaaaacctgccaacattgaaaatgaaggctcaggtgacttcatggtgaattctactaaaatggaagaaataatatcaattctatacagactattccaaagtgcatcccaaaatgtaacttttataaaggtatcattacctcgatataaaaacaaagacattaccaaaaaaagaaaactgcagaccaatatccaacatgcacgtagacacaaaaattctcaacaactgtagccaattagatttagcagtatacaaaaagataatacatcatgaccaagtgtggtttaccccacaaaagcaaagctggtgaaacttccagctttaatcataatgatcccactctgaaaactacccaaatgttcctctactcgggagaagataaataaactacggtacatccatgtaacggaataccccctcagcagtgaaatgtgaaaacaagatgttgatatatccaacaatacatgtgtggtgacgctcaacacactatgcaaaattaaagaggctagactccaaaaggcttcctgcgccatgattccatctatgcacactctggcagaagcaaaactatataggaacagaagacaaatcggtgcttgcaggagccggacgtgagaggaagggatgactgcaaacagacacgggggcatcttggagggtgatggattgttctaatcctgattacggtggttgcacaactgtattcatttgtcaaaactcacagaactgtacaatcatctacaagtgtggatttttctgaatatcaattatataataataagtaataattgcacaatggacaggaaggatacagatactatattcatgatggtggctgcctctaggaattgagggaaaagaacagaaggaggtggagggttcgttaacatcatctgtgatgttttagttgtttcattcttaaaaatacaaaaatataaacatgctaataactataaatttggggcaatgggtacctgcatttgttatattattctccgtacttttctatgttcttaaaattccttcaaaaataagaatcaacatgccaatttagttcttaccaaatcccatcccgttttctagtcataatttttttctccaaacagtgccccggaattggaataactatttctaggagcacatgcttccaaattttcacaatttacaaataaaggaaaaagagctgcaacctgctgagcctgaccagggcaaaatcactgaaattacagagcatcaatccacattgcagaggcatgacgccaacggtcatagccagacgccgacggccatagccagagtgaggcatcccgggggtcaaaaatgtaagcagtgtttgctggaggtgacaggagctgggctgcactttcctcgctgttcacagaacagagataaagggagattatgccgacctgctgctgcacccccagctcagcgtcttgcaatctcctggccctctgggtgcagggagcagagacgctttctctgacggggaccataccagcagaggtggcacagcctgtgtggatcctgccctgaagcagcaggaggagggagctggggaagtgagtccaggcacaggaagatgcccaggtgttggggagccctgacaacatgcagggtgatgggccactaggcagggtgtgaactggatgtcccagatgtgttccagctgcctgtgcagtgttttaaacattgggacagttcatataataatctagccatagccaggcacagtgactcacacctgtagtcccaggactttgagaggcactttgagaggcggaaggattgcttgagcccaggagtttcagactacattgagctaagatcacaccactgcactccagcctgggtgacagagtgagaccctgtctcaaaaaaacaaaaacaaaaacaatatccagccatgaaaactgatgacctggcaacacaggacctgcaacctgcatcccacatggaacaagccccaggggccacagctgagcagcagctgaggatccggaggccccacccctccctccactccccggccctgcggggagctgagttttcaacaccgctgtgactgtgggagccattcacggtgggctcacgtctagaggagaattgtgatcacagcgatggtgggagatcccccagacattgggcaggtgagccgtggaggcgagctggggcaggggctaggagggcgggaggagactgcatgtgacaggtgtgacaagtggacatgggagatgctggggaggacgtcccagtcagggcccaagtggcagaggctgaggcctcagagttttaggcaggcctgatggtcagcctgctccagtggagccggcaaggtttcaaacaggaaaatgccaacgtggctagtcagaagccactcccccaacccccttcctcagctgctccaagaccctcgagggggacagccagggctgtagggcctgctccaacggacagcatcctccagctcccccgagcatctgctgcactggcttgaaagttgccctgggcattcagaggctttgtccagacacatcgtgcaacagcaggcccctcctcgcatggtctggaggggaggcctccacccagcactgccaccaggccctgcccacatctccagcatttccagcattttcgcataacgcaaccatgtcagctgcagaaatgggtgacccagatcctcccctgggctggcatggggcgggcctgggcttggacacctcatgcccacctgctctcccctgtgcagagggtacctgaagtccaggaaggcgcagtacacgaagactcggttgctgctgttggtggcctcactgtgctgcttacgtgtctgaaatgaaagaaagcaaacacgatgcatgacgctgctgaagaggcccctggttctcagcactgatgtgagagcgagacccttacagctgggcgacctcaggtagggacaggcatagccactgatgtctatctccatccattgtgggtgtggtcccacatcacctggcccaggtcatgctgccctctgctctgccctccccaacccacccaagggccctggcaggtgccgggccctccctctaggacactcctcctcctaggacgtgcctccccatagggtgctccccaccaggcagccacaggctccctccccactccccaccaggtagccacaggctcttccccactccctaccaggcctctgcaggaggagctcctcagagagaccttcccttccctacctgttctaaacagcaccggcaccctgcccactctagctccattccactcactgatgttttcatagtcttgatcaccatgtggcatattacatatccactgtccactgtgtgtgtttgctaccttcccctctacaatatccactacagaaaggatagagcttctgtctcattcacggctgcatccccaggacctagagggcatctggcatacagcaggtgcttactaaatatctgttcaatgaatgaacaaaagaatcagtgaacaggtccatgagaccaccttgttccggagactggcgttctctcctgggctgctcctgggtgccagctcggaggactctgcagctatgctctaccctaaatgaaaggcacagacaccttcaggagccatagttggaggctcaggaggccagcgactccaccaggacccagggctgctcagaggtggcatggctccgggataaatggtgtctgatggattcccagtcagtcaagtcaagcatctcttatttgtccgatgcctgctctgttctgtgacccattcctgagccatcattgctccaatgagacccttcccccatttcagggtgaccagccctcaggaaggcactgacttgtgcaggacagagccacgagggcagcccccctcatgagcgccatcctggcctcgaccaaaagcccctcctttcccaggaagcagcagctctggtgcccctgacaggcacctcggaccccactgcagaaccaaaggactcacagggctatcatcgcagcatctgtctgacagctcctccagcctcaacccaattatcctagtgctgtctactactaatgttttggcaaaatggaacgtttactctttttgctttgtcccccacccctgccgccccgtatcttagggttattttaatccatcacagggtctcttaaaaccgcctggaaaagacatcttctcctctgtcttcccaaagccacagcctgctgtgaactcttgcacagacaacagagggccctgtgtcctgcagccaccaggaccacagaggggcatcagcaggaaaactgcagcaccaacctcacataatagaaaagatgaacaaaaacctggtggccacagcctggttctcggaggggtgtaatgaggcttccttgggcccaggctacaccagggccaaagcctccagcagacagcgttatatgtaattttttaacaaggaggcgtatttgtgtgttacctgagtaatttaaaggaaatttaaaaaataagtcggtgacctggggaagccagcagccagacccatacacatcaacacgtggcaaggcttctcaggagtgaggcgacgcctcttcccatcaccccctcacccagtgccagcccccgcctctgccccacgtgtggaagcgcagtcccaagggagcagagaagaggctgctgtggcctctggaagtcctgacactctgacttcagatctaaatcactcttcaaaggaaatgtagaaaacagccaccaccgcaacaagccaagcatgtgtgtggtcggagggtggggaaggcagctagcttcctcttggatctggagccaagatcacgccctgaaacggggaaactccctcccctccatcgtcagaggttccatcacagcctccactcctgggatgagaaaagcaaattgactcttcatgtgtgtggagttccccactgactgggaacaaatgctctcagcaagtctccagaaaagggggcctcccgggctcccaggggtgtgacgtggggtgggtgtgtttttgatatgggagtgtggtggtgccagaatgtaagtcatctgcatacaggccccatctcatgcagaaatgtgggaggtgctcacagcccacgagcctccctgaggcctgggtgaggcacagaagccagttcagttcgtcaccaggtggctggggaatgggaatgaggcgctccctccctgtggagtcttcaacagtgttgggggacagccgcattcacctgagcgtcctcctgaaacctcaagccaggggctgctgagctctgctggacagaagtgaaggcctcctcacagggccggctccatggcaagtaacctaatttcccactagacacacttcacttgggtatgtctaatggggagtgcctgtgagccctcaggaatatctcccacaggatctgagatgtgctccaacaaccatcatgatctttccagtcagggagaagcaaacgggattaaccaactgcttgtttattgcctactgttcatgagcaaggtacaccaaagtgtctccttctaggagatacatgcagagagaagaaaaaaatttgatactcatgatagcctgttaatgccccttgtttagaaatgtgctggcttttatgtaagtattgctagggtttgactgtgtcccccaaaagctcatgtgttggaaccttaattcccaacgcagcagtgttgggagatggggcctttaagtggcaactgggtcatgagggctgagccctcaggaatggattaatgtcactgttatgggagtaagttagttcttgcaggagtgaatttgttctcatgaaattaggttgatacaaaaagcaagctcgactcgctcttgcagtctctttcactcacactggctttcctttcccttttccaccaagaggtgaagcagcacaaggtgttcaccagacacggctgcccgagcttggacttcacagcctccagaactgcgagccaaaataaacttctttcctttataaattacccagtctcagatattctattataacaacagaaaatggactaggtgtacagttttacctgtaaataatttggggagctacgtgtccaacattgtcccaagcaaaagagagatggcaccatggtccttaaatttgatggtaagtaaagcaatataaggagccgaaatactgaccccagagcagtgggtcaggtgcaggtggatctcagtggaacatctggggcagccctctgtgccaccctcttctccagcccatctcacaactaaacagggttcagggctttgaatgcttgaaatgtcccacctttagggaaatcaaggataacagaagtaatgggagagatacgacaaggaaaaaccttgaaccagcctctatctcttggtgctttctgaggtttcttgctttcaaagagtcataagacagtccagcatggatgaggcagccacagcctgatagaggctaagacaggactttcagaacctggttccagcacaggaagaaaaaggtgggaggtgggcaggaccctgaatgaggcatttcaggacaggttgatgagctgggccaccccagtgctgagaaggaaaggttaggccaggtgagaccctgggacagatggcccagtagagcaggggcacatggtggggatttactactctgccttcaccccactagtgccatctgcatgtgggcctgtctggttaagtcactctccccagtgctggctcctgggcagaggtgagcagtgccttggggcgccaaggatacccacagatgctgctcagacccttaggacatcccactcagcccaggctgcttcagaaaccagaggcatccttcttccaacatgtgatcaatccatctgaggacaacagcagaggccctggaacatgacacccccaagtcttccctctccaggcctcccaggcccatgagcctgcagagatctctttggcattaaggcagcttgaaggggtctgtcctttcaatggaataagtcctgaccacagaatgcaggcgccaccccccacacacatggtgctgacatgtgcacgtccttattttgagatcatggggccagatctcaatcctagagagcagcctccccaacctcacaacctactgcttccctcttcaaaggcaactgagcacagccaagaaacaccaggcagaggggtagacttgtgcagacaagcacagcccatggccacctgggacgcaccagggtcagagagacccaccgatgccccctacttcagaagaccccaggaaacatggtttttgccaaagaccaagaagcttcagtttgctgtctgttcatcgtcaaggtgggatgctggtctggtaagagacccaccatccagtgtgaactggactctaaactgtgtccctccctccaaggtccccaagtccctgtctcctctgcgaaacctcaggagtcccgtttgagaagaaaggggcccgcagacacctgattctcacgctcggtttgtgcacaggtgccagcctgcaagccggagaggcatgcagagaggaaactgcattgctgtttcaaaacccaaagaaaagaaagtactctgaattgcgtggggatctggagttagggcagcttgccccgaaactgaacagaaagtgttttcacatcaccccctcgccccaggtagcacccagtcacgcggctctcagtggaaagcgcggcacacgaagccaggccgggacccacagcccaggttctgcatttggcatttagcagctgcgatgtctccgagaaccctgcagagacggagcccacagaggagggtacagcgtggaccagaagccaccagaagccgggcgaggcggctgagttcagtgctgtcagccagaggctggggagggagcaccctggtgcccgcatccctggtgagccttgaacccggcatccgggtctccactctctccttcctcgggcctcctggacacataggacccgccagtgcgtgcacaagttgccctctgtggcccagcagcactggggtcacctgcactgtggccatggtatgtgtggagaggttccatccttgggaaagaggtcctgagtgtcctgggagccaggaggaagaatctccagagacaaaccagagaattaaccacagggaccccgcccccttaactccaccccactcacattacccttcccactcacatgacaccttcccactcacatggctcctcttctcccagtggcctcgccccactcacttagccccaccttccttgcacatggctccacctcctttcacttagccccacctccttgtacatggctccacctcctttcacttagccccacctccttgcacatggctccacctcctttcacttagccccacctccttgtacatggctccacctcctttcgcttagccccacctccttgcacatggctccacctcctttcgcttagccccaccctccttgcacatggctctacctcctttcacttagccccacctccttgcacatggctccacctcctttcacttagccccacctccttgtacatggctccacctcctttcacttagccccacctccttgcacatggctccacctcctttcacttagccccacctccttgtacatggccccaccctctatcaagtggctccagcctctcttacattcccctgatggtgcagcccacagccccttctcaggcccactctgaccccaggactcttctccaccatcctggatggcagactcacccgactctccaggacgtcccgtgcagacactccatgaccacatgggcagggcactagaggccagccaacctataaggacacagcctgaagtcacatgtactccacagtccaatcagctaaggctgtgggtggggccaggaaggttccgcccaggatagtgctgtgggtggagccttgcagtgatggacacgccctcatctccgtggcaaccagctttcctcccacctctgctcactgcgcacctggctctcctctcacctggatgacgcagcagcctccactcgtctcccgcaccgagtccccgcagagcagcaggtcaacttctaaagcgcgtctcagaccgcctctccctacagaagccccaggggctcccagcctccgagtacaacacaaactcctacccacctgcaaagccggcgcctcgttttcctcctgagctgcggtcacgagaccctcccacttcagaaaacaaaaacgctgtcgctgcccttcgtctctgtctgtataagcggactcagcaccagggggtatttgcgggggctgcggagctgcctggagacccccgcccagccacagaaggctctggaaggaggcggcctctgctgagggcctggttttgcggtcatcccctagaatgctggagtctcgcctcatacaggtcgcgagcccgtggtcaccccactcgggtgtgacaggtcccccaacgctaagcagagatgtggcccagaagggctccaaggacccaaggggtgcccagggaggctcttcccagagggagcattttctctctgggacaggatgttcatgctcaggacagacctgcacacggacaggcctttgcttgtggcttcatctccgtgggaataggaacctccacatcggatcgtcgtggatgagtgacactgaattttctcaggcccatgttattggaaagcaagggactttggcatttctatcgcaacaaggcgacctgtattctttcatacatgcaataataattaacacgttttaaataattttcactcattaggctactcaaaacgtttttatacagttgtctcattagggcttatttttggcctgccctttttgtgccgaatacaaaaatgatataataataccatataagatattttctaagaccttggattttgtcttgttttcatgacttcactctgatacattgtgctccccttatccttccaataaactacctttctgctcaggagaaccagagtcagcgtctgttgctggcatccagacatctctaacaccccctcacaggctgctagaagcctccactgagatcatgtgtgtgagccccttgatggttcctaatgatggcaatagttaaccttttccacggacctgccctgcgcctggtcctgctctgttttacatgagtgaagtcattcaattgctcagcccttgccagctgcgcacactcttgccccactttacaaatgaagccacgaagccacatggtggttggaggactcacggcaagtgacggagctgggaaggggccaattcaggactcaggtcaagacatcctggttccagagccccaccgtgacccaccatgttactcagcacaggtgagttacactgatctttatctgtcttttcatgccctggagatggaattttcctagaatagccactggctcccccgcctggtacatcatggactcgtagtgcatggccctgccctcagatgcctgtgacgtcagagatggaggatgggcctgctgggctctgtcagctccaggagcctcagggtcggggggacgatccacaggaatccacgagcctcccagaacatggaaggccatggccccagagcatccaaattccatctaatggcatctttcaggagtaaagaaagaggcagaacagaaaatccatatagctgctgtgctcggaatgaacacgtttacctgccgaagggcactactgcctaatctcagtgctgcagtcagtccagaaaagcaatacctataaacgtctataaaagtgttacagcttttcaatttggctcctgggccatggctacttgaaatctcagctagaatttaaaggttgtttctttttttcttccctttgttcttcttgtcatgaagttggccaaatggtttccatcaaaagatccaatccattcattatccttttatttattttgttatagctggcctctacccaagaagaattttggatgacttacagaaacaaggggaaagcattgctaatgccagagtgtctttaaactttcaggagaagcagatatgctgtggtttttcgcatgagaatagtcaggggttcatagaggcctgtatgtggaatcatgtcaaaatcagtgcggagtcaaacagcctcagccacctggaccctcctcacgttggaaaagtcatcatggtaccaaggcctggagtggccaagctcatcccactccacgccttccctccccgcccctctgtctggtggggaagatgaacattctttcattcctagtagaatatctgagattctggtctgtctaatgttgggccagaggcagagaaaaaaacccaaatgcccagagttgaccattccagcgccacccatgagacacaagcgtgcatcatcaaacccagcaacacgggtttccagaacagagcaggctgaggtgtgcagccactcagccccactcggccccagacctctgcctgtccgggattccaagtttccatggggttctggaaccagcccctggtccccatggtgaccgatctggtggcctcaggaaagtggctgaggtctttagagcttggtgggacttctctgaaatctccctccagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacagaaggtagagggcagcccctgctcagaagaaggatcaggggcacagcgatcagaaatacaggaggcagagggcagcccctgctcagaagaaggatcaggggcacagcgatcagacatataggaggcagagggcagcccctgctcagaagaaggatcaggggcacagcgatcagacatataggaggcagaagaaggatcaggggcacagcgatcagacatataggaggcagagggcagcccctgctcagaagaaggatcaggggcacagcgatcagacatataggaggcagagggcagcccctgctcagaagccaggtctggaggaggcccagagaggcctgacagagccaggcacacctcctccagggcctgggctgaccctgatgacgcctgaccagtattctttctccagttctttctcactaacagaagcagttttttgctcggggtggcaacgtgcccagctagacaactgcaaaatctgcatctccgtcctccattctagctccagctctaccaccaccaatgcagcttccccacctgggcgtccacaggcctcccaaacggagcatgtccaaacctccctcctgacctcactcccagccctggactgtcccagagtcatgcccttgtcagttagtggccactctgtccttcaactttttgagcccccaaatccttgaccctgtcagcaagccccccatagcagacctgaagctaacatcctccactcctatcctgagcctggcggcagccccgtctacctgctcaccctgccctgtacagggtttgtgaaagcccaagtccatcgcttcgtccctctgctcagaccctccgggggcacccaccttactcaggggaaagccgaggcccttaaagttgcccccgggcccggaaagatctgcccgtagcccctgacctgcctcctccagcccctcggcctcctggccgctcctcagacttgaaggtgtgcccccgccgccagccaggtgtgtgatgcctctcccccgatgccccacgatccccccatccacgtggccactcctcagggcagcctcctgccagcaggcctcccacgtgctgctccttgggatctgatcttgcatgtacctgtcactgcctgtctgtctgcctgcttgtcacctccccaggtccccagcactgggatgtgagagtcacagggcaggattcggtctgtctggctctgtcctctccctcacagcctgaacgggggcaggcatgcaggggcactccgtgaacttcggtgggatgaacccacacaaggtggcctgcggtagggagggtacagggggccgaggacaatggcccagccaggcatccctgctgggagtgaacggacagggccaccgccccacagcctggaaggtgctgacaggccacccgagccctaaacatcctgatggagtcacccctcggagtgagcagcaggtgcagatgcgtcggcgggaaaccctagggaaccaaagcctgcggtgcttgcagacgtgagatcacatcctccgccctccccgtggcagaggatgagcggccaggattattgttttctaaaaatattcaaatcttgtagcggtcacaatcctattgtggctcctatgactgctggagtcagggtttatttctttactgcctgctcatgagtctggagttgccccacaaatttgcttccagtttggctcaaatggactaagggcccctggcccggccctggggctctaaggtttaacctcagcctcacccctgccagagttcaccacagagacatcaggtgtccccagaaactccacagggactgggcagctcaaaaggtccccagcgttcctgagaggcccaaagaccagggctgagccaggtctcttcctccacccccggagagggccctaacctgggagatgggggcttccagccaggagcagaaattcagagtctgtggtaagcaagtcacaacaacttttatcctaccttatgtggggaagagagaggcaaacctctccctcatctactgataaaaataccccctctccttcatgcgcacaactaacaaccgaggaatcacacctttaaacacacctggcctctggcaggggccttccctgcactctgaccccctccctcccatcacagactccagcctggtctcaaaagggacccagagcctgggtgcctctcgcctgagatccgtacaagggaagctgcccaacccaggacagatccgtatcaggaaacacagacagtgacaggcaagggcctgtctctgacgcctcctcccacgggacaggggtgactccggttctgtctccagagggagtggggtcctggcactgcataccagccttggtcagcggctccagcagacagagccgagggtccacgctgctacagcagggcccgagcgttctcatgatggtttgcttttcagacaaggttcactcttgttcagaaatcaaacctggcaggagcaacaccaacaggtgtgttttcactctggtcaatcgcttcccaagccaccctgtcactccgttttctctcacctctactgagccactcacctggtacagaaaaaaatcaaccctgaacccccggcaccatttaagatttgcagagcagatgtttatggcatcagtgtggggaatgggatggccacgtggcttctacaaggaccaaggaaagatttattcgaaaaggacttctgagagtggagaagggagtagaaggtaaatacatacaaagagagaggagagggagaatctgatgaatgagggctgagataacagcctgcctagtgctgctcatcctgttcagtaggtctggctcactagctcaagagctgggcagtttgatggaattaatttacacatctatgcatctaggcaggaacgctcacccagaccagtgtacccaaaaggagcatctcagcacttgaggattcactgattcccaaagaaaactctcctttccctttgctttctaaaacaacatatgagagtggggaaaacattaaggtttctctgaattaagataaactcacttgagtagcgaaagggtcttttctatagaagatatgggatcctcaattgagtcatttcctccatttagaaaatgtgctccttaaagagaccaagtgccaacacttttccttacagtgtttcataaattatgtgcccatatattcacatggcccatgaagcaaaagatgatagtattctcctaatacacagaatgaagatttagaaagaaaatgcactatataaatatagccccagtcttcaattggaatgctgtggaatacaaggctgactcaatacttgaaaattagtgtaattcaccatattatcaggctaaagaagaaaaatcacatgatcatatcgaggcagaaaaaccaacaaaatccaatatctgttcatgattaggactctcaaaaaactaagaataaagggaaacttcctcaaataacggacacctataaaaaacctagagctaacttattagtcgaagacagaatggtttcttcctaagacagggaataagcaaagatgtctggtctcattactgttgttcaaatagtactgaggattccagccagcacagaaaggaagaaaaagcacacagatcaaaaggaagaagtgaaactgtccctatctgcagatggtatgagcatttatgtcaataatttcaaggaatccagaaagaaactcctacaattattaagtgagttcatagtcactcaaaaaatgtacatttaggtgtaaatttaacaaaacatgcataggacctgtatgccaaaaactacaaaatacagatgaagaaaaccaaagaagattttaaataaatggagagatacgccatgttaatggattggaagactcaacacaataaagatataaattctcccaaaattaatatacagtcttaatgtaattcctagtcatcccagcaagaatttttgtagacacagaaaatcttactctaaagttcatctttaaaggcaaaggaactagaaaagctaaaacaatttcgtaaaagaagaataacgtgatatgaatcatgtgctcaagctgatttcactctacctgatttcaagacctactacacagctacagtaatcaagactgtgtgggactggcacagggacaggcaattagatcaatgagacagagccgagaacctgggaacagccccacacaagtacagccaactgatttttggcaaagaaacaacagcaattcaatgaaggaaggagagtttttttccccctcaacaaatagtgctgaaacagcacctcatacaaaaaaattaattcaaaatggaccatagattaaatgtaaaaaataaaaccataacacttttagataaaaacaaaggagaaaatctttgggaccaagagtttgatgaaaagttcttagtgatgacaccaaaaatatgatccacagaattagaaaatcaataaattggactttacaaaatttagaagcttcagctttgtgaaaaactcttgttaaaaggataaaaagataagctgcagacaaggagaaaatatttacaaaccatgtagctgacacaggattcatatctataataatccagatccataactcatatctatctataatatctatagattctatctgtaattcatatctataaaatagaaagaattcttaaaattcaatgataaaacacaaaaagaatccaattagaaaatgggcaaaagatactaagagacattttattgacgagaatatccagatgacaagtaagcacaagaaaaaattttcaacatcactcatcattgggaaaattcaaattaagaccatgatgagaacaactaaaataaaaaatagtaactataccaaatgctgtcaaagaaactaaatcactcatacattgctcatggaaatgtaaaaaggtacagacactctggaaaatagtttggaagatttttttttaatattaaatatatttaccacgtgacccttgtattagttcattttcaccttgctaataaagacatatccgagactgcataatttataaaggaaagaggtttaatggactcacagttccacatggctagggtgacctaatgaggagcaaagtccggtcttacatggcggcaggtaagagagagctttcgcagggcaactcccctttataaaaccatcagatctcaagagacgtattcactaccatgagaacagtatgggggaaagtgctcccgtgatttaattatcaccatctggccccccctttgatatgtggggattagttcaaggtgagatttgggtgaggacacagtcaaaccatatcagccctgtaatagtactcctgggcatttgtctcacagaaacgtaaacttatgtccacacaaaatgccgtccacaattgttcacagcagctttattagtaatagtcagaagctggaaacaaccaaaacatccttcagtgggcaaatggtcaaacaaattgtggtttggtcaggcgcggtggctcacgcctataatcccagcactttgggaggccaaggcaagcggatcacaaggtcaggagttcaagaccagcctggccaacagtgaaaccccgtctctaccaaaaatacaaaaatgagccgggcttgggaggctgaggcaggagaatcgcttgaatctgggaggcggaggttgcagtgagctgaaattgcaccacctcactccagcctgggccacagagtgagactccatctcaaaaaaaaaaaacaaaaaacaaacaaacaaaaaaatcaaactgtggttcctccattccatgaaataccacactaagcaatgaaaaagtataaacaactgacctatacaaccatgggcattatgctgagtggcaaagtccatctcaaaaggtcacttactgtatgattctatttacagaccactgtcataatgacaaaatcataaatacagagaacagaacactggttgccaggagttagggatggtagaaggaaggcaggatagcaacgaggagatctgctggctggtaaaacggcctgtatcttcatttcagtggtgattccatgaatttacacctgtgttaaactaacagaactatatacatacatagcactgatgttagtttcctggtttgacattgcgctgtatttctctcatttgtaatcactgggggaaactggatgaagggtgcacaggacttctttgtaattatttttgcaacttcctgtgaatctatcattattccaaaatagaagtttaaaaaaacagttaaatcaacatcagatcaactataaatgagtcaagatttctagctgggggaaacacaagcgtgggcaggcgagaagaggatcctactattaagccagaggcttgaatatttacgtctcattttgatttgctgagttctgcacaggaacagggaagtcagtggtaagcctgtgacggggacggcaggtgacagctggctactgatcccaagaggacccatgactaacgttctcacgaagccaggtcagatgggttgtggtccctcctcccctgccttcaaggcatactcccagcctgagtcactgggggtgggaacacagggacttttgggggccataggcatcaccttgagaggctgggcggggctcctgactgcaggtcctgatgttataagcctcattatacttataccgctgacctgcaggatttgttctgaggcctgcagtgggggctgggggagggagaatatgacgccctgcatgatcctgagctcattcacagggatgagtctcacgggtgtccaggtctgaacagtgttacgtaaaatgcaccccaggaggagggaccttcaggactctgtccactctgttctccatccaggtaacatgggcggggtggactgagcccctgggaggccagaattaccacagcccatgagcttggcccaagggtcaaggagaagaagggttgcctgagaatccaggcaatgggatctccaggcagtgagatcataagtgattttacattccgcatcccaaagtttttgatcaaaagaatccaggggtagctactgatacgtgagggaagatggaagacacagaaccatcaggtgtcacaggcaggggtaactgactctgatgttgttggacaaagagtaagaatcagaatccaactcctctggtttagtggtacggctgctgatgcccctggagaggctgctggtgtccgtaaggcccccttggccacggcctctgtcacccaggactgacttggccagtctctgcatggtgtgacccagccagcagttaacagccagcatcgctctgacacagcattgtccatgctgctgggtcttttgaacatgacccctgctgtcgctgcctgcgtggattatttgcctcctgagctatttgatctgatatgtccagtaaccacagaggaccaggaaaggggccacctagacaggcagtaattagctactccaaataccacgggagaaagtgtggccccacccagcctctatgagcaaaggctgagtgggtatcagggctgtggcggatgccccgagcatccccagggaggtggcactggagaagaccgagtgtgaagccatggggagaagcaatgcggggcatcagcagagccctgggggaacccagtagccatgcggcacccagccctcaccaggactccaagggacacagagcaggcactcggactttcacccccacgccgcagtactgcggcacatggcccttcccagtggtgggtatcagagaaggactgctaaaacagatttaaataagatccagagtgtcataacataataaccaaagtgtccaggatgcaactgaaaatcatttgtcataccgagaaccggaaaaatctcaacttgaatgagaaaagaaaaacaacagacatcaacaccaaatgatgcagacagtgaaattaactgacaaggatttttaaaacagccatcataaaaatgcttccatagttacagacactcttgaaacaaatgaaaaagagtctcagcaaagaattagaagtgcttccaattttggactttttcagattttgacatttctgcattatatgtacccggctgagcatgcctaagctgaaaatccaaaatctaaagtgctccagtgagcagttcctttgagcgtcatgtcagcgctcagcagatttggagttttgaagcatttcagatttcagattttcagattagggatcctcaacctgtataaaggaaaaccaaatggaaaatttagaagtgaaaaatagaataactgaaatcaaaatctcaatggatgggctgggcgtggtggctaacgtctgtaatcccagcaatttgggaggccgaggggggcagatcacttaaggtcaagagttcaagaccagcctggccaacatggtgaaaccccatctctactaaaaatacaaaaaaattagctgggcatggtgtctattagcacacctgtagtcccagctactcaggaggctgaggcacgagaatcacttgaacctggggggctggctgcagtgagccaggatggcgtcactatactccagcctgggtgacggagtgagactctgtctcaaaaaaagaaaacaaaacacctcaatggatggctcaacagcaaaaataaaaatagagaggacagaggaaagagtagtggacagaaggataatttgaagaaaaacaacataaattacccaatcagaacaacagagataaaatagattttaaacaattaacagagccttgaggacccgtgggacaacaacgaaagatataatatccgtgtcactgcagccccataaagagaagagaaagggagtggggttggaaaaacagtccaatggccaaaatttcttaaatttggcaaaacatataaacacacagattcaagcagctgagcaaactcaaaccggaaaacctgaacaaatcactgccagacacattatagtcagacttctgaaaaccaaagacaaagaaaacaaattgttgaaagcagggagagagaaaggacatctcacctacaaggccagacaattagaatagcgtggatttcccatcagaaactgctgaggatggaagggagcggcctctctcaagagctggaggaaatgaactgtgcaccctgagttctatgtccagcgaaaatacccttgagggatgaagaagaaacaagaacgttctcaaaggaaaacagagaatttgatgccaacaggccggacataaaaaatgtctaaagtacatttctggaaatggaaaggaaatgataaaagaaggaatcttgaaacatcaggtatgaagaaagatcagtggaaaataaaaatatggtcccagcctgcaaatgtgtacggtggtaccttgctcagcaactcaaacccagcacattccaaacagatcactgaaagggcatggaggtttctgttaggccaagcagccgacccgccctgggtcacatcctcttgaggagctccactgacccaggacgctcacgacgcttccctagaatccagcaagcaacagacacagctactgaaaatgtgttctgtaggatctggaatctgagccctctggagggatgctatgaaataaaaaacccagactctgccatcaaagaacttctagtctcatggggagggcaaggccagaatccatgaaaaaaatattgtcagaaatgaaaagcacaaaagagtaacctctgaaacccctcttgctctaaacttctggatctaggaagttgctgtctgcttctcttaatacttatttcccaataaagttacaaaggttaaaataacagaagctcattctccctggtgcatagacaaggaaaaacatgaacaagaaagaagcgagatgagcacgaagacggctgcggtcagtcctgcaggaaagcacatggggtccttgactagggaggtaccagtgaaggcagagacatgcagacccattttctgcctcatcccagctccacctgtgttgtgggttgaacggtttccccacaaaattcatgtctccccagaaccctcagaatgtgaccctatttggaaatggggtccttgcagatgtcattaatgtaacgttgaagatgagactgtgctagatggggacgagccctcagtcccatctgagtgtcctcgtacactgcgggaaaggacaatgacacacggaagaggaggccgtggggagacggggcagagactggagttggctgccgcaggccaggactactaggagacaggcaggggtggacgttcccgctgagcctccagaacgaactagctctgccaacgcctttgtctcagactcgtggactcaagagctgcaggagaacggctttctgctgtttaaagccactagccatttgtcacggtggccctaggaaacggccacagcagcgcagactcggctccgctgccatctggccccttttctccaccgttccccttccaagcattctctggtccgcggcgtgtctcaacacattaggaaccactgatgccatccaacccagcttcaggggtgaagcacagagcttctctcaaacaccagcaggcgctcgccaggcagcgttccgtgcagttcttcaaacctgtttatcacagcgggggtagcctgtgattatttcctgcaacaatttcctccacttcaaaaattacacccaagtcgttgccacaaaatcatctctctaaattttatcccgttactctaatcattgtggacaatgctaccataattagtaattatcctccccctccttcccagcatcctaaatctcatctatttgtcgaatgtcaacacacgtgagtccaagacccacggcacaatcaacgcctccacaactggctcctgggacatgggtgtcttcagttctccccagggacatggcttccttcgtcgtcctagggccctggaagctgtattaacacctgcttgcatccagaagcgtgtgctttgttttctctttccaacacaaggatctcttgtgtggtccacgctagaaccaggggaagtgattatccccacggggtcttccgccctgtgtcaggttccatggtccacccacatcaaaggtgctggctctgcctctaggtctctttccagactatttttcttctcagatgcctcttgctcatggaatattcatgttataaattatttttctccagacacttggttagaattttgccaagttctccacaacttcatgttaatgttatcggtgctgtgatatagcacagtatcagaggaagaaaagagaagcctagcttaaaatacagcctcagcaatgatgggctccatgtttcccagaggaaccctccaccttggcctcttgtccccgaattttgacagagtcagggccccagtgtggctagacctgagctttaggagaacattctttataaagatcaaaagaatgggcagtggtccttgcattgatcattctcactggttcctgtttccaatgccgcaacttgggattttcccctatagccggcaaactttcctcctggattgtaaactaaagtacaacctctaatgtgtgtctgaaaaagcgtttacgatcagaacaagttaacactgcctctatgcatatcagtgatcctcaaccaagaggaaaaaaataatattttcataacacaatctacaaaacaggactctcaatatattccttcagggtagaagatttcagatgatgggaaaatttccatcataggtttgcccccaggggaccatatcaggagctcccaggggtgtaatcctcactcctgtgaaaataatggtgtgggtttcaaagtttgtaaaattctgatctattttacagcctagctctgtggctgttaataataaccggtcatgtttgtggtcttgagccctctgatatgccacatcaaaaatgatgttattttccatgaaagatgagtggttttacttagaaaagaatgggggaatctgacagcccacagtttgcttctagaaccgtctaaggagagatatgctctgtgaagctctgtggctgtccccagagtctgtgctcgttcatatttctgttcgtctgctttgtctcacagtttcccttgtttgctatgctactttgtaagttcacaaatgaaacagtttaaaccaggttttcccaggcctggagcacacaaacgcacaagaactctgaagtcaacaacatagaaagccttccccttgaaattctcccccacatattaaaggataacttttaacaaggtaaatcgtgactctcatacagagataaaatgaacacacatcaaagatattatttaacgtgttaatgggcaagggaacctgtgagatgtgaccgtcacttcaaagggaaattcaaagaaccatatgtacatgagcccatcccgaacgctgaagtcagtgtgcttaatagacacaaaactggcagaacttgatgtccagggagaagaatcaactgaatcaaccagacgagacctacatgtcaatggccaaggatcacgtgaatccgtgggcaccctgtcactcacagggttgtgaggtggctcagggacatggtagggagcacagactcccgagaatcaggtaacccagataacacccacttcccatgaaacgcattcagcaatctttttggtctatttcaaaatcttccataatttttccctccacaaattaagcgtatttcttaaaatctaactttccaaactaaaaagatatggccaagttcaaaacttaaataaaatttccatgcaccagaaacaggatagaaacataaagtaacaagctcagtcgagacttgtgcccaagacagtgtaacaagaccggactcaccgcccgttggcaccaactgaaacctaaggtgagtttgtgaatttgtgcctttcacagcactggacatccatcaggcaatgaaggggaggggtgcatgagggacaggaaacagcgcagaagcgagctctataactgccccggagctcagccttgagacagttcccagacgctgcagcagcgaggggaacctaggcaagacccggcagagaccctggtgctcagatatccaagaccagtgaccggagaggagagagctgcatggagtggagggcccctcgagttctcagcgcagcagagactggcacatgcaggaaggaagcgcccagaacagggaaagaaccacccaatggattacagggaaccgaactggagctcacacagggccaggaatagcctgagtccacacctgccggcctggaaaccttggaacttctagggcactgggtggagcgcacagaagggtcttggctcgctagtccagtaagcaaaactggacttagcttgacactaatggcttagcaaaacaataatgctgagtggaaaacgccaggccagaaaagagtacatactatacaattccatcatacaaaagttctagaaaatgcagattaatctatggcgaaagaacaagtattagcggttgccttgggacaggggagggaggtgggaaggaacagggaggggacagggattacaaaggggacccagggaactttcggggtgacacacacgttcatcgtcttcaccatggtgatggttttatgggtaaatgctttgaacactttacacatgtgcatttatttttttgccagttacacctcagtaagtgtgtttttgttttttttattgtttgtaactgtgcaggtgaagcagctctaggcctggggactctgatacaggtttgggttcttgtggtgaggggttaaaacccaaggtgaggggaagcagaaactgggagggagacagtaaatgggacgggctataaccaggtgagagatgctcacactcacaggtaatcagggaaatgcaaattacatcttcagtgagatcctgtttcacaccagtgagggtggcaagactttacgtctactacactggtgggctatcggtgctgctctggacagaaatttggcaaaaatcagcaaaactgaagtgtttctcaccatgtgaccccattcccaagcacaccccctaagtaaacgacatgaataaccatcagtagagtaacggctgagtcagtggtggggttgtcgcagcacactaccgccctcccactttggatgtttgtctttgggtttactttcttgagatttatccatgttgattagcaccattctggttcattgactttgactgatgttatggaaagtctaaaattcttaaaaacagccctgtttatggggttactgtggggtgatggccgattacttctgaaatgatcacctgtcattctcaggccacaaaaatcatgtcaggtcctctctaaatcactatgtttgcttctacagaaaaccctttacttaaaagatacacattttcctgatttagcagagcacttcagcagaattaagcagccttgatcgaatgaagacgggtttccaagaaaataaaacattgacaacatgccacagcacatgcacgtgaagaaagcagggtgcaaatgttcacagcacaggaacggggcagggaagtggaagcagacagcagagggcccaggccatcaccagcctgcactccgtcatcacagtgactctgtgggcactgtcagagaaagagctaccagaaggactgtaaattatgctttagaaaccagcatgccaccaggagtgacttgggaggtcccagtgccccgatctgaccgagaaaggcccaggcctgtgcagaaaggatcatttggccccactgtatggcagagggagctcatgttttctggatcaggcagaaaaacagccatggacatattctgtgctataaactggggctgaggtgccttgggacccagctcttgaatgcacctggcagacagtgtcgtgttctccacaagcagagatgtgggactggctggccttcagcaggtctagtggcagatgctcccacctgccctctccagggtcctcacccctccagagctacctacggctcctcaggggctcatgaaaccacagcatcctcttggagtcaatgccatgaggccaacaggaagaaatggagtcctagaggtgggttgttttggctactcagaagctactcacacttctgtccatttaaccctaatttaatttcactctagtgagcctctcattcctcccccacaaagaccactccccattccctaggtctaagccaatccgtgcattttatgcccccccgactgctcctgaataaagcagaccgtgccagccctggcggaggcagatgcctggttgcagacctccaggagagccctggaagcaccttttaattcctcagtgaatgtgaagcaagagccctcaggaagaacagagctcttgccctgaatgttccagctatagaagaagagctcgctttggggactgagttcgggaacaggtgagaagacgagaagtgatggtgatgtgggcacaaggtcggagtgaaacagcaggaagccagcaggtgcccacccacgccagcctcaggacacggccctgaccagggtgggactcggtgcaggggttctcatctcagagaaaatgagccccgggagtggctcgcacagcccagtgttcccaggcagagcttttccaatttgtggagcagcagcagcctccccttagctcggctcctgcaagcccttctctccaggacaaccttcttggggtaataaaggagggtcccgtgcaggccccaggaggagctggaagttttcagatcagagctcaccatgcagggttatgaaagatgtgatttctgaagcaggaggaggagatctcaacataagccatttaattaagaaacacagagcagggagatgcgagtttggaaacatcctttgaagcaaacttgatcctctccatatgtatgtttcaattcatattcaattcaattcaattcaattctccaccactctggaaacagaatgttttctccttctttaaataattgcctactggtagagaaatgctaagaaagtgttaggaaaacagctatcgcctgggcgcggtagctcacacctgaaatcccagcactttgggaggccaaggcaggtggactgcctgaggtcaggagtttgagaccagcctggtcaacatggtaaaaccccgcctctactaaatatgcaaaaaaattcgcctggcgtggtggcgggcacctgtaatcccagctactcaggaggctgaaggacgagaatagcttgaacctgggagatggaggttgcagtgagccaagatatcgccactgccctccagcctgggcaacagagtgagactttggctccaaaaaaaaaaaaaagaaaagaaagaaagaaagaaaacagatatccactgctctctcaaggatcttctcctccagaacattatatgttgttcctgagattcccaatttgtttaaacaggaattttgatggaaaattaccatttgaatacaaacacccaagttctgtttcaaatcaaacagcagaaaagaaggaaaatgaagcaggccattggctattgttgatgtcaatcaaaagaaacaaggaatcgttcctggggcagcataatcctgaacttcccacaagcacgagcaccccgggacatgggcgagactttgtgcatcttcctcccccagctgggcaggacagtgcccgtctgaggcaggacgtggttcagatctgtgtccccaccaaatctcatgttgaactataatccccagtgttgcaggcggggcctgctgggaggtgactggatcatgcgggcggtgttctcatgaatggtttaacacaggggttcccaacacccgggccgtgaaccgggaccagcccgtggcctgttaggaaccgggcacacagcacacagagcggtgggcaagcaggcattcccacctgagctcccctcctatcagatcagccgggcgtttgattctcataggaatgcaaaccgaccgtgaactctgcttgtgaggtatctaggtttcaagctcctcatgagagtctagtgcctgatgatctgagggggaacagtttcatcccgaatccatcccccaccccatccgtgcaaaaattgtcttccacgaaaccagtccctggtgccaaaatgtctggggaccgctggcttaacaccatccctcttggcactgtccccacgatcatgcgttctcgtggatctggtcgcttaaaagtgtgtggcaccccccacctctcttgatctgcccatgtaagacgtgcctggttccctccaccttctgccatgactgtagctcccggaggccttcccagaagctgagcagaggtcagcaccatgcttcctgttccccctgcagaaccgtgaggcaattaaacctctttttttaaaataaattacccagcctcaggtatttcttatagcaatgaacagactaacacacagggcaacacacgagtggctcgtgatcttgggaaatttgggctagaaaaacacaagtcaaattttagttccagcaactccagagtacttggcctgcccaactaacagcacttcctggctatgaatagcaccggatgtcctgactgagaatctcattgatgatgatgatgatgatgacgatgacgatggtgatttcaacttgagacaggaaaatgtgttatgtaacaggccaccaagaggcgatgaggtttgtgctggcccaggaggacacactgaattcccagcttcctgcacgcattcctggacccccgtgtatccaatctatgtgccaagcactatgcaagagaagcattcgtgcccagtttcccaggtagagggccaagcccaggcagaggactcttcctggaccaccagggtgacatctgcaagccacaaacaactgtcctgcttgtccaggttttagatgctcggttcccatcttttcctgctgtgtctcccccgacgccctctccagccagagaccttgactgggagtggctccgagtcccccacggaccccactcacaggcacagctggtcctgctggacggctgggcccatgctctcccccgctccaggaaagccattcctaaaggcagccccactgcccggccccaaacctgccctcactctgcagcctacacggccgcccctgctcgcaccccagacggcagcacacacttgaaagcacatggttatgatcctgtggggcagccagggaggccggcaatcccattaaccagtgctcgccaggagacaagtcatgaggtcactgctgatctacaaggtcactctgggtggtgcacggatgagcactttatttcagtgacatgtgcattctaaggcatattaggaagtgacatagtcaacactctgtgtccagaatctctggctataatggcttagagtgagggaaaagtaggcatggagatcgaaaagacgtttctccacatcgagtggaggaagtgcatggggcatgagtgtgcaggaggcacacaggtggggcgggagtgagaggagcagaggacgggtatcagggccatgcctgacagcgcagggctcacaacctgccccccaaggccaggtcccaccatatgtgcggcatgcagcccttgtgccagccctgggctcagacagtatccaaggccccgcctgataaggcaggaagctgagaccagagaccccagggactcggtcacagtcacacagctaatccacaaaggagcaggcacctgagcctgagggtccagctccagagtgctcgtgacgtacagcatatgaagtatcatccgcttttccaaactcccttcctcggcctttggcctcgccctctctcccatcccttaaaacccattctcaccctctctctctctctcccatcccttaaaacccattctccttgtgcttcctttctttcttccttctcagacccctcctcttgccctgagtgtcaggaagctaagcaggcttcttccccaccagctggaggccctttccctgcacagtctcggagaggggagacagcaggccctgccgcccagcccttcaggagggacctggctcctggaatgtgggtgtagccccgtggtgcacaggagggccacgccagcatctgaaaattatccctgccctgcccacaaatgaagactggtttctcagaacacaagagtatttctgtgaactataaaaagctactggatcgacaacctattatcattgtggaagaaattactgatctgcacgtcagctgggagggtgcctggctgggccgtccgccccgcaaatccatggagccccggatcaccagagactccctcggtggccacgccccacatgcacacacccatctcagcgcttcccgtaggctgtgggctcaaacccgggaaagatgggcaggcccctctgcacatctgggccgccccacagctgtagcagcgggggtgcaggaagacacccgaggatgggcggctgcttccagctctccacgacagacataggtgcactcctggccagctgcaggatgtgtgaaaggaaacgtgctccctggggagtgcgagactcacagatggtgcggggctgcccacccaccgtgccgtccgctgctggattcacagtgtcagaagcactgctggccccggctgaccctgcgccctcagccttccactcagcacactgtgtgcataagccccagtgctggggcagggccagagagagctctgtgaccgacaagcatctgctctccctgtttcagggttgaagggcctttgaccaccagcaagtccagctggtgagaggtcaagagcacatgtgaagcccccaacccccttcaggggagccgacactctgcctctgccacccccatctcacccctgtgacatgggatgtggagatgactggcagagccccatcctgggcttggaggagaaggggctgaaagtgggggccaggtccacagggcctggttctgcaagtatcagatgttcatctcagacccttacttgagggagaagcaggccatcagcagggctgtcattctttgggggtggctgttggtgatgatgtctttacgctgagccaagcctcctcccactgacccacgtcttccaagaaatgctgaggtggggaatttatggcttcacccaacccccagagccacgcacagtcgtgacgtccctggcactgacaatggctggctaactcttgtctggaacggtcacagccatggaggagagtcccagccccagcccggcagaggaagtgtccccacgtgagctcacagggcggtgcaactgtcctcacattgcacattatgtcactgcctctatggctcctctcaccaggctgctgacctgactctgtatctgcccctctcctcccgacagggggctccctggatggctgcggaaggggtgcaaaagggggcccggggctgcctgctcctggaatgctcccacccatctgcccttcagagctgtccccccattgtccaggctccaggtgcggaggacaccggagcagtctccaaaccacaatgtctcctcgccgtggatcacctgactcccctcctccaggccagcacacaaggacagagactggccacacccagggctggagatcttcacaggactcgcccctgccctcaatgggctccgtcctccctgccttagagacaaaccagggaagacactgaccaggaaaggaacactgattaggggggacactgaccagggaggccactgactaaagagggagcagtgaccagggagggagcactgaccagggaggagcattgacgagggaggacactgaccagggaggacactgactagagagggagcactcaccagggaggacactgaccagggagggagcgctgaccagggagggagcattgaccagggaggacactgaccagggagggagcactcaccagggaggacactggccagggagggagcattgaccagggagggagcactgaccagggaggacactgaccagggaggacactgaccagggagggagcactcaccagggaggacactgcccagggaggacactgaccagggaggacactgaccagggagggagcactgaccagggaggacactgcccagggagggggcactgaccagggagggagcactcaccagggaggacactgcccagggagggggcactgaccagggaggacactgaccagggagggagcactgaccagggaggacactgcccagggagggggcactgaccagggaggacactgaccagggagggagcactcaccagggaggacactggccagggagggggcactgatcagggagggagcattgaccagggagggggcactgaccagggaggacactgaccagggagggagcgctgaccagggaggacactgaccagggagagaggacactgaccagggagggagcgctgaccagggaggaccctgaccagggaggacactgaccagggaggagcactgaccagggaggacactgaccagggagggagcactgaccagggaggacactgaccagggagggagcactgaccagggagggagcattgaccagggagggagcactgaccaggaggacactgaccagggaggagcactgaccagggaggacactgaccagggagggagcactgaccagggagggagcattgaccaggaaggacactgaccagggaggacaccgagcagagagggagcactgaccagggaggacactgacctgggagggagcattgaccagggaggacgctgaccgggaaggacactgacctgggagaagtgctgaccagggaggacactgaccagggaggacactcaccagggaggacactgagcaaggagggagcactccccagggaggacactgaccagggagggagcaccaaccagggcgggagcaccaccaggaaggatatggacaaggcagggagcactgaccaggaaggatatggacaaggcagggagcactgaccaggacgggcgctatcaccttggtcacatctcagcctgtgcccgccctgaggaccgcagggcagctccctcgctggccgcctggtgccggcagctgtggtgctttgtcccccaaggagaaagcatgatcttcggaatgagactcaactctaatcccaactccgctgtggatttgggcagcatggtgacttccctgagcctcagtttccccaactgtaaatccccacatccctctcagctgttgtaagaaggaacccggtgggcatgggcgtgatccaggtacagccgtgtgctgagcgaggctggcctgtgggccggatgtgcccgggcagggaggcgggggtgggggggggtccctgtacagcactgccctgccgcagctcccgggcgtgcgctgacagaggctgccccgctcttctcctcctggagccccttgtgaacagagtttcaggatcctcctgtcgccctccctgcctggggctgatgcccagagaccaacatgatggcaccaggtttcgggagaagacgagatccctgcctcccgaacactgtcccgcctacggcgtccacatgaagcagtgctggacggagggctcagcccacatgacggccgcgacctggagacccacaggtcctgcgggctgccctggggactgggggacgagggccaggctcatccacgctctcccggatttcggcatgcccaatgcgcccgcgggtggtgtgggaggcgtgtgcctgcctggaggccccctggacagcagccattcgcattcggatccgctcctggcgctgcaacaccactgcgtggcacacgccgcagaaacccaccggcacgcgcaccacggcctgcggagaaggcgctcccgagcaccacgcacgaggaacaagagggcgaagcctgaacatcggtaacagagcggccccgcagggaccagccacacgaaccgcggcgcagccacgcggtggaatacggcgcgaggcgggcgtgctcttcgggtttcggtttcatttttgtcctttaatgaagtagctctgtgtgctggaaggaagtctcccagagcgccgctgcggctcagaaccacactggcagcgtgatgccgtcgtgtgtgtgtaaaaagaaactcgcacacccagagctttccaatgggtgcaaatctaaacacgaggggaaatctggaaggacagccgtgggagggagggcagcggggttctcaggggaggggaagataaaccaggcctgggaatcgtggtgaaaaggacactgccagcatttggaatgtttcaggttcttaatggagatgtaattatgtttacagaattacaaataaatattttcagagggccacttttaaaagaaaaagggtgcagagccagtcctctgagaccaggagctgcgagtctcttgtgaccccacccaggaccggtcccctcagccccctgtgcttctgcctctcctgtcaaggggggaactcgtgggtggacgggttcctgggagccggacagcaacacgcgcggacccagctctgcagacacagcgtggcctcctcggccccgatgcttttgtgcacacaggacacaagggcacccatgtgaggacggccgcttcatccttctaacaagactcagcgatcattaaatggtcctaacaccacttcccacatagctaggacttcacagctgccagtgagaaagcgatgctttatcagaacctgttctaagtccccacagaggtgtgtagagattcagttcactctatggaaacccaattagaacctctatttcttgttgatggagttcctacacggtgtgaggcctgaagttaacacccagtcttccctgctgtcttgacgcctggtagaaccagggaacctctagtggcccggccaaatgcttccctcccaactctgctcctcagaataaggtccccaaaagacccccctcctcatggggaacaggtgcacttcccactcatcccagggtggtgggtttcagtcccacccacctgcagaattatccaagaagccactcacatcctcccgagggaaccagggcgccccgccctccagtcactatgccctccggtcactacgagcctgctccccagccgcacgagcccgttccccagccctgcgggtgcactctgccccacgtgcatccccgtgtggccctgtgtgcgtgcgcagggccctccatcccgggacccgagctttggcgtcttcctctgtccagtgctgggcaccccatggccctcaggcagcactgcctccctcaccaaagggtgtagagaaggagagccagcctcctgcccacacgcagcctgcaggggagaggcctgcatggtgtctgcaaggacaaagccgtgcgttccacacgcccacagccaagtcatgttttgccagggcagtgagcgtggctgctggaggagcccagagctggtatgcacccaaagggatggttttcacccctgtcagtccaggggcccaaagatgcggttcctactcccgtttccagtgcttagtggcaggtctggactcacaggacctccacaagtctcagtttcctcatctgcagaaaggtagtaaggcctctccccagctcttcaccagagctgtgggaggaagcaatgaacccggacaggaggccatctgagaaaatgcacggcatgctcagccccgggccgggctgctccagggtgcacaggaccctggcctgtctcgctcccaaccccaccctgcactttgctctttgctcagctttgggttgatgtacttgaggcctgcaggctcccagctgaaagcaggggcaacaactcacctgcccacaggggccaggctgggccctgcccaggagggcacaggttggcagggccgcagggcggggagggccgcagcctcgcatgggcagacactcagctgcggacaatccgacagttaccactggggaatgcgcccagctgtgcccgcaggccctagtgcagatttcatgtgaaatcaaccaattcgtaactgttgccagctaaatcaaattattctgctggcctaaagccatcaatttcaaactctggctcgaatgctgctcccacacgctcaggaggaacagcctttgtgttgcagacgccatgccggggttggaggtcggcgtccccctcctggctcacctgggctgcgacagacagagccgcagcgcctgtgaccccaccgggaccgaacacggagctgggagaagccagcagcaaggctgctacctggtgggagtttcctttagaaaccaaacatctgagctgggagagtgacgagtcctcaaggttttcaagtggaggacgtatagacatgaagtcaggagcggtgtctgctggattttctttaactcacatgtaatttcttatgtctacttcattcattcattcaacaaatatttactgtgtaccatgaggctgtttctggaacattcctcttggctcatcagtgtcggggcagcaagaacgcggctcagggggctgggggtagcgctgggcaggctccggaacctgaggctcactggggagtgggaggcttgtcgggatgatgccaaccaagggctctgggaggtccaggatgtggccccatggaagggctgggtttggcctgttcagcacttaagctgttttgaatcacttgctaacattttaaaaattgggacagttcataactttaccaaaaaaatctggatcatcagttctgtaaaaaaatatccctgtgggcaagtggcagctggggcgcagtggccccctttcctcacctgctgggcaactgccccgtgcaggggcctggggcgcagccgataataaaatgtccaaggacacatggtgccttctcctcggggactcggataacaaacccgactgcgaaggaaccctaggtcatcggcgccttctcctcgcagggggactcggataacaaacccgactgcaaaggaaccctaggtcatgtcaatgtcagcagtggcatctagaaaaataacccaggaaaggaggaccgtggggagggaatgtgacgtgggcaaagaccccagaagagggagaatgtgcttcccaggcgggtgcaggcagaggcgccaggcagggggaggctgcggcaacagcgtgcagtgtgttccccgggaactgctccctgattcatgcatgacatgtccactctggcacctggtgtccctgagtggatggccaagcccctgggtctctgcagagcctcattaagctgcacaccttcctctccagctataactggatgtttgctttcctgtttctttgattctgaatacatgctgtcctggccaccacagtctccgtctccctgcggaggtcacaaagtggtctcggtctcggtctccctgccaaggtcactagttataccctcaagggtggggtgggaggcaaaagccgcttcaggtggctgggtcagctccccatcgaggctttccactggacagggaaagggcggacctctgccctgtccacacctgctcttcttctccccagacaacttcctccttccagggctggtatcctctgcagctcctttgcacccacatcccccacccacaccctccggctccacaagatcatccaagaaccaggccctggaggatccttctgggtgcctccccacattctctgcgccagtggccagcaccaagacccccgattttctgtgctcagtgaagtccctgctaccctttcctggtaagagcatcgaaacattcaccccaggacaagtgagggcatcagagaaatggtggcatcatcaccacaggtcacaactcagatgtccccagggaccatccaggtggggatgatggcaaactccgggggggccaccattcagccccactgtcctgccacacagcaggtcagacctgcaccgcgagaagttcaggtttcaggaagaagctagcaattctgatgctaaggtaagaatcgtctgatgtaaatattggccactgtcttgaaactgaaacagtgtttgggtcacctgcaggctgagtggtgcaaagaccactgcccggcaggctccggtccaagagcgagcaagcctgccgtttcccaaatgactgtcgcatgcgatctggcagccagcagcccctgaggctggcacacacaaggttgttctatccctgtcttacagataacaaggcagctctggagggcgggtggtttaccccaaaatcacagttcacctaggtgtgcacctggggctgtttctgagctgcccggcccaggcctctattagttccctgccctggctcaaggggcaggctgcccacggtggtgctcacaggacgatcctaggtccctgcaagtatgagaagcgtgtgagtattttgtttaatagttaagtatataatgcatttttaaaagggtgtaccaaacacatgattttatggagattactgcttaagactttgcccttaagaaataatatacatttactttaatgtataaacatatgtaaccacacatcaaaaccatgattcaccctgtgttctttttaataagagaatgtcagctccttctgaataaggagaagaaggggaggatgaagagcaggagggagaggaggaagccactgacttctccgcaccagttgcacgtctggttgacaaaacacctcaaatccctgtcctgttaatgacaaaccccattcatctcctccagactcctgggaaaaagcatcagagatacaataaagcggcccctgggagcaggagccagttcatgggtctcaaactcaggctcctacaggggccgggaaggtcatgcctgagggtgccgctggtggggtggggctctggaaacagagcagccaggtccctctgtggcccttggtgtctgttttgttcataaaacagggacagaatgatcctatctgcgccggcctcagggaccgccggcagggccaccagcacagctggccggcagcaccttctcagatcctctatttgccaagggaacatagaactccaggtttttatgtggcatctcccagctttgaaatgtctgcaagtaattcattattttaaagcagaaagccctgtttgggcccagctgagtctgggccctttcccagcgtgagcctgggcttagcggcaggggcgtggaccagccaccctcctccagggagtgccaccccagccaaggcgccccagggttgggttcgggtgggtgcgccccatgtttgaaacggcaaagcactcagagaggaaagccttcaacaaacaagtgaccccctcagagtccacacagccagcctccaggaccagatgttcagagctgtcccttgtcagagctccctgcagggaacaggactcatttgtctttgaacaatctttccatctcaggcacggccatcgtgaactctgtgtgactttttcacaactttctgaataatgaccgaagatggtctagaccgggaaatctatttttatggaaaccctcctctcaggctgagctggcttttcccccatttccccggcgttgaaagggtcaccccgtgagggtcctggtgggactgggggctgagctggagcctgcaggggccaggagcacagggctctccgcaccgtcccggctcagcgggcagtggctggaggagcacagggctctccgcaccgtcccggctcagtgggcagtggctggaggagcacaggactctccgcaccgtcccggctcagcgggcagtggcctggaggagcacaggctccatgcgttcctgctccgcacacagctcggggccttcgacagaggactagactcagcagtttcctggcctctcccgcaggcagttccctctgagcttggcctggagaggctctggggagatgaccataggcttcctcctccctagggggacagccttgctccctcctccactcgaggccgtaaccaccctgctccatctgccccaggtgtcggcctgcgacctagtcttttcccttttatgttttgcaattatttaaaaatcagaagtttcaggcaaacagttcttctgggaaaatcagcaggttgggggacaggacgggtctaggggacccatcacatcaggtttgcttctgaccctgatgtcaaaggtcagcctacctgtcactgccgtccccctcacctgcaccccggctgtgctctcgtggcagagtcagaggcaggttgcccctccatcacctctgcctccagccatgaggaaacagcccgtgctgatgagtgtccacctaccccacactgtgggccactccagtggctgagccccaggggcatttccacttgccatgtctgccccccgactgtagtatcggcccctctgttgtctggccccagtcacagagaagaaagatgctctcagctggatgggcctgggtgggaataagcagggctcgttcccttgtgggaggagtgtcggctctgcgataccaaaccagagtggatgcctaacaacccggaggtggcaggcaggcgagatgcaggtttgaaggttgagaggaattctaacacatggctgccctgcgccatctgccacctgccctggctcagcgcacaggccctcccggcactgtggagacactgggctatgtggatgggggaagtccagggcttccagactgctgggtcatctgaacccctccacaggggcctggtgatggtccccacacgtctcaacagttagagcaaaaatcagcagaaaggggccaaacccccaaatgatgcagtgagtgagacccagtgtagtgagtaagacccagtgcagtgagaactggtgtagtgagtgagacccggtgcagtgagtgaggcctggtgtagtgagtgaggctccatgcagtgagtgagaccccagtgcagtgagtaagacccagtgcagtgagtggggcccggtgcagtgagtgaggccccatgcagtgagtaagatcctggtgcagtgagacccggtgtggtgagtgaggctcagtgcggtgagtaagatcctggtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgaggcccggtgcagtgagtgaggccccatgcagtgagtaagatcctggtgcagtgagacccagtgcagtgactgagacctggtgtagtgagtgagaccccagtgcagtgagtaagacccagtgcagtgagtgaggcccggtgcagtgagtgaggccccatgcagtgagtaagatcctggtgcagtgagtgagacccagtgcagtgactgagacctggtgtagtgagtgaggctcagtgcagtgagtgagacccagtgcagtgagtgagacctggtgtagtgagtgaggccccatgcagtaaggcctgggacagtgagtgaggcccggtgccgtgagtgaggcccggtgcagtgagtgaggcccggtgccgtgagtgaggcccagtgcagtgagtgagacccggtgcagtgagtgagacccggtgcagtgagtgaggccccatgcagtgagtaagatcctggtgcagtgagtgagacccggtgcagtgagtgaggctccatgcagtgagtaagattctgttgctgtgagtgagacccagtgcagtgactgagacctggtgtagtgagtgaggctcagtgcagtgagtaagacccagtgcagtgagtgaaacctggtgtagtgagtgaggccccatgcagtaaggcctggggcagtgagtgagacccggggcagtgagtgagacccagtgccgtgagtgaggcccggtgcagtgagtgaggcccggtgcagtgagtgaggccccatgcagtgagtgaggcccggtgcggtgagtgaggcccggtgcagtgagtgaggcccggtgtactgagtgaggccccgtgcagtgagtgaggccccgtgcagtgagtgaggcctggtgcggtgagtgaggcccggtgcagtgagtgagacctggtgtagtgagtgaggccccatgcagtgagtgaggcccagtgtagcaagtgaggcctggtgcagtgagtgaggcccggtgcagtgagtgagacctggtgtagtgagtgaggccccatgcagtgagtaaggcctggggcagtgagtgagacctggagcagtaagacctgatgcaataagaccctggtgcagtgagtaagacccagtgcagtgagtgaggccccatgcagtgagtaaggcctggggcagtgagtgagacctagtgcagtaagacccggtgcagtgagtgaggcccagtgcagtgagtgagacccagtgcagtgagtgagactcactgcagtgagtaaggcctgatgcagtaagacccggtgcagtggttaagaccccgcctcccgtgaatgagaccccctccagtgagtacaaccccctccagtgagtaagactcgctgcaaggctgaaccctgctgtccccatgcctctccaggggcctgatataaaggggccaggaacaggagcagcctcaccaaagttaatttctttttatttttaaacccaaataagctttgttgtttttaaagcaggtaaacaaaaaggagaccaggagaaccttagtagtggtataatgtgactcggttttggcttgggtgtgaatcaatctccaagcaatcatcttgccttttatagatatagtgaaaataattaactaggagaataacatttttatctacattataatttccacttataaaacgttcatgtctgtgtgcataaggcataacaggtctatatctaggaaaatggatccatttttctccttttgatttggctcctattaacattgttataatacagtttcttcgataaataataacaacatcatactatgtcagtgattgactgctgccctgtttctattttcaaacagacaaccagacatcatgtgtgggggcagctgctaacaccccatcatcagttaagcacagagaagctgtgtctcggctcagtggatttccttcttgaggcataaaatgcagaggcggtctgaaggtgcagactgcagtctcaatttattctacgtagaaaacagacgctactgaagtcgcacttgcagtcagaactccgggcccctcggggcgtgactgcccagctgtgtcacccggagcagctcatgctgcttctaagctcagcttccttgttggcaaagggccctactgtgtggcacacgccgtgcacgtcaggacaagcacaacgcatggcgcacaccacctgctgggagaggcaattgtgcactctacagccacagggacaggacacagcgcggtgagcccacccggtccaggagcgctgggaaagggccccaggagaggcagcagagctgagacaggacgacgaccaggagcgaccaggaaggggaggaggagagtgctctgggcagaggggacagcgtgtacaaaggcccggaggtgagggcacggacagaggaggagagaggttcaagatgaggctgggctgaccacacagggctgtgagtcacaggtcagggtctgtcttcactctgagtgacaggggcccagaagactccacagcagaggagggagtgaccagatttgcttctttaaaaggcactcgtcctgctgtggaggggagggctgaagggggcggaggagcagctgtaggcgtggggcaccagtgaggaggtcctgcaggccccaggcaagagcggccctgtgttcaggtggaggctaaggagcgggagccggtgcagtgacatttccaaggtgacgtgaccaggttggtgaaggagagagcctcaggtagagccaccttctccagagctgggggacacatggcaagcccaccctgcccagcgaggggccaccaccgtgtcctagcctcagtcattcaacaaacatgtttatggagaccctgtcatatgccaggttctgttctagactcaggaaatagcaataaacatgacagcctctctcttccccaactccctctctctcctgctcttctctctctctgtccctctctctgcctccctcccttccttcctccaccccatggagtttactttctagtgaaggagacaaagaagaaagaataagcaaacacacaagtaagacagtgccgccttccaggaaagaaaaggagccagctgatgtggcgagtggctggcgaggctgggctgggcagtggaggacagtcaggtcggcagtggcgactctgggaaggtgtcaaccatgcggggacccgggggaagagcattccattcaaaaggacaggcgtgcaaaggccctggggtgggaatgcacttgatgtggcgcagagcaaggcagacgcatggcgggagcggagtggaatgggcggggagtggcccagagtgcggcagggtgggcaggggaagaagggcgtgtagatcttacttgaaatgcagaggaagccccgagagggttcgagcacagggtgacaccacctgacggccacgtcgaatattactctggctgctgtgtgcagctgggggcggctgggaggctggcgctggcctccggggtagacagtgaaaccaggggcaaggctggtgatggtgacgatgggtaccggtggaaatcggacgtgagctgcaggtggagccggcatcccccggggaggactggcagagggtggagctctgtcctgccaggagtgccgtgaaaatgcacagacgctcacacctagatcctgcagataccacgtgtccccagccttcacccacgcggctcagggaagctgcttccccctagcagacgcagcagccgtggaaatgaccacagaggacacacggctgtgcagccctggttgggcacctgctccagggacctggcaaccaccacatcccgtgcccctgcaagcccctgtggccacccaggcccacggcctgcccctccagggccggctccagtccactccaccgggacccaggcctgtcagccaaggcaagagggacacacactcccgtcttcactgagaacctgcctggctgcctccgtcactgcacacctgcgcaacccagcccagcagaggacaagaattccctgcgttcagggggctccgaaaagacataaggaacccaaccctgcatgccacgctctgagcgggaaggaaggccgcatgtggacgcctgtcctgctcactgtgcctccagggctctgacggtgctgagcacagatgtggtgcttgggcagtgcttgtggggtgcatgatggaagggcaccctggccccagcaatgaccagctctagaaacccctccggcctggaagtccttccttcccaccccaccccagcccctgccacacaaaaacaagacaatcccatctggacacagctacaggggacccacccaacggccctgcccgcacaaaaaaagagctcgggcagggccagcctggtctgcacacggagggtgggcatgcaggagacccagggcactgcctggcacgagccatgaatgtcctggagggcagggcggggctcgtcgcgcgccatttagctcgggaggagaggaagctgcaaatgaagtggtctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataaacgtcatctctgtgatggggtggcgatttctctaataaatgtcatctctgtgacggggtggtgatttctctaataagcataatcgtcactgccccaccatagggagaggaagcagaggggccctggaggaagcacagtgagcaaccacgtggagctgcagagccctctccgctcactgctgtcctaagagggcagccgagagttcgtgtgcaggtgctggcacccgggcctgcagcaagaacactcggggaaaaggccacacagcggtgggggacgtgtcagcggaggcatcgcatgtacttccagggtaccaaagtgagttgtgaaacctcctactacgctgaattttcaaagcaggcgtcagaacccgtgagatgattcgtgctcgtggaggatctaggcggggtcgcgagtggcacaataagctgtggacctgtgagactgtctttgaatagagctgttttgtgagctctgcctccaccgccagggtggagagggaacgtctgccgcctactgaatgcctgtgtagcctaggagagggcttcagtagagcctgggggagccctgtgtgccccttgcgggggacagggttggagctggtgcctgacacttggagaaggacatttgggctgtgtctcagggctaagggctgcattttggaaagcaatgtcaccccctctatctgtggggcacagcggcaggaaccccagagccaagggtggaggctgcgataggagagaagtcaggctggttcatctgaaggcctcccttccggggcagcagttcaccaaacagacacaaatggctccccagcttcccacagggaaggcaggtaggcacctggcatgtgcggggacgaggcaatgacacctctcagggtttccgagtgttggcagaagtgacccggatgtttggtatgcagagctggcccctggggagaagccaagtcacttcctgaggttttggggagacaaggtgttgacacccaggcccaaccctgggggcacaagaatcaaagacacagagatccatggaggtggccctgggggtccagtacaatgggatggtggagaggggccccagaactcctgcagcctcaaggggaggggcaggtgggtgacctggtttaagaccaggcctgaaggaagggtgggggggccgtgtttgctaatcctggaaccttgggaaaaccaccgacaaacgcaaatctgagaagctgtgagcaatgggtgactcgtcgacagaaccgcatgggtgagggactgcatttatgtctcaagctgtgtaaatggtcatcccagcaacaggtcagaactcaccccattccagtcatgccccacagtctccccgaattctcctgcacctgggctcagacctgcaagaggctaagccaggcctaaagggatgaaggccaccgtccagtgtttgagccgcaccagggcagcacgcagtacccaaggctgccccagacgtgagtgggctccgctgtcagagcccccaacaaatgacatggcgcaggaagggagggtgggaggcagggagcagcttcgacaggaccccccaaggcagcagagcttccggcagtggagctcagagttgagaccgcccagcccctggctccccggggcccagtgtggtgagttgggatgaggtgttgcccttcctgcgttccgggctcccatgtggcctgttcagaaaccctggtgaaaagagcggccctcggtgggggccctggctgtgggcgagtgctcctctggaaggagactccgacacactgcacattgtgacagaggtggctgtaaccaaggcgaccccagaacaacaggctgcagatgcggctcagtgtctctcctacacaatagctgacctgtgctctgcacaccccggcgtattcaaagcgatgagccctcagccgcgggttaaagtactggtgtcttctgttctttacagtctcagtgtgccacattgaggtgtcacgcgccacactccatggcatccacgctacagatgccaaaggccacgggaaagcgagttcgccattctgctgaggtgggcaggctactattccccgggacgtggctgacacccctcacctgccccgatgtgcagctgaagagacccctcgtccggccttggcctcaggggagggacgatgtccagcaagcttctgtctgaccctgtgtctgccacatcaactggagcagagacaactggatacagaaaatcccattcaccaaggtgggtgccctcaggaggaagggcctgcgcacgctgcaacgttggggatgcattctgagatctagctgcattctcggagatagagccactgccccaacaatttcagcggcacagtctggaagggctccccacagattcttaatttaccctctgcagctgacaaaacacaatccccaccctccaccagaggggtccacaacctaaccccagagcctgggaatgtcacctacgacgggtccacaacctaaccccagagcctgggaatgtcacctacgacgggtccacaacctaaccccagagcctgggaatgtcaccatacgacgggtccacaacctaaccccagagcctgggaatgtcaccgtatgaagggtccacaacctaaccccagagcctgggaatgtcacctacgacgggtccacaacctaaccccagagcctggaaatgtcaccataagaggggtccacatcctaaccccagagcctgggaatgttaccataagaggggtccacaacctaaccccagagcctgggaatgtcactgaacgaggggtccacaacctaaccccagagcctgggaatgtcaccgaacgaggggtccacaacctaatcccagagcctgggaatgtcaccgaacgaggggtccgcaacctaatcccagagcctgggaatgtcaccgttaagaggggtccacaacctaaccccagagcctgggaatgtcaccgaacaaggggtccacaacctaaccccagagcctgggaatgtcaccgaacgaggggtccacaacctaatcccagagcctgggaatgtcaccatacgaggggtccataacctaaccccagagcctgggaatgtcacctacgacgggtccacaacctaaccccagagcctgggaatgtcaccacatgaggggtccacaacctaaccccagagcctgggaatgtcaccgaacgaggggtccacaacctaatcccagagcctgggaatgtcaccgtacgagagtcccacaacctaaccccagagcctgggaatgtcactttacatggcaaaagggacctttctgatgtgggtaaattaaacgtctggaggtgggaggtgatcctggattagccacatgtatccagtgtgatcccaaggatcttgacagagggaggcaggagcagaggagggggaggcacagaggctggggtcaggggaacggattcgcactgcaggttcaagtgttcatccgcactgactataatagtcaatataaaaataagcctggtagattacagcagcaggcaatgagttaacgttggaactacatcgagagctctcagaagtcactaacaaaacaaacactccactggagaaatcaggaaagaaggtggttacaacataaagaaaaatgcagatggccagttcacttaggaagcctcaccaataaccaaagctacgcagctatgaatgacaaccaggtgtgacttcctgtgcatcagagtctgcaatggcgtgggagaggcggcactgccgagccccacccatggctggataaatggttacgacctttctgaagggcagtttcacgacgcgcatcaaatttttaaatgcgtctcaccaaaaatagccgaggccgcctggaataacaagctggagggtttacacgagccggtctcaggccttggcataggacgtggcagttgcaatcgtaccggcatgcaaatgggatgacggacagagcagagtccagaaacagccacgtcgcccctcccgtgactgacggcaaaggcggcaccacagcactaggggagaggttggtcttcccacacgtggagctgggtaaattacatatccgtctggggacagtggtcagtctcaacccctactgcactgcagacacagaaacaagcagagaaggaccacaggcccaaacacgaaagtgaaaacaacaaatgttccaggtaacacaggaaactactttcatggcctcgggttaggcaggattcctccaccaagacataaaagcactgaatacagaagagcttgataaaccggactgcactgacgttgaaaactgctgtccaccagcagacaccatcgaagtcaaaagggaagaccccgtgtaagagatatttgcaatacgtatatcaaacaaatgactcatactcaaaatacacaaaaactccttaaaaaatcagtaagaaagaaaagcaaacagcacaacagaaaaatgagcagaagtcttgagtagatttttttaaaaggatattgatatccaataaacataaaaaggtcaccaacatcattcaagaaaagcaaataaaaaacagaatgagacaacattagccaccagaatggcggacctggaaaagacgggccacacccaatgctggacactgggcttctcacgctctgccaaggggagagtgaaccagtgcccgctctggagaaggcaccgggcaccagctgttcatgctgaacatgcccctcgacccagcgacgccatcctgggcagatcccacaaagaagggcacagtcaggttcaccagcagaaacgcgctcactagaacatccggcagctctgttctgctggcgtctggaaaaggcattccatggtgctggccgtgtgctgcttcttgacctgaggggtgatttcttgggtatgttcgctttgtaaaaactgtcataccatacacacatatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaaaaaatgtgtagacatttaacagagcaattctacctctgagaattcatcctacagagataacccagcaagaacacagaagattcattacagcattgtgagaatgcaaacccgaagccagacgcacaccagcaggatgacaaacgtagactattaagcagccgtgagaatgatgatacagtctgagctactggcacggaaatatagacatggtaaatttaaaaactgaagctgcgaaacggcacggatagcagaaccccatttatataaaattgtgtgcacacacacacacacctagagaagccccgaaagaagtcaccacaatgttgacactggtcatctctgagggatgggatttcaaacgatgtttggctatgtgtgtgtgcatgtgtgtgcgtgtgtgtgtgttatttaaacagcctgcagagtaggaatatcctggatctacagtgcaccaaggaatgaccatgggaagaaaatgaaccttgcttcattcacaatcaaccgtttttccctcattcacagcaaatcctagagaaataacagctgtgtgccacaatccctacgagaaagtacctgcctccaagagaagccacccgcctgctttcatctccctcaaatatggttctgaatctgagaagcacaggaaagtgactgtgtgtaatagtccgcaactggaaacagccaaattatggttacaaggacgagtcagcggtggcctattcatataatggaatatggaatagtgacgagtagcatccagccgtgaacactgcaatatcccctgggagactctcacctgggagtctcccgggtatattggcgatgcctagagacgtatctagttgtcaaacctggggaggggctgctggcatcaagtgggtagaggccagggatgctgctccacaccctccctgcaatgcccaggccagccccacagccacagtgccccaacaccaatgcatctcaacacagcagaaccagttcccttggaagattaagccccagaaacacaagccaacttcaaaaggccaaagtctggattccactctatgcctgggaacctcctctgttccggggtgacatggacgctggagctccacacggtcagaaagcgctccggagctcggctccacgcggtcaggaagtgctctggagctcactcccttccaatgccctgagagatcggacagacgattgctgacgtcagtggcaaagggctgacgtcagtggcaaaggactcccgcccccccgcagacattaaaatgagccctttgggagaataagggattccatccagctcagaagggcaggagtaatgaggccacccagccctctggagggcaccgggaaaggctggaagcagggtctgtgccctgagacacagtccactgagacacagtccatggcccagccacacccgcggctgccccgtttgtctgtagagtgcaggctccccagcaggggagaagcacagatgacacctcactgaccattcccacttgccctctgcagcctgagggcccagacacactgatggcactggcgcaattgacatgaaccgggcacagtgacacagtcacgtgtcccaggacctccgtgggcttccgtggtgcagccctggggcatgtggagtgcccagcctcacccccaggctttaccaggtgccccctcagagcctccaggatgggcctgcaactctgtccctcacaccctggggagcttgcaccccattctgtgccagcaaaagaaggtatctcaggccaggcacagtggcccacgcctgtaatcccagcactttgggagacggaggtggatggatcacttgaggccaggagttcgagaccagcctgaacaacacggtgaaaccctgtcactactaaaattacaaaaattagcagggagcatgcccgtaatcccagctactcaggaggctgaggcaggagaattgcttgaacccaggaggtagaagttgcagtgagccgagatcgtgccattgcactccagcccggatgacagagcaagactctgtatcaaaaaaaaaaaaaaagaaaagaaggcatctcagcctcgggcctcaagacctcagcccatgttgggagaaaattcctgcagcctccatgtcacggttccctgacaacgatgtgggggacaaatgtgtgactctcttctgagttcacctcctcctcacggcccgtgacagagtgccgccaggggaaatcttcccatcagacaaatcactttaacttagaagagcaggcccccgcaacatcctcagaaatataaaagcaaccttcaaaagaaaaaccccaaaaccctagagaacgcttggctaagacaagccttaattaccatcctctttcggtatgataaaaattcctctccacctctcttcaagacaggattccttattcaaacactttctttttttaaaaataactgcagtaaccaaccattaaaacggggactgcattttaatccacgctttctttttctctggttttcaaactggcacctttcatacttcacagaagacacaaacatggccttctacaaaacttccatccacggcatcaagccccacagggcctgtaattcactggagccgggaggtgagaagtgcctgcagagacggttcccccaggccaccatgccgtccctgccctcgggccacagccagcaggcctcaggaccagtgagaaaatggcccggagagccctgcccgagcttctcacacagacacgcctgctgcattgctcccttcccattgctcccttctcgtgtctgggaggcctgaatggtgcctcaaggaaaaggagtacagtcttgcatcacttaatgacaaggacacattgtgaaaatgcatcattaggcgatttcatcgtgctgtgaacatcacagaggggacttacacaaagctagacgacgcagtccaccacacacctggctgtatggagtagcctattgctcctaggctacaaactgtgcccactactgtactgaatgctgccagcggctgtaacacaatgggaaggatctgtgcattgaaatacatcaaaacatagatgaggtacagggaaaatctggtcttacagtctgatgggaccactgtggtatacgcaatctatcactgaccggaacatgactgaaatgtttccaaaacacacaggatgctcggttgggtctgctgcagcaccagccacactggaaaccctggtggctttagggaccactagaagccacgctcgacctcccctctgccaggaaagccagcacactgaggagctagccatcaggcaccagcaccaggctccagccctccatgtgggcctctctgaccctgacgtcacagagaaccccagtgacccggccagcggggctgcctgcacctgcttcctgcacaactccccccaggccgctctgccgggggcaggaaagcactgtccctcaggggtggctaattctaggctttgcctctcccaaaaccattactcggatcatccagatgctaaccccagatacatcattcatctctcagatccgttctgtcttcatctgtggtcgacagctcatcaggttgaatcttcagaaatgacttaaatccacacaccagggtcaggagcagaaggcggctagctggggaccattctgagttgtctatttgcagagactggtcattttctccctgctgtttgtcacttcattgcccctcaacactgcccgagggtcaacataaggggaagaagaaggtccatctgcaggtaaatagaaactttctgggtttccagaacagaggctggaccgcccactgcaggaatatgcaggttcacagggtcatttgctgcaacaagttatttatacaaaatatgggtaacaacttaaatgcccatgagtaggagatgagctgaataagccggcgatggttcagtaaacccacacagtggggctctgcgcagctgagaagctggaaggcctctgcggatgggtttggagtgacttccaggataaactgagtaccaaagagtttctatggtataccacccttcacaggagacagaaggggctatttaaaaagtacatgtatctgttcatttggcacaaaagagatacaaaacacacacacacacgaatgggaccggcttacctggggaagtgggtgggaacagggtgcagggaatggaggatggagacagagcgggggtgcgccgtggctcggaggaagccttcagaaccacacgatggttcacatacccctcaaatacatcaacactgaaaatcaaccaacctgtgggggacccagaagagagtaccagtgacagcagatgaacttgactgtgttctaagtgacactacaggaagggaggcagaagaaaggagccagctatggaacgcagagaaatggtatcttaactacatggtgtaaggctaaaagcagagagggtgggaacaaacactgtcccctcatcaggacatacgtttcccacaagggtgtgggttagcaattctgaacctgtgtgtgcagcacatttatacaaataaaattattgagaataatgagagacaggtttcctactttgggagaaagaagaacatacaaggaaaggctaaatgaatcccacagtcttagaccagaaacaggtatcagaatgcaatcctagtttgcaacacagacacacatacagacacacagaaaaatgcaggaagatgcaggtgcatgcgtgtgcttctgagagcacacacacacagatttcccggctctgtccaccgagagaggactgagaacagtgacgctccagcagaaatgagcacgcctgtccctaatcctgctttctaaacgccattctccaaccaaaggcaccagggctccttagggaaagagccgattccatgagcccagcatatctttaatgcctgaatgtaaggagggactcagaaaatgagggaggcatcaaaggaggcagaaaccaactggacagagctcccgacggtcacggccgcgacaacgggagcaacagaatccgtaatgatagagccggacagcgccctgtgggatgaaatagtacccctgagtcatagcaacaccagcaactgaataaataaatcacggtttgtacttatcacagaattccaattaataaatgcagaaggaatggtggaaatagaaagtcatcattaggcaaacattacagtcaaaatttttgcaggcaagagcaatcaaaatgtagaaattcatgaaggaagatgagctgaaggaaggttgtgtagtttcacggtatctccccaccaccaagatatttattctaggcaaaggggaaaaccatccctttacagtgggttcatctggcagacaccacctcactcatgccatccacgtgagcgttaccggcaacaatgagcattcacatcccatatttgctatgctggagccgaattgctccccactaaagtcacctgttgaagccctaacccccaagacctcagaatgtgacagtgtttggagtcagggtctttgaaggggtgattaagataaaatgaggtcattagagtaggccctaatccaacgtgaccagtatccttataagaagagatcagggccgagcgcggtggctcatacctgtaatcccagcactttgggaggctgaggcagaatcgcctgagcccaggagttcaagaccagcctaagcaacatagtgagatctcatctctacaaataactgaaaaatgagcagggcattgtgatgcatgtctgaggtcccagattctcaggaggctgacgcaggaggatggtttgagcccggcgatcagggctgcagtgagccgtgactgcacctctgcactccagcctgggcaagagagagagactctgtctcaaaaaaagaaaaaatggaagatcaggacacagacacgcacgagggacgaccatgtgaggacatagggagaagacactgtctgcaagccgaggagagaggccttgggagaaaccaaacctaccgacaccttgatcttggatttccaacccctagaacaacaagaaaataaatgtctctcgcttggtagcccacaggccgactcacacagcctgatgctgcgataagaaaggaccatttcacttccctggcgttcttgtcaaagacgcacagcatcggcctaatcaggaggaagcatcggacagtgaccagggatgctccacaaagcaccggccggccgccgcgaagtgtcaaagtcatgggagacaacgggaagctaagaacccgtacagactgcagttgcctaggagacgtgacaactaagcgctctgtgccagccgagatgagaccccgggactgaaaaaaagctgcaagtgaggaaactgacaccattcaaaaaacgtctgtcgttaatatcagtgtcaatttactggtttcaatcattgtacttaaaaataccaccatcagggaagacggatgaatgatctgtatgtctgtagacatacaggggcattctgtactattcttgacattttttttctgtaactttaaaatcatttcagaataaaaagcttaaaacattgaggttgtaaactgttgacctcctggctgaatgcaacccacacatagggtttctttgacaacactggaaacaaatttgaattagctgccaacaagacacatccagggatataatttaaagcccaaattctgggctgctcttcgaaagtcacaagctgtggtgacggtgacaccccaaggaggccaaaacccagcccgaaggcaccctgtgtccagggctgctcctcacactggccatcccgggcctggcccctgagagccacacctagaggagggcctagtttgaggaggtgcccagtcctgaggacacaggtcccccgcactgcacaaggacagagcctgagggcttcttcacggtccaggggcctcggataaatgtccagggttcagccttacccagggcttcatgtgagggcatccacagctcgggcaactgcctcgttcagacctggcccatgtccaggtgggcatggccaacatttcagagcactcagcttacagacctccttttgccaacagtgcctccgtttccctcctcagatcaccagtgccccactgcgtgtgagcctggggaaccaaacctcttccctgacctcagccctggggtgctattaggcatgcatgaggggcagagccctgccctggccggagcttggggtcctggcctggaacatctccctgaagcaccctctgccctggccggagctcagggtcttgcccctggaacatctccctcgagcaccccctgccctggatggagcttggggtcctgcccctggaatatctccctcaagcaccccctgccctggatggagctcggggtcctgcccctggaatatctccctcgagcaccccctgccctggatggagctcgcggtcctgcccctggaatatctccctcgagcaccccctgccctggacggagctcagggtcctgcccctggaatatctctctcgagcaccccctgccctggacggagctcggggtccttccctggaacatctccctcgagcaccccctgccctggatggagctcagggtcctgcccctggaatatctctctcgagcaccccctgccctggacggagctcggggtccttccctggaacatctccctcgagcaccccctgcccttgatggagctcagggtcctgcccctggaatatctctctcgagcaccccctgccctggacggagctcggggtcctgcccctggaatatctccctggagcaccccctgccctggatggagctcggggtccttccctggagcatctccctggaacaccctcattacactcagtcccttccagaatttgtggtagcctgagcgatggcctggctttgggactgactgacattcaggtggagctgaggccgtctgatgagaaaatgtttgacaacagccatcaaactggcagcactgggctctttgcaatacgtatttttggtgcttattctaattctgaaatttcccaagactctgcttcgctcattccttgctcccttctaaggaaaaagctttcatcttcattgacctgggaaactgacatttcaatgttgaattaaaacttcagcttttggttgaacgcagtgagcaattttgactgaagagaacactgcagattctgaccgatcgtcgtgtcgaaaacccctggcgtcccagggtggtgtgtgggtagcatccctgtccagagcctcagtggaactgctggaaaggcctcctgcgtagccctgggtgaggcaccctggagacccgctctgcccaacagcatagcctgagctgccgaaggtctcagcccactgggtgcccctagagccgggtgggacagtggccagaggtcagggtgaccaaggaggagcagcaggagccggtccaccagaggccactgctgagtcggcccaaggtcagggtctgaatctggattatttgatagtttggggagcaaacaatgttaaaaagcaaaatcctgcagaggcgtctgtgcagggctctgaagtgtgcacacccgggcacaggctgggccaccacggctgttctgaaccggaggcctacgagtctgtgccccggccttgctgagacgctgcctgtcatgtcctcaggccccagctgggctcctgcccccacctgcaggacctcacagaaccagaacaacccgggagccaaaagcaaagtccctctcaaacacctcagtctgtcctgaaagaaaatgactgagcgtactgagaaagggtggtggaaatgaaacggctgtgctttgagaaagaagttccacgagaatgtcaacacctctgctaacagaaacgatccaggggtgccactaaacagcgttaagcaaaatacattgatttgccctttgtgtgtaaaaggcaaaaccctccatatcagggaggtgggctcttttctattttattttgcaccggtcataactgactcaagctggtttcctaagaaaatagaagagcgggattgtttaacatacgggtcctcgtggcctgaagtcagtgaatgatggggcagcacgagggaagcgctgcgtgaggcggccgacccgaggtggagcttccctcctgtctcactggtggaccctctcggtgggaaaccgcggggatgaaccgatctctaagactaaggttcaccaggcaccacagggggcgtcctccacagcaggggcaaggcgggatttaaccaaaacccgagccgatgcccctcatcccggcgtgaagggtcagacatgcagacacctgggagaatgcgggcctcagccctgcaatctaaccacgtggctgtgattcagtttactgccaccctgccttcctgggagctggaggagtgggagaggagggggctgcctgggcgggagagcggataggcgtgaggcccctgggtgaggcaccctggagacccgctctgtgcacgagagggagaagccataccagacaaaacaaatcactttccactttccaaattccagagctcctacctgccggccctgcaaggatgggatgtgggtgtgtgtgtcggtgtgtgtggtgtactgaggctgggtatgtgcacatatgtgcctatatgggtgctggatgcaggtacatgcactgggtgtgtactgagtgtgtgtctgtgctgggtgtgtgtgcactggttgtgtgtgtctgtgctggctgtgtgtatactaagtgtgtgtgcctgtgctgggtgtgtgtgcactgagtgtgtgtggactgggtgtgtgcacactgggtgtgtctgtgttgggtgtgtgtgtactgagtgtgtgagcactgggtatgtgtgcactgggtgtgtctgtgctgggtatgtgtactgggtgtgtgagcactgggtgtgtgtgcactgggtgtttgtgtctgtgttggtgtatctgtgttgggtgtgtctgtgctgggtgtgtgtgcactaggtgtttgtgtgctgggtgtgtctgtgctgggagtgtgtggactgagtgtgtgtggactgagtgtgtggagtgagtgtgtgtgcactgggtgtgtgtgtctgtgctgggtgggtgtagatggggtgtgtgtggactgattgtgtgtggactgggtgtgtgtgtgtctgtgctgggtgtatgtggactgggtgtgtggggactgggtatggactgtgtgtggactgagtgtatgtggactgggtgtgtgtggactgtgtgcactgggtgtgtgtggactgggtgtgtgtggactgtgtgcactgggtgtgtgtggactgggtgtgtgtggactgtgtgcactgggtgtgtgtggactgggtgtgtgtggactgagtgtatgtggactgggtgtgtgtggactgtgtgcatgtgcatgtgcatgtgtgtgtatgcgtgtgcatgtatgctgtgtaacctcactggctgtgtggctctcctgcagccctggcactcaagctgtgctctcatctcctgcctcccctctctgcccgtgccctcccctctccacttgcccccgcctcaccttctgggatgatccctgactcctgctcttcaaagtccctcaggccctgtggtcggctgtgcttcacagtgcccacctcactcacaaggacaacttcaacctcagagcacacagaggttccagagtccttcagaacaagcctcctgcctttacagactttttttttttttgaggcagagtctcactctatcgcccaggctggaacgcactggcccgatctctgctcactgcaacctctgcctcccgggttcaagtgattctcctgcctcagtctcccaagtagctgggattacaggctcgggccaccatgcccggctgatttttgtatttttagtagagacgggaattcaccatgttggtcacgctggtctcaaactcctgacctcaggtgatccgcccaccttggcctcccgaagtgctgggattacaggctgagccactgcgcccagctacagactcttgactacaggcttgacacgccgcggggcagcactgccctaccctcaagcccagaagctccaagtgtctctgctgcatgtcgcagccacatttccaaacataggctgagcctgtggagtgcaccctcactgacatcacggcagaggggacagcctgtgcaggggaccaggattctctccacacaaagagaagacacaaatgtcaactgcacaactgcaagacagggcactgactccggcacagcactcactcagcaagcgtctcctgagcctccacgcagtgccaaggccactgcgggcaggggggaagggcagtgggctccatgctggatctggcagcctctgagaagctgcaggccatttaagggattactgattagcataaatgattatagcatacagagctgagactctgtgctaatacagcgcaaagaccgcgtggagggaggttcccttctgtgcaggccgcagagggcttggaggagagaaggctcctcctgagatgggtgaactcagacagcagatgggtgagacaggcccaccaggcacagggaacgacaccagcaatgacagcagctgtctgctgggcttggaaggagagccagaggtgcatggaaagccgggcgggaaagacctgctagacatctgccgacaggcccagagtgtaaattctcctgcagggaaccttgagtcccagaaggtctttgaataggtaagtagcaccacctgatctgtgtgtttgacaataagtctgtaaactgtggggagaatggagcagacagaacacgcggaggctgctggtccaggtgagaagtcactgggaaggagagggacaccgggaggggcggaggaagcaaggcaggggacacactgaaaacaggctcacggctggtcacatgcagagaggaagggcaaggaggctgaggtgaccagtctcatctccaatcccctctccatctccattcccatctccatctccaactccatctccatctccaactccagtcccctctccatctccatctccattcccatctccatctccatctccaactccagtcccctctccatctccatttccatctctatctccatcatctccagtcccctctccatctccatttccatctctatctccaacatctccagtcccctctccatctccatctctatatccagtcccgtctccatctccatctccattcccatgtccatctcaatctccaattccagtcccctctgcatctccattcccatctccatccgcacctccatctccagtcccctctccatctccatcttccactccagtcccatctccgtctccagtaccatctcttgactgccccagctcacccagcagcacaagtgtgtgggcccctcccaggtggggcagaaacacagtcaccctggaaagaacagaagcacccacccaggtatgcgcacagagtcggccttggccatagagcagagtgaaacagaatgaaatagaaaatcctgccaggaaatgcctttagtgttaattctgaccaataacacagtgagttcttgaataaacactttgaaaaatctcactctttcagtgtcacatcaaacaccatacctcctgacatgaacctggcgtggggaacagcgcacgcgttttttaaagaacggcagcattatactctggtttctcctcagattgtatacatcttttgccttttactaaagaatggcagtgcatcggtatccccaatgtctctgtcagtcctactcactggcaaaaacaaacgacatgtggagaggagagcggttatgaagcatcaggaccaagagcttatcacgcaatgcctgaagcgtaaaaatggttttgcctgagctctgaagcatgtttctctctaacagaacacagtgctgcatcttgctgatggctaataacacacatggtaactgggatggccaaggtacccccctcctccagtaaggacacttgttataaatgaggaagatccgtgatcgctccacacgtctaggagagccacctcgacgcctcttccccaacatcgacaccgcgtggccagcccaggcactatgcgaggggcctcccactgcagctcagaaacaaaggcccaagagaaggagctccagggagaggaagattccagttcgggccggcaccaaggctgttggagattctttatgcaagcacacagacaacccagcattcctcagtgtgaaaccagatcaaaggcggcgacaagggtgaaggcaccgccactcaccaatctgtgcttgaggtggaccgtaatgagtggagagcccgacaggttctgagacagggtgggtggtggggacacctccagggaaatcaggtggctggtggcgaacagcaggcagtcctggtgatgcatggcctccgcgatccttgggaagagacggaaatcattacaaaatgggaaacgcaggggagcagcacacagctagaacctaggctgggagccagcgttccacccaaaactattgagacggaaatcttctttggatgaagctttgatttctttcattcagctcccgctgctctccttcaagatgtgaagctggtacctgcaggcgagttcaactattctgtgttttaactctgtcccttgaattcttatcttcaatacctgctctcgttaaggtgtgacgccaggaccaagaggtgagacagagccctcgacctcaaagagtttataagaaaagtaagatggcccaggaagcatggatgagcagaaatgctcaaaataacagggcatgaatctcaccgattccacttaatcagctgtgtgaccttgggcaggtaactcaccctgtctgagtgtcaatttccctgattataggatggtgcagtggccatctgctgttttgcccacccagtattcattcatcgttttcctgatcaaagcacctgccttcccctctaggtggccatccccttccccgctcacagcccacacagcctggagttgactctatcttggctcaggaggaagccctggtatctgggtctggatcagtcagtgcaccgcagccctcaggccatggggaccatttaggaatgacacccaatccagtcaaatctgaggagatgccagaaggcgaggtggggggagaatgagggctcaaagaccctcattctccctgccagacttctcctcatgccctgaggcacgaggccctgggagctgcttgcattcatgaggagggagactgattgagaagggaattgctgagagatggagcccagcaacagcaatgggatgctggatcgagctgctcctgaagccagccctctgcagagctctcggcttacgtgatccaataaactcccccttggcctaaaactgttaaagatgggttttccgccccttgcagcccaatctaaagaagcctaactgatgtctacagtggctgtctcgtggggttatgagcttgaaaagatattcagggccaggaggagggtgagggaagccaggtacctgaagggcaagattgaagaaggtgctcacactgggcacgaccccaaggatgaccagctcctttaattttgtgccctcagcccatttgcctgatttgatcccagccctgcctggcacacagcaggtcaccaagtatctgttccatgaatttgaatttggggtgactacacaaagatgcctgagacgtgctgtcaccgggccccccgcggtcacccagccgtctgcttctgtgtgggcctcacccgggtcctgtgcacctcccccgtccaccatccaaagcgctgactgactgaggaacctgcaggtccctgtttcgacacccactgaaccacctttgggacatcccacagggctctgggagctgggggcaccatatttttcctccctcaacttgtttttccttctaactagattcaaacaccgtgttcagtgaccctgcctgggatgggcggtggggctcatggagcaggagcacgtcccacctcacccccggcctctgcactgtctccttacacacatccctgagaaagagcaggcctccaagaagcacgcagaattattcctggaattgtaaatacaaagtgtttacaaagatggcgccatagagaatgaacaccctgtctgttcccgcagaagcgacttcctgcagatcatcaccagttcacagggtctggagcaaaccagggtcatcgattctcaggcctgtgagtaacaacagacgcgactgctcgacccggcaattcctctatgtgaccatgttattgatccaagcccaaagtccagatgacacacatggagtaaaacacaaacttaaaaaaaaaaaaaaatgaaaagaaagcatcaccctaggtccacgtgtctcaaccatttttttcattatagcccctctgaagaggctttttagacatttttttctaataaacttgcccagaaagttttagtcccacagagatacaagctgtacgtacagaacgtacataaacattccactctgcagagccgcagacccgggtagtatctcagatgtttccccggaagaacaacattcaccgtctgagaacattcaccactgggcatgcgtgggctcagtccccaccgcagaaagtgagggtgggctcgaggccgcagaaagttgggggggaccaaggcaaagccccgcggcgcccagcctgactcactcagcagaaccttgtccccgccccgcacgcgactccaaggccctaagacgtgtggtgtgttcgcttcagccaggagcctggttctcactctctgtgcccagtgccccgatgctcgtggccttttctgcagagctccatgaactcaacacgtgtgcaattccaccaaacgcgctggaaaaaccacgttgctagcaacacttagggctgtgccattagccagaacagaaagtcgcagctgtgggcttcaggccctaaacacgcagcatgatttgtcccttgactttccctccgtggacatttcctgatggtgcaaccggtggtcatcatctccctcccagaacagaaattcccctggggcccggatgctttcccgtttggttcactgctctccccagctcccggaaccacgcctgacacagtgggtgctcagcacacacgtgagtgagtgagcgagtggatgaatctactcacaggcaagcggcgatgacttagatccatttcttaggaaaaacataaggaaaacattaagtgagaaccttctatgaacacaaatgatatgagagcaaatctggagtggtttcctggattccgctccgggaacacgtggcctccaccaggcccagtttggtaatcagtgcgacgccagatgtcggccaagtcaagatgagaatggggccagacgcctccttaggagcattttcctccagtaaaggtggggacagaggtgaggtggggaagggtggggcaggggtgaggtggggcagggtggggaaggggtgaggtggggcagggtggggaaggggtgaggtggggcagggtggggcaggggtgaggtggggcagggtggggcagaggctgtgctggctcttcctctgccccttataccctgcctccacccgccccgtcctgtgcccatcagccaggctctgggctctctcccttcatgtgctcagcaaaagggaagccccagaaggtcagagggcatcggagcagatagtggggccaggattcttttccctcagcctaccagggcacagtcgctgccccgggggcccctccatctctgcccggggaaagccatctcttccagggcctgcctggctggccctggggaaagcagcgtgcccccattcttgttcctggcccgtgactgtgctgtcccccagagctctccactcctgattgcacctttgcaaatccgccttccttcaatgtgccccaagttactacctggccccacggagccccaccgatggtcaggctctgcgtccttcaccccacgcagcacatctgagccaaagccacgctgctgctccgccttccgttacacaaagaggggacttaaagttacatgaggcttcagaggagtgctgaaatctatgaggagacacagagacttcccagcctgtgcagaagaccggctcaggaactcaatccaaagaagtcagaccaagtggagtaagaaaaagggctgttattcggttatttggagaattatcaagtcctcacagttaccatgtcacattggggagtgaacaaacatcgcaaatgaaaatattccctggtaaaggaactccttgataactggctcctgctgacacatgcctgtgtgctcaaggaatcccctcacccatccgtcacacactgcttgtcaccttccctcagcgcgagaattcaacgccaccctgggaacacagtgtgaaggaaactccaaatcttgccaacaaggtggcacatggcagcatctctgagtgtgatcttgggtgatggtgaattcttgaaggagactgagcccctgactgacgcaaacagcagaaggagacagcatcgagggtaacaggcgacttcctcagcaccgatgctgcccaggtgacgttgttctctgtttcgagcagcactgcagccagggcctttcagaaaggacggcaacagccacaattcctgcccatgccaggagcccccgcagctttgcactgttaaaagtcaaaccagcaggaaatctgccagaaaacagtacaacgcataggcttcacctacactctcagctcttatcatttgccatgttcactttatctggcagtggtcacgctcacacttgacacacacataccacacatgtacacacacacacgcacatgtatgcacatacaacacacaaatgcacacacgcgcatttgcatgcccacagcacacacaaaacacacatgcacatatgtgcacacataacgcacatacaccacacaagcacatacatgcacctgtgtgcacacacacaacacacaaatacacgcacacatgcacatttcctttctgctgaagcactagcggtgtgttgcaggcatcacagcatactccatctctaccacgtgtctcctaaaaatggagactgcctcctatataaccatcaaacaatgatcacactcagaaatttaacgaggaccctacaagatgctctaatgcacagtccagagtcaactgcacacaccccccaccatcacacacgtcctccagaactccacttctctcaacccaggaatgtgcattagctcaggcacgaacctctttagtctcccccaatccggaactgcccaacttcttctcccttgcaatcgaaaccacagcagcacacaacatcgcttagttcaggtgtgtctgactgcttcctcgtgaggggcgtgaggccatgcatctgacaggagtatgccacaggaggcatggacgtctcccatgacgtgacagcaagagacacgggcccacaacgtgtcccacgttgataatgttgagtgtggccacctggctgcaggcgtgcggcagacatccccatcaccaggcaccctccgacctggtacagctaggactctgcaggtcggtgaggtcccccgccccgcaaccctgctcccgctggtgtgcacatccactgatagcttctgcctgggtcagttactgcactgagggctgcagaaccgtgacctactggttccatcggtgctccgtgtcactctatagtgactaaggacacacgctgagccgggtccacctccccactcatctttctcgagcacccgtgagtccctcacagcctggggagaggcccttccctctgtgggctgtggcttccatcttcacaggaggactgggagcaggccagtctcagccccgtccacctggaggaaccggctgtcccggtgctggctgagcctagcacgagcacccgtaaaagctgaacagtctccatcattgcggggccaggcagcgagtgagactcaaaggatcctaggggtacaagcagccgggcaagaagcagctaagcccccaccgggccgtgggtggtcagatatcatcccctccgtcatcacaggagccctggaatggtctgcctggggctggctgtggagacaaaagttccttccggcccaggccccaccctttgtgcactgagactcacgtactgacttagaccctcaccctcatccctggagaagaaattaaaggacactacggcaccaaagcatcctttcatcctcacaacacactgcggatgtatgaggatgacagcacacaatacaaagacaaagacggagggaagtcccctgcaggctggcaggaacccggcatatgtgcgcacataaacgtgctgcccgcacggcagctgcactaacctgcttctcatcgtgcccaggatttgataattacctcaaaggcaaaatggcacaaatgcccaatcagcttacaaaatcacaaaagcaggcacttgtatgtcatgtttaagaaaaccaagccctacttacaccattaactcattcagtcctcctggcaatcctcagaaatcagtgctattattactcctgttttaagaggagaacacaggcctccaggctcaagtcacttgcccagggtcacacagataaggagggcacctgtgaaccaaactctttgtcccctccacttccgtccacctcttctgctacaggtacaaggtacacaggtacaatgtaacaagtacagagactttactggatgagctgtttgcatgatttttttccaggtgaattttgatgacaaggcatctttgcactaagtgctgaagagagcttcacctgagctgaagatccaacttcactgcaaatgaaaaacatgttccatcgctgcacagccagttctgctttggcttcagcacgtaaatgtgctgctcatggaacatgttgtggggctggtgtcaatgctgacgaaccagggatgacttggctgtccaatttccaggccctcggtttgcagggggacgtcagagttagctgcattgttctgggacacagtggcctgcatcctggggctccagtgtcctgtctgcagacacctgggtccgtgaggacagcagagggagagtgaaggctgaggccctggggacaggcgagacagactgtcttccatctgcaaggctgtgggctccccagagcaggccccgccggcctctcctctgcccatccctgccagcgctgatctaatagagggtctggcaaagatctgcaaactgcagctcttgggctggccgcctggttttgtaaataaagctgtattggaaggcagccactcccccatttccccacgtagtgtctctggctgccttcaccctgtgagggcagagttctggaaagccaagccgatttacaagctggcccttcatgaaagagctggctgacacctggctggagtcagattctggtggtcacagtgaattgcccctgaaatgtgtgcaccctgcatctggaagcaatcctcccgcctttgtgacgttgtgggccgtggcacggatgccgctttcccacgcaggttctcactgtggccgcacaagacacagcgacacctcacaaatgcacgtctcatatatttcacagcaaggccagcttcctggtggaaacttcagcaggaggggccaaggaagggtcaccttttcattcactatcttggaaagatctccccaaataactgagatggcatctttttgaggaaaatagattgcatttttctttgaccattttcctgaagaattttggaaatcacacataaagagtggcaggccccccactttctttcattaggaggaaatcggtaagcatgcaggctttccccaagaaatctgacgcagaagacggtgtttcctccagatcacaaaatttaggactacattcctcaggaaagaggcatcccctcccctccctcctcatttccctcatcctccccagcctcgccgcccccctcatggtccccaccctccttgctctccttctgggttctcaggacccaaacccacatgaggcgatgctgcaggagccagctctgctcctatggaggggcctgtctggaggacagcagaggcagggggcagacagagcaggtctagacggcgtcctcggggtccccgggtccagccatgactgaggcccacctgctcctcccttttcagtcccctgagccctcagtttcctggccttccacttaagctgatgtgaaatggctttgcccatctgtgtgtttgcccatgactgacacagacaggtctgttgtcttccattacacagcagtggaaactgaggctcagagaggttaagtcccttgcccaaggtcacacagttctgtccaggcgggtgggtagggtcttctggcccgtgctcctgacctccactccaccagcctggccccagccttgcagttcccaagtggccttcaaaacgcttcacgtttccttgcccgagcagtgaagcgcccggtactcgtgtccagagttctcagtgttgtgcgtgtggggcgggcatccctgtggccagccacccagcaaacccacgcacacccacgcccctgagctgagcacccccgagactcacttggtgtgggcgggccagatgttgttcaggtagtagtgcatgctgtggtacagcagacccacgacggtgctccaggctgcagagagagcagaggggcaggcgctgtcagcgctccaggccacaggcaggaaaaacacaaagccccacgccccgccatgcatggtgctgcccctcactcctaagaaccctctggggagaaggaagtgaaggacactcgggcagaatttgcaaggacaaagactctgcagcaactcagcagcgtgacggtggatccctgctccatcccctgagccagctccagacatgtggaggctgaaaccccccagggagggccaggctcacccagggcatcacacggtctcagagcccctgcagggagagccaggctcacccagggcatcacacagtctcagagcccctgcagggagacagctcctgcaagtcaacagggggcagtgccagcctccagccttgccccacgagtgcatcccgtctgccctccacacgcagaggatttagggcaacactgagtgaggcagaatgcaggttttcaagggggcagcagccactgggaagtctgtatgccttcacctggtcacacctctattataaccagccatgaagcagggtcacatgtgcttttgctatttcactccatggctcggccacggctctgccaggattggaaatcagggcactcccagcagatcatgcggccaggagatgctggtagatgtcggcaccatccctgggccctccctgctgatgctggaggaaggtggcatcgtccctgggcccttcccttggcttctggggtagggacatccctgcctctgccctaggagcagggcacacctgacatcatgctagttgaggacagggcagagaaccagtcggggcacctttcccacagacaatcaagatggtggtgggtgcagagacaggctccccactgcagagagagatgtctgatgagggctgtcctggtccccatccctaaggcagaaccctgggaagggggcgtggcctctggccagggtggcaggggcaaaaatctgaggctctcccctgcttgcccgaggtccccagggagggaaggagaggaaggagatgtctgcagagtcatattcgcttttccaggaaccagagagggtgacggtcattgtagcaaaaaatagccagggccatctgggctcccaacagggctccctggtcagaggcagggggtcccctgagcctctcattttttattatgtgactcgactgaggcctgcacaggagtggaaccccaggttcctgaacagatgaacccctcacctggcccacagctacctgagcaggaaggggaggtggccccatctttttatcttcggctgaccaggtgtgtgccgatttaggaggatgtaggtaggatgacttcccagtgggccggattccccaggcgagcaggttgagatgctcccagaccccaccccaaattccagttcagtggcctggagtgggcacagcattagcatcactaaggaacctctcaagcgtgtccatgagggtggcctgaggacacgctttgagaacggctgcccacagtccctctcctgcaggacaggacaggcagtccgggggagcaccgcaggcggcccgggggagcaccgcagctccctggcgcggtgggcacccagcaaagcttggggactcttcagaaagacttgagggagccgccccggaagggagtccagcgcagccacactcaccgtgcctgtggaaggcctcgtgggggatctggatgaagctctgcccgtgggccgggaagcggtaatgggaggaattcacggtcttgggcaggattttggccacggaaaactctgcggtggaaggagcgagagagcggaagtcccgtcagagctcacaggctgcaggaaatcagactgcaaaaccccgtctgcttttcttttttgacaggacaagctccccacgggaagtataattacctttagaaagcatggcctcaaaaaaaaaaaaaaaaagggtaaagcaatgaagagcccaggcagtgactgccacggggaggctcagcattccggcccacgggcgcgcggctcctcacctggggcgccctccgccccagcacagcccccagctctcaaggccggtgcaaggatgggctgtgctcagcgatgcggtgacatcggctcctccccaagcgcagcaggcgagggcaacacggccaacaaactgcgactaaactaacccctgtagcttcagcccattttccccagctcggctcttgcagcgaagtatcagcaggataatgcactcctggtaaagacttttaaaatcgaaaggtcatcacctctgcctctacaattagacaactgtgacaattaccctggagcccagctgagagcaagctgacgccagaaacccgaggccaccccttttattccacagactcttgcaggcactgctgcttctgcctcctgctctgaaccgagaccatcatcccagggcaggagcttggctcccaagtcactgggaaaagcttatgggccccatctgcatatcatggccgaacacacctgccctcatctgaccacgggttttccttccaaatgtggtttgtgccaggcagagcagtcagggagacagagcatggctctctgctaagggtgtaaaaagacaggcagtgaaacgcagcctccagcccccgcccctgccatgtggctcacccttacaagcgacagctacctgccatggcagaggagccctccacggtgacctggggcgtgctgccgtgcaggttggaggatacatggcccatgacggtgtcaatagtgtcgatgagactcagtaccacggcgctgtcctgcagcaacacaagcaccaggagccatgaaaatccaccccactcagccagggcaccaggcaggtgcaccaggcacacaaaatcaagtttccccacgttggccacgagggaggaagaagtcacacaactgccccttcccatggatcaggaggggaccacacggaggccacacacccgactgagctcacggagcatggacacagcccaggtggacccatcaccccagccatcgccggctcctgcatttctacacttagacacggggactgaggggacccaactcctggtcctgcctcctccctgaactcacagagggaccctcagcacatcccagaccctccccctacctccctgtgcttcacgaggaggggctgatcgcccccaggtccactctgggatggggacaccagcagctctgtccccttctccatgaagggtggctgcttccgaggtgccggcacccagagctatctctggctgccttgacttcccaggagcttgccttctactccaagagccctctttcctttctgagttccagagcagaggatcctggtagacactgcccccaagaaagcagggggccctcatcctcagacacacatcaccaggggagaggcctctcttaagccctgctgagctgggccagtgagctctgccttcactgcttctcttcctgcctttctggggaagcacctgcctgctgctaagtcctcagcattctcccacaaacacgcacttcagaagagcctcatgagctggaaatagaatgctgaggccaattttagatatttgcttttaggcccatagcctgatttcagtcaccaggcccagttaagcacatggaagtctgtgtttctggcatgcagttctgtggggtagagaccgattcatgcattctctttaatgcatattggaccctgcctgagtctggacagtttcctggttattcatattttgtaacagatttgcatattttgcattcaaaagcagttaattaaaatcatgcacaaaatacgtctgcctggatacttccattggctgtcctctgggtgttcccagcctgcagctttggacacaaagtccccttgaaatcatgaaagaggtcaaaccttttaaaaaggaattgttttctaggtaagactgtatccatcttacattcttgagcctttttttctccctttgccactgttaaacctaatctcattccacttgaaattattcaaacaaaagtttatcaaatgtaaactctaacgcaatcttattaataatgagagaataaaatgccacttctgccctcaaactggcaaacattttcaaatattatcagggcttaggagaatgagcactttaatatcatggtggtgtggttgggacccttctgggccaaggcagttaagagtcctcctcacccttctctgcccctgcctggcaaccttggaaaccacatattgagaagccagcaccggaagacagatggagccaggatccctgagtatctgggtggagaagaggctcctctgactcactctggactttgcatggcagagaagtaaatttctactgtgctgagccactgagatgtagggatctatttgttactgcagtgcaccctggcctgtcctgactaatacagtgttgcaggtgaatacttagtatcattggaaagtgttattgacataattaaggaaaaacaaattaagtcaaatatacagtatatctgttgaatacatatataagtgaattgaaaactagactataaggaaatatacaagaatgttaataatctcagttttaggatttgaagtgatttttattttgttttttattatctgcattttctaacttctccacaactatttatttgttttctttttaaataagtacaatcaagttattttcagaaatataggaaaaattatttcattctcctttctagctattttgagtaaagagaacaagagaagctttttttctgcaccttaatcatgaagtacatattgtcatgtattctcctttttcttactaaatccagtgacttttaacataaaaagctttctattgtcattcaagaatgatgggatggtaaagaaaaaaaaaatacatattacatgaaatgaccaggatgaaccaagtacacatttctcatggggaaaaaaccatcatttccttcttccatgtttaggacagtaacacattactgacacacgtgcatttcttttgccttagaggacaaggcattctgaatcagttgcatgtctactcaaaatgagctcttatatcccagatgtcaggactgggagatacatcattctttttgtggatgtgactgggccatattatgccacttctaggaagacaaaatggttcccgaggcacatacgttttgaagatcaaaatgttcttttctctctctctcttttttttttttttttttgttttttgagacagagtctcactctgttgcccaggctggagtgcagtggcacaacctcggctcactgcaacctccgcctcccaggttccagcaattctcctgcctcagcctcctgagtagctgggactacaggtgcccgccaccacgcctggctaatttttgtatttttagtagagatggggttttgccacattggccaggctggtcttgactcctgacctcaagtgatccacccgccttggcctcccaaagtgctgggattataggtatgagccaccatgaccgaccatgttcttttctcttacctctgacagagcaatccaaccaggcagtagaaggatctctcccacggcttttaagaaggtctaaaggtggacaaaatgacactgctcagcacctgtccttaggcaacaaacttgaagaccttcagttttccccgcatcttccaatgggtctctatcaaccaccagttcagttttatgcacggcagtcaacaaaaatagctgagtcatggaccacatgatatgttacgaagcccttttatggacgttatcttatttgctcctgtggcagccctgtcgagtcagtgaccagcaccggaacgtcagaatgaacactgctcagtgacggcaggggccctagcacagcgcctgggggacacggcaggccctcagtgaaagcccgtggagtggagagacgtgtgggaaaatcatgacctgctggatgcgcttttcttggggcgagaaaccaaactgacgtggaagcactcgtgttcactgaaaatgacctctctagaaagcagaagctactcaggcccttggtcaggtcaccttaaaaccatgtttggttcggctcactattattctaaggaaacaatgaaattaatttctactgtttcctaatcaggagacttaaatgaaaacgtgaattttctacttcgttttaaaaaagcagactcttggacaccccttagcccacattcccataaaaccataattgaccacagctgagcggcaccggcttagtggatgtgtccccagcccactccagaccccgccatccccactgcctcatacgctcatgtccgtttcactcatctgcattattcacacacagtcttaactgtttgtctccaactatcagcatcagaattaaacttagaggctgaccgaactctcccatatttccaccaaaccgccatctccagaatactcacgttcttcctcacactctgagacactaaattcttagagcacatcatcaaaactcatcatgcatttgtttatctttatgagataaatgctttttgagaccttagagtgcaaggccttaagaattaatgaaatagggaataatcaccatcctgccttcactgagccggagcaggggcagcaaacttcttaaagtgtcacacaggaacgaggtcaggcctcatgggtcacgccctgtgtcacaaacactcaactctgccatggcagtgcaaaagcagccacagacaatatgcaaacaaatgggcatgcatgaataaaactttatttccaaaagcaagcaacgggccagatttgactcgagggccatagtttgccgactcttgatccagagcagtctatcacacagaaacataatatgggccacatctatcattttaaattttctagcagcaagcacatttttaagaagtagaataaaaaaggtgaaactaattttaataatgtatttttacttagctcaaaaacctaaaatattgtcatttcaacacagaatccatatgaaattactaattagatatttcccttttctttgcacaaagttttagaaatccagtgtgcatcttacactcacagcacatctctagttggacgagccacacgtagctaatcactgcctcacggtacagtacaggaaatgaccccttgccattttcccgtccagctgctagtggacaggtgagaagccaggacaccatggaaacttgtagaatggggccgggcgcagtggctcacacctgtcatcccagcactttgggaggctgagacgggtggatcatttgaggtcaggagttgaagaccagcctgggaaacatagtgagaccccatctctactaaaaatacaaaaattagtcaggtgtagtggtgcatgcctgtagtcccagctacttgggaggctgaggcaggagaatcgcttgaactcagaaggcagaggttgcagtgagccaagatcatgccactgcactccaacctgggtgacagagcgagactccatctcaaaaaaagaaaggaaaagaaaagaaaagaaaaaagaaagaaactaacttgtataatggatgccaaaaactttgacttctcatcaggtcagagatcactggggttttgggtaaatctgcatgactcatccccagggtccccagccagataccccaaaacaggtctacaccaggggtcccacagggatggcacacaggctgagcctgcctcgtagatgtcttgtatttggtctgcacataatttcatttaagatttctgctctccctctccctctccccctccccctccctctccccacggtctccctctccctctctttccacagtctccctctgatgccgagccgaagctggactgtactgctgccatctcggctcactgcaacctccctgcctgattctcctgcctcagcctgccatgcctgactggttttcgtttttttttggtggagacggggtttcgctgtgttggccaggctggtctccagctcctaaccgcgagtgatccgccagcctcagcctccggaggtgcggggattgcagacggtgtctggttcactcagtgctcaatggtgcccaggctggagtgcagtggcgtgatctgggctagctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccgtctaggaaatgaggagcgcctcttcccggccgccatcccatctaggaagcgaggagtgtctctgcccggccgcccatcgtctgagatgtggggagcgcctttgccccgccgccccgtctgggatgtgaggagcgcctctgctcggctgtgaccccatctgggaggtgaggagcgtctctgcccagccgccccgtctgagaagtgaggagaccctccgcctggcaaccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggtcagcccccgccaggccagctgccccgtccgggaggtgacgggcgcctctgcccagccgcccctactgggaagtgaggagcccctctgcccggccagctgccccgtccgggggggggggtcagccccccgcccggcaagccgccccgtccgggagggaggtgggggatcagccccccgcccggccagccgccccgtccaggaggtgaggggtgcctctgcccggccgcccctactgggaagtgaggagcccctctgcctggccagccgccccgtccgggagggaggtgggggggtcagccccccgcctggccagccgccccatccgggagggaggttggggggtcagccccccacccggccagccaccccgtccgggaggtgaggggctcctctgcccggccgcccctactgggaagtgaggagcccctctgcccggccagccaccccgtccgggagggaggtgggggggtcagccccccgcccggccagccgccccgtccgggaggtgaggggcgcctctgcccggccacccctactgggaagtgaggagcccctctgcccggccagccaccccgtccgggagggtggtgggggggtcagccccccgcccggccagccgccccgtctgggagggaggtgggggggtcagccccccgcccggccagccgcctcgtccgggaggtgaggggcgcctctgcccggccgcccctactgggaagtgaggagcccctctgcccggccagccgccccgtccgggagggaggtggagggtcagccccccgcccggccagccgccccgtccaggaggtgaggggcgcctctgcccggccgcccctactgggaagtgaggagcccctctacccggccagccgccccgtccgggagggaggtggggggtcagccccccgcccggccagccgccccgtccaggaggtgaggggcgcctctgcccggccgcccctactgggaagtgaggagcccctctgcccggccaccaccccgtctgggaggtgtacccaacagctcattgagaacgggccaggatgacaatcgcggctttgtggaatagaaagggggaaaggtggggaaaagattgagaaatcagatggttgccgtgtctgtgtagaaagaagtagacatgggagacttttcattttgttctgtactaagaaaaattcttctaccttgggatcctgttgatctatgaccttacccccaaacctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttctttgttcacttgtttatctgctgaccttccctccactattgtcctatgaccctgccaaatccccctctgcgagaaacacccaagaatgatcaataaaaaattaaaaaaaataaaataaaacaggttgaaaaaaaaaaaagatttcagttcactgcccatttcttaaaattgggagatgttccattttaaaaatccaggtctggggtttttcttgcaaaatcagaatcagtcaccctaacggttacagacaggtggccttgagttgctagcaactgctggctgcagaggaggcggtgcattcaggctgccactacctctctctactccccactgttgctctgtctggcccatgccatccatttcctttggcccctgaagccacatgagtttgcaacctctgactctcaggtatagctgagggagagaaggaagaaaagcagcaaggaaagtaaaagtgaccaagcttaaaaagaaagtgtttcctgtgtagacctgcattgccttgtgttgcaaaccagacagccaataaggatacggagctgccttggcctccacccacctcactgcgcatacgccatccccacccaacaaccccagcccccacacctgggctccgcagagggcagccctgcctggccttttctggggtgcgtgcctgtctggccttggccccaagttctgcttgtcctactttgtccctgtctcactcctgccagccccaccaccaactcttcccacagacctgccagcctggccacaccctatcacactcagttcagggacctgctgggtggtgtgggccacaatgacacggctaactgctgccactgcagtgtcaggtgcgagacagacccttctagcccgtgatgaagagatcacagagccaggcaggcggtgggccacagtggctccggcctgccctagggcaggacacacacttctagaaggttctgaggagtgacctttaggaccagcatcccacaggcagctttccagctaactggacatgcccctggccacaagccccacgagggcaggggcaatgcccggcacatccatcacacatccccagcaccaagcccagcatctggcagagagcggaggctgcacaatgtgcttaattaataaagtcatcagtgaacccactcatgagcatgcaactgtggctcattaagccatccattttataattaatgaagcaacccacccacaagtaggtgtttaatcaacattcgtctaattaatttatcctcactcggactccctccttccctagacacccggaaacacagagggagcctgctaagtgtctgctgcacattcctgaggatgctgcagggtacccatggctagtcagacgggagggcgcccgtgcccagagtgggtgtttattgagcgccgactgtgtaccacggctagaggggagggtgccagtgccaagtgggcatgaagccccgactgcataccttagctacaggcagggcactagtgcccggagtgtgagtgtttactaagtgctaactgcatagaaggcaccgcctgccacagtcaccccttgtagcccatctcaacaaaaacaagagtgttcgtattaataaagcacttactgcataccaagccctgtctcggggcctcacgcccggtcctgtgcatacatgcataaggaccttccagcttgtctatacccgctctttccacccaacaccccgcgggtccttcccttcggagcccggaagcgctcccacactgggcagccttggccccaccctagagctccttcatgattggctgagctggttgctaatcccactccccttggttagtgattggcccaggtgtggtcatgtggcccagctctggccactgagatgtgagggggtgtctcagcaaagggaaccatgggaaagatttccccctgacgaggagggagtctcccgacccgttctttccctcctggacgtgccagggtaaggcgagggtgctgggggcctgcagctgggcgagaaaagggccgagtgccgagagaattgtggcggtgcctatccagcccctgctgtgagtgaagactgagttagtgactcctaggattcccgcctctgggcctcttgttgcctgaagcgagtacatggcctgaagtctaagtccgctaagcagagggccctgtttctcacagccagaagtacctgagacacatgggcgatctcactgtccccatgtcacagtgggaagcaggtgtgctgaggttaaataaccttcccacggacacagagccgggagtggtggagctggggtcaaagccaggtctctgtgactccaggaccgctgagtcccgcagctccatgtagttccctttaaagcccctctcagactccatgacctgtcatcactccctcaaccctgagcctcttgaaagcagggagtattagcacttggtcatcctgcactcccagaatctagtatggtctatgaatgaatgaatgaatgaatgaatgaatgaatgaaatctgagaagtctaacttctcttacgtggacagaaaagctgagggcaacctccctccattccaagatgtctcaagtccctgaacacatggctctgcatgtgcttctttgggtgtgacttcagcaaggaaatcagtaagaattaagaacccttgaaaagtgctcaccacgtacccagcactgttctgtgcacataggaacccacttatccccgatgaagtgggcgctgttattatttcctccacatctcaggagccaagtgaggcagagatgttaggtcacttgaccaaggacacagagtaactgcagatcaaaggtcagtgcagccgtgggacttcatataccctgctcctaacccatatgctgtgctttcaaggtgagccaatctcaaaaccccttctgtcttcgcatccaccaagataagccctagccctaaaacagaagacagcaagtccacgagagcccacgatccaccctctgccttcacctggaaactatttggaggagcagaaagagaaaccatcttgattttaatgccataaatgttgcattctctaagtgtttagatagctttggggactcccactgtgcacaggctgtggcccacgccccacggctggatctgccagtgaggcctctccaccttttacctgttgccaggaggcagcagagtttatttagtctaggagttgccaaccacacgcccgcgggggccaggtggctgcacaggggggaccaggcaggttgggcattgggaaaccacagcaaagactcaagtgcccataaaggaagctccgctgagctgtacagagctggccaggagggccacaccagctggttgttcatgagaagcctgaaacccaaacgtttcagtaaaagttcctgctttttttaaactcgatctaggtcaaacagaaacatctatggtcccggtaagggtgccacgcccggtccaccagacacagacatcaaatagccttaccttggtgagattcaaggctgtctgctccgagagggacttactgggtaagctgagggatacattttggaggtaactcagtatcactccgggactttggaaggtttttctctcttctgtcaggttggttatgatgggatggtaggcatctgtgggcatctgaaagaaattggcaacatgagtttctactaagaactaaaaccaaaatattatacagaagtttaatgtgtcctactctgggtcgaatgctttttttaatttttttttttttttttgagactgagtcttgctctgttgcccaggctggagtgcagtggcgcaatctcggctcactgcagcctctgcctcccgggttcaagcgagtctcttgcctcagcctcccaagtagctgagactacaggcgtgcaccaccatgcctggctaatttttgtatttttagtagagacagggtttcactgtgttggccaggctggtctcgagctccggacctcaagtgatccttctgcctcgacctcccaaattgctgggattacaggcatgagcaactgtgcctggctgctcttttttttatttatagagatggggtttcactgtgtttcccaggctggactcgagcagtcctcctgtctcagctttctgagcagctgggactacaggtgcaaccaccacacccagctggtcaaatgtttttataccatgatagtaatatagctcctaccatgtatctgacacttttgtgaatattttgcttatattaacatttcatcctcacaacaaccttacaaaataagtccccatttgatggatgacactaagcgcagagaggcttactcaaaaataagtggtagaacttggatttgaacccaagcagatgggtcagagtctgtgcactcactattatattaacgttctcaagaaaggacagttctttaactacaaacactaattccagacaagaatttttctatatgaattgaacttttctctaacatcaaacgaaaagggcatagagagaagccaagcagggcagattcctcactccccactcacggcgcccacgtcccatgaatgagcccggtatttccttttgggcacctgaggttcctggtggcaggagttgagagttttcccttcagtcactcttagcaccaagaattagtactgcagttggcttcccctccatttgttatttcttcccagacaatgtactgccgataacagagagcccagacacctaatggaattttctctctcccagcaaacagcccaagcagaagaacatcagcaagggggaccaaggaagatgtgtctgctcaccacggggcttgctgtggatgtcatgaagaggcttggcagcgttgaagacaataaagcatgctttcctggaagaaacaatgctggattaaggactaaaacatggtcacttttttcaccacgaggaagacctgtccttgttaaaaatgtactggcttcagacacatggaagagagtctgagaatgttttgagtaggaatgttgctggagataaattatgggctaagaaatcagctgactgagtcgaccgtatagattttcccaggtcacattacttttccatttgtattctcaatcgcttttgaacacccttcatgcaagtcagcatatcaaaagatgattttatacaaggattaccgatttcaaataaataaagaaccaaaagaaatagatttcaattgcatccagactggttggagataaaatgaggagtgctacaactcgctgggccagcacagacaggagccctgggagcgctctcctctgagatcgatgaagtgagaataggccccagtaaagcagtggagaaaactgtcttcctgagccccctctagcccaaggattccagctattctttgcactcagcccccatggggttaatgatgaattattacaaacaatgaagacatttaaggctgaagactaagccatgatttgctgttctctgcctgttcacccccaactatttctaatcccactatttcctgatgagaacacacacttaaccagatattctacttcatttttggaaaatctcttgaagttgctttggatgagctgaggaaatgacatcatcaccccttgctggctgcaggagtgactgagcccttgggtttgggtggggttgggctgctggtgaacgcagaaggtgtggcgctgccgagagaactggaccccagaaccgctctgttctccaagtcagagtgacattcactcctcaggtgccaatgagttacagaggagtcatgtcaaactcacatttaactcgtgtgtgtccacaaagcagagtgagggatagtgaaaatcggtccagcgatcctgccaacgcttgcaagcgatgaccatggagactggggtgaaaatgagaatctgccaggtcctcagtcggtcccagttcccacgtgttgagtgtgtttccagtgcccaaaggtacatgctttccgattacacgtatctgaacataaccttcttcctcctctacagaaagagctgctgtccattccagtggtaagggagaggggacacctggccagggtgacagacggtcagcactgtgcctttgtatcaggaaaggccaccacacctggacggaccggtcagcaaatggtgccagctctggctcatgagattagaggaggtgtcacctctgcccaggtcactcagaaaaaagccccctctgggcacctacagccccagcacagcttcaaatgcagacaggtcttcatgtaaagaaagacttctacctacttgtgtggccatgtccccaccgaggcccggcctggctgggagcagactggatttcagttccagttgtcactctgcatggctgccctgaactcggctgtgtcagactcactgagcagtggtacacggggccccacacaggccttccagggacttcaagagccattctcctatacatgctttacgtcgtatgccttgtcttcagaccaggtcaccaggtgcaatgggattctggtcgatccagttctggttcagttctggttctggcgatgagggtttgctctgacaagaacaagaaccagaaacaagggcacctctttccagtgttactaaaacaagtaaactgtcaggagggcaggctttgtttgaagcttttcataacataaatacaagtgatatcttggtttcaaagtgacaactctaaaccctaggcaataaaatgcagtagattggtccatttttttcttctgaaggatgctatcatttgccctctgtcagtgctaggagagggaatgcattccgttttcctgggtggaagctggaagatgtaaatgtcgaaggctgtagtggacacaggctgttttgcctgcacagcatctgttccttctgagaccagcatacctgattgtcccctgggagtcccctctcctccacatgttctggacaaggctgacctcactgtcatttcaggggggctggggatgggggactatgacagagacctaagccagtcagcatattctgcactcccagacacagaaaatgactcatggaaggtgcatggataaatgtgagccaatgtgagtcctgcccagccccagcatgggaagtgataagagaaagaagctccctcttttccacagaggctgctgagggcagaggatgcaacactagaagcatgacagccaccttggcaccaggaggaggctaacaaaagagggcagggtcaaacgcagagattcccactgacatcatgtgagcacctggaccaaaccagttctgaagcagtttcccctagagcttccattgcaagagatgaaaaagaaacacatggctttcttggctaaagttatcttgaattgggttttctgtcatgcaatcaatagggtcctaacaactgagggactcaacgtcagaagcggaacgagggcaggcagcgtctggaactcaggcctttctctcctggtcctgacatccgctgtgctgggtcccaatgaagcagcagccacatgtttgtgagtgcctacatggggtctgtcattttttagcagattattttatgtggaaataaagaaacccattggggaaaaaatggtgcattcacttgtgggcagcatgaaaatggaattgtaggggaaagatgaatattaattttaaaaacagctaagaaccactggattcttgccatatgccaggcattgtgctaatggcctttattatcaacacctcccccagaaagggagtatttttatccatttaacagagcaaaaaaaaaatctgagagattaagacaaaaaggttatacgttacacatttccatttatgtggaatctccaaaataggtaaagacagaaagtagattcgtggttgccagagtctgggggaggggaaggcggggagtgactgtactcaccgggtgcggggtttccttttggggggatgaaaatgtttccaagccaggtagaggtggcagctgcataacaccgtgaatgtgccaagtgtactgacttgttcatttttaaatggttatgtttatgatatatgaatttgacctcagtttttaaaaatgacttcccaaagtctcacggctcattatggcacaatgaatatttgaaccccagtccacctacccacaggcccctgccccgaacaactgccctgtgctgaataggaagaggtatcttcggggctttccaagggcccatcccctgggaggcacacggctaacatttgttgatcaaaaacactaatggatctggaatacttgctctccaaagccttctataatcgtccatcacatataccttgaaaccccgtgatgatcaacagaacaatattcatctcaaagcatctctagtaaattattaactcctctatctcagggaacaggtgttctaacacacaactgtgtttataaggttcattaggacacatctcacgcctgcagtgctgatagctgcaacgggagagtggggagaaaggaggccgataccagggtgaccctgggaacagacagcggatctgccccagcccttcacactcactgaccaatggcagcagtgaagtacatggcgatctcatccggagtcagagcccgctcccagatgatgaactcatcgaaagcaccgttctcataacacttggcctggtcctgctcagaccctatcacgaggttgacgttggactctccatagtcacgagacacttttccactcggatcagaggtgctcagggtcccgttgacgtagactttcaggccctccttggatttccatgtaaataggacatgagtccaataggggcctggaaaagagtgaagatcgccattctgagtactgtgggaatgagctccccatgcacaggtttttcctgtttgtaggcacatccttctttcttaaggtgatcaatcactgttaactgtggtgcgtcctaatacaaggtataacacagacctgactttccccagtcctttggagcacaggaaggatgttatctttttgtccttatgccctaaattccagaagcagttcaaggagactccttgttattttaacatagtagttacaaattcaaatgcccacaagcaagtgtgattaaaatatttgaaaaatggcagggcacaagtgccaaccaatcagaccataagctcagttaagaaaaaatggtcaggagcgagacaaggatgtccccttttaccactcctttttaacattgtactgaaagtcctaactaatgcaataaggcaaaaaaggaaaaaaaaggaaataagaatataaatattgggaaggatgcaataaaactatatttattcacagatgatgtgattgtctatgtagaaaatccaaaagaatcaacaacaaagctgaaactaatgagtgagcatagcaagattacaggctacaaggttaatatacaagtcaattgctccccatctgccagcaacgaacaagtagaatttacaattaaaaaacacattaccattgtcattggtgccaaaaaaggaaaaagaaatacatatattataacaatacatttataagctatatataaagaaaactatataactctgatgaaagaaattaaacaagaactaaataaatggagagatattccatattcatggacagaaagactcaatgttgtgaagatgtcagttcttcccaaattgatctatatattcaacacaatcccaataaaaatctcatcaagttattttgtggatattgataaactatggagaaggaagagagccagaatagccaatacaatattgaaggagaaaaacaacattggaggaacaacactacccaatttccagacttactataaaaagttacagtagtcaagacagtgtggcattggaaaaaaacagatgaatagatctgtgggacagaataaacagcccagagatagaccaataaaaatacagtcaaccaatctttgacaaaggagaaaaggcagtacaatgaacaaacagaaccatttgttgcaacaaatggtgctgcaacaactgaatatccacgttccaaaaaataaaaagaatcttggccggacgcagtggctcacgcctgtaacctcagcactttgggaggccgaggcaggtggatcacctgaagtcaggagttcgagaccagcctagccaacatggcaaaaccccgtctccacaaaaatacaaaaaattagctgggcgtggtggcaggtgtctgtaatcccagctactcaggaggctgaggcaggaagaattgcttgaacccgggaggtggaggttgcagtgagccgagatcgccccattgcactccagcctggacaacaagagccaaactccatctcaaaaaaaacaaaaaaaaaatcttaaacctgtcataaaaattaattcaaaatggactataggtctaatataaaatgcaaaactataaaacccttagaagataatataggaaaaacatctagatgaccttgggtttagtgatgacttattagatccaacaccaaaggcacaatccatgaaagaaataattgacaagctggacttccttacaactaaaaatgtctgctctgtgaaagacactgtcaagagaatgagaagacaagtcacggatggggagaaaatatttggaaaagacatgataaaggactattatccaaaatacacccaaaaactcttaaaattcaacagtaagaaaacaaacgacccgcattttgggaggctgagatgggaggatcgcttgaagccaggagtttgagaccagcctgggcaaccaagtaagacctcacctgtaccaaaaaaaaaaaaaaactagtgagacatggtggcacatgccggtaatcccagctacttgggcaactgaggtaggaggatcacctgagccctggagttaaacgctgcagtaagctgtgattgcaccactgtactccagcctggatgacagatcctgtcagaaagaaaaagaaagaaagagagaaagagagaagagaggagagagagagtgagagagagagagaagagaagaaagaaggaaggaaagaaggaaaggaagggagcaagggaggatggaaggcaagaaggaaggaaggaagggagggaggaagggagggagggaaagaaggaaaagagagaggaggggaagaagaaagggaggaaggaaaaaagaaagaaaaacaatccaatttttaaaatgggcgaaagatcaacctcaccaacccatagaatgtacaacaccgagagcaaatgctaatgtgaactatggactttgggtgacaatgatgtgtcactgtaggttcatcacatgtaacaaatggatcattctggtgggggaatgtccatagtgggggaagctgtgcctgtgtagaggcggagggtaatgggaattctctgaactttgcactcaatttttctgtgaatctaaaactgttctaaaaaataaaatctattaaaatctaacagcaatacaggcactccatggcgcccaccaacccagtctgcagaggccagggagcgggtaagcacagtaacgagctttccctgaggacgtggcttctgtgctgactgcagtgcgtggaagggcggctgccccatcacgaggtggcccctactcacctcccccatcagtaacatgagagatgaagagcctgccttgccagtctttttatttccaaaagaaattggaaaatcttaattttaaaataaaatcataactaatgatcgtaaatcattccaaatatttttcttacaaacttggcctaggcaatcacaatataggaccataaaacccatctgaggacccaactcagcccacaggccattggcatcagcctgtgctctaagcgagggcgtataatgttaaccaacatgggagtgagttggtagagggaagaccaacctccctgctcattcaggaacctccatcaaccagcatttgtgttactcttctctctggcacaagaaccacgctcatcaacaagaatgttcatcagactttgactgttgattcccccacaaaggttccctttgttctgccagcatgtgtggtaagctgtcctcctgagcttgctgctggaaggaacagggcagcccttttaaaggacacacatcacctctagccagctatgcatcttagatcacccagaatgacatcagggcttcttgctcaagattgtgcaactttctgataattttgagtctctggagcacgcttggaccctaggttggtccaaagtattattgcccctgagtttgaaagtaagaataacaaacgccttcaatgcacaaaagagagcacattgccagccagaagtgtttctaattctcgccctttccctgggtggaaaagcagccagagttgagcatactttacctttgttcaaggtcaaagaacctaatggatgcctgaaaccacgttccaccagccccaaggagcagagagataagctgcttacaatcggactctgatagcaagtggaacaggaaggtcacggaaaaggttcagatggttctgtgtcaggggagggaggcagagattatttctgaccttagggatcacagagggcaaatttgaagtagatgtttgctgaactgccccactttacagaggtggaggtacaagctggtccgagcacaccgagcatccacagaagaaggcaaacaccttctgggcccactgtgccatcattccacgctttatgcctagcagcccacttagttctcacagtcaccctatgatgtgatactgctattactgccatattatgaatgaggaaactgaggcatagggcagttagggaaggtgcccaggttcacacaactaccaacgtccagaggcgggatttgatccagcctgtttgggtccagagttcacgctttttaataactgggccatgcagcctcccttaagaatgagccagaaaatggatttcccttaaatacatcaaagatgtttcctaccggaggagatcatcctaggcttttgtgctgccccctccacctctgcccttcccttgttgggctccagtcctgacttggcccccactccatgccaccctgagtccttctgtgtccccagccacctgttccccttctccagcttccacttcagaccttcgtcagcctctgcagcctactgccccacgtccatgtctcaacacccacctgcaaactcagccaatgtgcagggactcctgttctcttcccacacatccagggcccctccctcctccaagaccacgcacagtccagtgcttcatgcgctctcccctagccccttcctctgctccccgattcttcagcctctctctccaaaagcttcttctcgtcatgctttaaacaatttcaagtctataccactaagaagaaggaagaagaggagggggaggaagagaaagaggaagagacaaagactgtgagagaaaaaggaggcagatgaggaggaagagggaaaatgagaaggaaaagaaggagaaatgtaaccactgcttgcactttgcacaccatatcttcagcttaatgtcctggaaaccgtgaggtaagtactgtcaatatcatctgcacatcacaggtgtgatcactgaggtcagtgtggtcaggtaacctacagcaggcacacagtgcacgggcagacggagcccaggctctgcaccaaccaaaggcggcttaccaagggcacctccttgcctctccccatgcacctccccaacaacccttaaaggaaaggagctcgggtgccaggaggcagcagcatccctgggctccttgggctgcgttgggcttctcagcgtccattctcagagaagactccactcctccaggcagagcctcccgggaccgatgctgtcactcacctggggggctgaaggaggcctcccatgtcatggaattgtcccgcgtatacagctccacagagcctctgccaccgctggagcagactttgaacccattggagatgacctgtcccccatacgcagaagggattggtctagactgttctccttgtgtcttccagaaaaaagaaaacgtgacccctgaggaaagtcacaagatcagttattcacagagagcaggggacttgacttctcgcaagcacatggttctctttgctttttatttttcattcgaaaagcattttgtccccattctaaaggcagtgtatgttcagttcagaaaatccagacagtgatatttgctcatgtttattaagggctcacacagtgccaggcacttttctaggagtttgaaatgaattctcgccttttaaaaagtacaaaaatcctgcttcatccccactatacagatgaaggaactgaggctcattcactcaaggtcaccagtgactgatgaagatcgctgcagccccaggcagttccccgcccccactccccgggatcatgcaaatgtgaagacctacaccctccaggtttctctcctattcctccagaaatgtggttagggcggctccttcctaagcctcttctataaatagattttacaaagacacgaaccatctcaggcacactggtttataaacaacatttctataaagtttactccaccgtgaacttcctccgatgtccataaatacactgtcacgttgtcacttttatgtctgcacagcggcgcattctaaacaagcaccacagtcttttttttaaacagcaatcccctgttgctggatcttaaggttttcttccactttttgaagaaattttcaaacagaacttgaagcaaattcttttgcatatctcagactatatgcctttaggatacattcccaagagggcatttcttgccaaagggaagcacacttttaaggttgttgatatcttcaattgttcatttcccgcagttggatacagagggggcagcagctgaaacctttttcaagactctagtctgcacattcgtggtaagtcctgaccccaggcccacgctgcgggggaggagggattgcacctggactaaatggtctgagcgacgcatgttagcatgaatgagctggctcattagttcatgttgcctccgccaccagcagcagataggacatacctcaaatgtgttgtggcagtatattacagtaaattatgacaattagatattgtacctttgtgggtgcaaagtcctactgtgatcaatgtaaacatggaaaaacaatgtaatttttatgatcctcatgtgggatttctccatgtttttactataagaggaactgcaggccgggcgcggtggctcacgcctgtaatcccagcactttgggaggccgaggcaagtggatcacctgaggtcaggagtttgagaccagcctggccagcatagtgaaatgccgtctctactaaaaatataaaaattggccgggtgtggtggcatgcacctgtagtcccagctactcaggaggctgaggcaggagaattgtttgaaccacggaggcagaggttgcagtgagccgagaccacgccattgcactccagcctgggcaacagagcaagactctgtctcaaaaaaaagagggtccaggcatggtggctcacgcctgtaatcccagcacttagggaggccgaggcgggtggatcatgaggtcaggagatcgagaccatctttactaacatggtgaaaccccgtctctactaaaaatacaaaaaattagccaggcgtggtggcaggtgcctgtcgtcccagctgctcaggaggctgaggcaggagaatggcgtgaacccgggaggcagagcttgcagtgagccgagattgtgccactgcactccagcctgggcgacagagcgagactccgtctcaaaaaaaaaaaaagaggaaccgcaaaagcccagctcctgagcatgccccgcacccaccccgaccgctgttctgcactcacacccactggtctgggggccgggctctctgctgaaggggaagtcagggcagggcctggctggaggctctgtggagcttgggcctctctggcgttgcattttggagctctggttgtctctattccacttctctgcctccagtagcatctgcccacctggcccttctttgtgtgtaaactccagtgtgtgtgtgtgtgtgtgtgtgtgtgtgtgtgtgtgtgtgtgtgagacactagctgcctgtctggattctgcccctgacagctggaaatacatccagctgcctcacccccgccaagcctggcccaggcacatgggtaagagggttcagtggtgctgagagagaacacgtgcccagaactggtccaaagaggcccatgatgggacggtgggtgcaggggagaggcagaaggatatttgccctgggctttatttctataaatggtgccaaatttagactttagaccttaccttcacatgaggttatggacacagtcttagagagtcactgaatt

SEQ ID NO: 714 - DNA, 219490 bp, Homo sapiens
  misc_feature (1)...(219490): n = A,T,C or G
agtcgatggaaccgtcgctcagggctctccttaactactcccctcctccctctcttccttcctggcggcctctccttccctccctccctccttcctctctcccttccttcctcctctccttccctccctccctccttcctctctcccttcctaccttccttccttccctcccctccttccttcctcccctccttcctctcttccttccttccctccgtccttccttctttccctccgtccatgcctactgtttctcaagcactggcccagggggctgcaggcctctgagtctctctgtgcttctctccctcttcccttctcccttcctctcccctccccctcctcttctaacagccgccccacccccactggtccagctcttcccctcccctctaccccatcccctcccctccacgccaccccctcccactgacaatggggaggaaccctgggctcagctccccacagtattgtccctttaaggaatccctaaatccggacacccctctcctcccccacctgagaaccaattagggttcccgaattcaagtagaggcttttgtgtgtcacgtgtttgtggaacaaagccctctccggcaggaataaaagcttctattcaggagccagtttgctctcattctaatcgtttccactccagcctcgcctccttcccgggttcccagggccgcccagctcggcctcaccttcccgcttcagcaccctgtattagtgccctacccaaaagcaggtggccaccgacccagggctctgcccaccttttcttcccgaaagatcacgtgatgccgactggctccgagctgggccctgggctcagcgctgtgtgagcatcattgtacgggactgtgaatagcctcaatgcaacggaggaaactgaggctcagagaggttagggcacttgcctgaggtcatacggctggtaagacagggagtctacaccctcgggcattattctatggtacccccagctggccctagcatagcacagggtgcagaagaagggagctgccatttttataaagcccatggggccaggcacctgctggatattagagactcctgacaatgccacgtgaaggagcaacgattgaggtcaaagtcactgacaagtccgaggcaggatggcgttgggactcagaacttggagggaaacagtggggccctcaggtctgaagatgaagagacagggagtatgggaagcccatattacgaagccattaagaaaactgtattgatatggaatggtaattgacacattgccaagagaaaaaggcagtacattgaatggaatatgatctcatttgcataagaggaaaaggaaatatctacacacaaacatgtatacacatatcgcacatttctatctgtatggaataaatttggggaaaaaacatcataaattgtagtatcctttatttcctttgaagagtggaaatagagcatggagagaagtcacttagtaccattctgtgctgtttgaaaaaagatattttcttactatgatcatgtatttattttatgataattatttttgttttattgaagttaactattttaaagcttgcatttcagttgcatttagtatatttacaacgttttcatcaccctaaaggcaaacttctaacatcatatccagtaagcaattacttctccttccttattccccccgcccctggcaatcactaacctgctttctgtctctacagatttacctattttagatatttcatagaaatggaattatagcatttcatagaaatggaatcagtatgtgacctttttcatctggcttttttcttttccttctttttttttttttttttagatgagctctcactctgtcacccaggttggagtgcagtggcgcgatctcagctcactgcaacctccacctcccgggctcaagcgatcctcctgcctcagcctcccaagtagctgagaccacaggtgtccgccaccacacccaactaatttttttgtatttttgatagagatagggtttctccatgttgtccaggctgatctcaaactactggattcaagcgatctatctggcttggcctcccaaagtgctgggattaaggccggcaaaatgcacccctgagctcagcctggtttttttcatttaggatgatgtccctcaggtttatccatgttgtagcatgtgtcctatttcattccttttaacggctaaatagtattcccttgcatgggtatactacatcttgtttacccattcatcacttgatggacatttgggttgtttcaatcttttggcagtcgtgaatggtgctgctatgatcatgcatgtttttgtctgaatacctgtttttaattattttgggtatatgcctaggatctgggtcatatgataattctgttttactttttgagataccatcgaacggttttccacagtgccacaccattttacgctcacaccagcaacgtacagaaagctccaatttctccacattcttgccaacacttgtcattttccatttatttatttattcatagctgtggtagtaggtgtggaatgatatctcattgtggctttgccttgcatttcactaatggctcaagatgaatatcttttcacgagcttattggctatttatgtattttctttgaagaaatatctattcaagtcctttgcctatttgtacttatttattaatttattttttgagaaagagtcgcactttattgcccaggctggagtatagtggcttgatcacagctcactgtagcctcgacctccctgggctcaagtcctcctgcctcagcctcccaagtagctgggactacaggcacacgccaccatgcctggctaatttttgtatttttttttttttttgtagagatagggtttcaccatgttggccaggctgttctcaaactcctgacctcaagtgatccgcccacctcagcctcccaaagtgctgagattacaggtgttacaggtgtcagccactgcacccagcccttttcacttttttttttttttttttgagacagtctcgctctgttgcccagactggagtgcagtggcacaatcttagctcacagcaacctccacttcccaggttccagcgattctcccacctcagcctcccgagtagctgggactacaggcgcccaccaccactctaagctaattttttgtatttttagtagagatggggttttaccatgttggccaggctggtctcgaactcctgacctcaagtgattcgcctgccttggcgtcccaaaatgttgggattataggcgtgagccaccacacctggcctcactttcttgatagtgccttttgatgcccaagtttttatttttatttatctattcatttatttattttgagacagggtctcgctctgtcacccatgctggagtgcagtggcacaatcatagctcactacagcctcgaactcctgagttcaagccatcctccagccttagccttccaagtacctaggactccaggctcgtgccaccacccagctaaattttgttattttatgtagagacgaggtcttactatgttgcccaggctggtctcaaactcctgagtttaagcaaccctcctgcttagcctcacaaaatgctgggattacaggcatgagccactgcacccagccaaaagttttaaatttaaatgaagtccaatatatctattgttttcttgtgttgtttgtgcatttggtgacataactaagaattgccaaatttaaggtcataaagatttacccctgtgtttcttttatccattttgagttcattttgtttttacatggtgccaggtccaactttattctttcacatgtaaatatcctataataattgtttttaatctttgtctttgctgtcttaacaaatgatctccaaatttttgtgatgatacatccctaagaggaaacaatctttgagctcatatttctagcatacatacatttatatatttacaaaatatatacatactctactgttataatatctatgttacaaacatctatgcaaaagaaattttaaaaagatgaaataggctgggcacagtgtctcatgcctgtaatcccagtactttgggaggctgaggtgggtggatcactggaggcgaggagttcaagcccagcctggccaatacggtgaagcccagtctctcctaaaaatacaaaaattaggccgggagcagtggcacgcacctgcaatccaagcactttgggatgctgaggcaggcgaatcacctgaggtcagggattcgagaccagcctggccaacatggcaaaaccccatctctactaaaaatacaaaaattagctgggcatggtggcgtgtgcctgtaatcccagctacttgggaggctggggcaggagaatctcttgaacccaggaggcagaggttgcagtgagccgagattgcaccactgccctccaacctgggccacagagtgagactccatctcaaaaaaaaaaaaaaaaaaaaagctgggcgtggtggcacatgcatataatcccagatactcagtaggctgaggcaaaagaatcacttgagcctgggaaaaagagattgcattgcagtgagctaagattgggccactgcactctagcctaggcgacaaagtgagattctgtctaaataaataaataaaataagaaattagccagatatagtggcacgcacctgttgtcctagctactcaggaggctaaagtgggaggaaggcttgaacccaggagttcaaggcttcggtgagttatgattacatcactgctgcactccagcctgggcaacagaggcacaccctgtcttaaaaaaaaaaaaaaaaaaagagcggggaaaagagatgaaatagaaaaaaatactatagaaggcctgatcttttcttggtggatgattttgagtgctcccagagacactcacccctctggtgcttgctggtgctgctgatgacagagtgaggtcagcccaccctctaaaggcacagctgggacagctgcaggcaggcatgggagtgggctctccaggttgggtctgacttccctcttctgagtcacaaaatttcacatcagaaggacgggtgtttgaatcctggttccatctatttcctagttgtgtgtcactatattaagctgtatttggccacgtgtggtggctcacacctataattgcagcactttgggaggctgaggcaggtggatcacctgaggttagtagttcgagaccagcctggccaacatgatgaaatcccgtctgtactaaaaatacaaaaattagccagatgtgctagcaggggcctacaatcccagatacttgggaggctgagacaggagaatcgcttgaacctggaaggtggaggttgcagtgagccaagatcacaccactgcactccagcctaggcaacaaagtgagacaccgtctcaaaataaaagccatatagctatattaaaaagcaaagtcttaacagccttttttttttttttagacagggtattcttctggtatccaggctggaatgcagtggcacgatcatagctcaccgcaccctcgatctcccgggcccaagcgatcctcccacctcaggtttccgggtagctgggcctacaggcaagtgccaccatgcctggctaatttttaaatttttgtagagacagagtctccctttgttgctcaggctggtctcgaactcctggccttaagcaatcctcccacctcggccttccagagtgttgggtttataggtgtgagccttacacttagccttttttttttttttttttttgagacggagtttcactcttgtccctcaggctggagtgcaatggtgcaatctctgctcactgcaacctctgcctcccaggttcaagcaatcctcctgcttcagcctcctgaacagctgagattacaagcatccgcccccatgccaggctaatttttttttttcccatgacagaatcttgctctgtcgcccagaactggagtacaatggctcgatcttggctcactgcaacctccacctcccaggttcaagcaattctcctgactcagcctcccgagtagctgggattacaggcgcatgccacctcgcccggctaatttttgtatttttagtagagacaggatttcaccatattggccaggctggtctcgaactcctgacctcgtgatctgcccgcctcagcctcccaaagtgttgggattacaggcgtgagccaccacgcccagctggttattatttcttaaggcttaaaggggccgatgtgtcttccccacaatttacctatttgttcattcagccaagatgtaaagaatgcctgctatgtgccagccataatggggaacaagaagaaagcagtccttattatttatttatttatttatttatttatttatttatttatttatttatttttagaggtgagagtcttgttatgttgcctaggtgtttgtaacggtgcctggctaacagtcctttcttttgagaagcatatgacctcgggatacacagacattacaatatacacacacaaatacacattgtctgtatttatgcagtggagcaatcataactcactacagcctctaccttctggactcaagggatcctcccacttcagcctcccaagtggctgggagccaccatactcaaggcatgagccaccatactctgctaatcttttatttttagtagaggtggggttctcagtcttttgcttaggctgctctgtcttgaactcctgacctcaagtggtcctcctatcttgggctcctgtctagctaggattacagggacatgcacaccactctcagctaattttatctctgcatttctgatgaatgagttttgttttttttttttttttttttttttttttagatggtatttcactctgtcgcccaggctggagtgcggtggtgcaatctcagctcactgcaacctctgcctcccagtttcaactgattcttgtggctcagcctcccgagcagctgagcagctgggattacaggcatgtgccaccatgcccagtaattttgtatttctagtagagatgaggttagccaggctggtctcgaactcctgacctcaggtgatccgcccaccttggcctcccgaagtgctgagattgcaggcgtgagccacctagcctggccaaatgagttttttaatttaattttttttctgcccccgaaaccaccctgaatgagttctattctgcatcagttaaccaataatttaatgttgactcaacatcatggtggacactagaggcaatagttgggccggtggtaaatacacagttcagccaacacaagtacccactggctctcctttgaggagtgcccacttctctgtttctgcttttccgacccagcttagatgccagccttccctttcctctccaacccactgtactccctccctcccttgagcttccaaagctctcttaaggctctcatactttgctttgggatataatttgtccctttactggagcgtaaatgcctcaagaactgtcagcaagccttattcaggtgtggatacctccagagtacctgacacggtggaaaaggcacatttgattcattcactgagaagagaagaggcaaagatgtagccgctgagtactagctgtgtgaccttgggaaaaataattctttctttggatctctaagtttatccataaagcaagaggggggcatcagaggctctccaaggcagcctttctcaacctttttaaaattgggacactcctgatgaatggcattcccacgtgactcatgcttccatggtgttcagataagatagtctgaattctgcgtaaccccagctcttcctctctccctctggagagcttgtccaaaggccagggagcaagagtgacgttatttatagacataaccttgactccacttctcctcatttgtttatttctttttcttcttcatttatttatttaaggcaaagaaagcattctcaagcttcagtagaggtagtggttaaaaataccagaccagaaaccagagacacttgcctttgaatcccctctttgccatttctgagtgtagtatccttgggtaagtttgctgagcctcagtttccccatctacaacatgggaggatcatcatagaactaactttagaagactgtagaggggattaaatgcgatcagacaggaaagctcttagcaccatgctgtacatggtaagggctcagtaaagttgtcaatatctactttgttgttattagttacatgttacatgtgacacactaaaaaattgggatatgatgctgagaccaaaaagtaaactcttgattagcttctgccaaatttgatcttttgtgattttctcacccagtcttggggacgctgagccgtggtgaatttctctgctggtggaaatagattcacggatgtagctcaatcctttcttattttgttttattttatttttgagatacagtctcactctgttgcccaggctggagtgcagtggcgcgatctcggctcactgcaagctccgcctcccgggttcacgccattctcctgcctcagccttctgagtagctggaactacaagcgcccgccaccatgctaattttttgtatttttagtagagacggggtttcactgtgttagccaggatggtctcgatctcctgagctagtgatccacctgcctcggcctcccaaagtgctgggattacaggtgtgagccaccgcacccggccagatgtagctcaatccttctttacctttgttactctatctccactcgctcatcctattccccttttaattttttctgttttttttttttgtaaagtatcactctcactctcacttctttttttcttttttgacagggtcttgttctgtcacccaggctggaatgcagtggcacaatcatggttcactgtttcctcaaactcccgggctaaagagatcctcctgccttagcctctcaagtagctgggactacaggctcataccaacatatctggctaattttcttatatttttgtagaggtggggttttgttatgttgcccaggctggtcttgaactcctggcctcaagtgatcctcccaccttggcctcacaaagtgctgggattagaggtgtcagccactatgctcggcttggatgaatttcaaaaattgtaggttgaggccgggcacagtgactcatgcctgtaatcctagcactttaggaggtggtggagggcagatcacttgagcctaggagtttgagaccagcctggacaacatggcaaaaccccatctctatgaaaaatacaaaaattagccggggatggtggtgcatgcctgtagtcccagctactcaagaggctgaggcaggaggatcgcttgaacttgcttgaggtcaaggctgctgtgagccgagatcatgccactgcactccagcctgtgtgacaaagtgagaccttgtttcaaaacaacaacaacaacaacaacaaactgtatgagcaaaagaagccagatgcaaaaaaatacatacaaaaattccatttatatgaaattatggaacaggcaaaactaatctatgggaagacaggtcatagtcgcgtttatctttgggaagcagatattgacttggaagcaggagataactttctggaggaaggaaagcttcaatatcagtgctgcccaatagaaataaaatgccagctacactcacgcctgtaatcccagcactttgggaggccaaggcaggcggatcacgaggtcaggagattgagaccatcctgactaacactgtgaaaccccatctctactaaaaatgcaaaaaattggccgggcgtggtggcgggcgcctgtggtcccagctacttgggaggctgaggcaggagaatggcatgaacccaggaggcggagcttgcagtgagacaagatcgtgccactgcactccagcttgggcaacagagcaagactccgtctcaaaaaaaaaaaaaaagccagctacagctgtaaaccatatatgtaatttaaaaattttctaggaaccacattaaaaagacataaaggccgggcgcggtggctcactcctgtaatcccagcactttgggaggccgaggcaagtggatcacctgaggtcaggagttggagaccagcctggccaacagggtgaaaccatgtctctactaaaaatacaaaaattagctgggtgtggtggtgggtgcttgtaatcgcagctactcgggaggctgaggcagaagaatcatttgaacgaaggaggtggaggttgcaatgagccaagattgcgccactgcactccagcctgggtgaaagagtaagactccatctcaaaaaaaataaataaaaataaataaataaatagaaattaaaagacataaaatgaaacaggtgaaattattttaataatatattcaaaaattacgtttcaacatgtaatcaatgtaaaattattatcactgtattttacattcattttctgcattctttgatatccaatgtatattttgcacttacagcactggttagtttgggccagctgcatctcaagtgctcagtagccacacgtggtgagtggtcacttttatggatctgtatcttaatctgggttttagctatatataaaaatttatatataaaacttgcggaggaactccagcctgaggtgacagagcaagactttgtttcaaaaaaaaaagaaagaaagaaattcatttgtattgttatatgtatctgtcatttgtgtgtttttttttttttttttgagatggagttttgttctgttgcccaggctggagtgcagtggcacgatctcgatcttggcttactccaatctctgcttcctggattcaggcaattctcctgcctcagcctccccagtagctgggaccacaggctcacaccaccacacctggctaatttttgtatttttagtagagacagtctcacgatgttggccaggctggtcttgaactcctggcctcaagcaatctgaccacctcagcctcccaaagtgctgggattacaagcgtgagccaccaagcatggtctttttttctttttcttttttttttttctttttttttgagatggaatctctgtcacccaggctggagtgcagttgcgtgatcttggagtgatcttggcacactgcaacctccacctcccgggttcaagtgattctcctgtctcagcctcccaagtagctgggattacaggcctgtgccactacacccagctaatttttgtatttttagtaaagatggggtttcaccatgttggcaaggctggtcctgaactcctggcctcaagtgatccacccgccttggcctcccaaagtgttgggcgcccggcccttttcattttacatagtattccattgtacgaatatatcatagtttatccattctcctgttgatggacgtttggattacttccaatttctgcttattatgaataatgctgctatcagtgttcttgaacagtctttaaatagactcatttaaattatttttactgttttctggttgttaagataaatccatactcacagaaaaaattcatactcatactaacacacacgcctccccaccacgttaaacagtttttactgttttctggttgttaagataaatctatactcacagaaaaaattcatactcatactaacacacacgcctccccaccacattaatggtttgatgcaaatggcttatggtttgatgtaaattcttttcctccacatatagaatcatgtattatcattattaataaaattgtcactttgatggttcctcccttggttgtctgactcctgggggtgctgcgtagctcttaatccttgcccttcttgttgtaaggtctctagaagaccaaaactggaaaggatgtagtgatcatctagtccagagaaggcaacgctatagcacaccttctactgttccatgactacctgcaccaaggcagacatcactaatcaatcacccgatttctatccttgcccagccctagccactaccagtcattttggaggtaatttgagaggccaagtagaaaaactgaaaccaattttccatctctggaataatatgccactttccattttgcacatgaataaactagcgctcagagaggggaagagcctgtttcaaggtcagaggtggagccccaggctcctaactccctaatactttttccactaagttcacaaactccaaaaactatttccctggtccctgaaaacctgggctctagggagggtgctttgttctccagatggggctcagagatgagaacctcccctctagccagcccttcacctttaggtctggcctaagtgtaagagaagcccctgcctgcagcctggcacccctttcccaccgtcagcactgacagacctgcggtttcacttctccaggtccacagtttcagtttcccaaaataaacattaaaaacaataaaacataaaggaggcatcctcttaacatctttgtctttggcccctgaattgtagaatgattagttgagcagattaaatcacagagttaattacagcagagaggtgacttcagatgctgaaaccatagaactctgaagcatcccccctttcactgacacatcaaaccagccctggctgtcattggaagcgacagtgagaaagtgagaaagtgggagagtcagcaggtctggacagactgtgggtgttctcagctgggcaagcagaatagtttatttaattccctccctgccagggcagtggggaaagtcggggggtggggaatggagacagagtgtagcataatgtttgggtcaggtagagctagatttttagactggccagctgcatgaccttgggcatgtcacttcagatgtttgagtttcagcttcgtcatctgtaaggcaagcacattaatagaacctactacatttaattattgcagtgattcaaatgacttggttaaaaagatgtgtatcagccaggcgtggtggtgcatgcatgtaatcccagcactctgggaggctgaggcgggaatatcgcttgagctcaggagttcaagaccagcctaggcaaaaaagatgtatgtaaaactactgtgtctccagattgtcacatctgtgaaagtaggaatcactgtctgtctcattcaccatctcatcctccagccctagcacagtgatggtttctaggcaagcacaactagtgaggccgggcatggtgactcatgcctgtaatcccagcacctggggaggctgaggcaggcagatcacttgagctcaggaattcgagaccagcctgggcaacatagcaaaactctgtctctataaaaaatacaaaaactagctgagtgtggtggcttgagcctgtagtcgcagctatttggggggctgaggtgggaggatcctttgagcccaggaggcagaggttgcagtgagccgagatcatgccactgcattccagcctgagtgacagagtgagaccctgtctcaaaaacaaacaaacaaacaaacaaaaaccaactattgagtacttagtgtaaggtatggtcctgaggataaggggtggtggaggagaatgcaaagaggtttaagggactttcccttagagagctcccattccagcataacagacattccagaaccatctgtaataataggtgcattgtgtgtgcattaaataggtagataacataaaattatgttcatgatgaagtgcatgatgggaattctggtatcagacttgaattcaaatctcagccccctcacttaccacccgtcttatctttattagcaagttgacctctcaatgctttcatttcctgatctgtaaaatagcgacctgcctcagagagctgttgcaaggattgaatgagtttcccaacgcaaagtgcctgagacacaataattgctcagagtctgactctgttgcccaggcgggagtgcagtggcaggatctcggctcgctgcagcctctgcctcctgggttcaagtgattctcccacctcagcctccccagtagctgggattacaggcatgtgccaccacgcctggtcaatttttgtatttttcgtagagacggggttttgccatgttggccaggctggtctcaaactcctaacctcaagtgatctgtccacctcagcctcccaaaatgctaggattacaggcgtgagtcagcacatccggcacccccatagtgcttttgatggactacctttactttcccatagtgctttagagtgtctaaggtgctttcaaatacatgatctcacttaagtcttgcagcaactccgaaagtaaatggaagctcagaaggctaagtggtgtatccctagaaccacccgaccagaaacagtggtagtcccaagaccagcatatggatctttggactctcagtcaagtgctttcattactccagctcatagccttctggttgagtccagaaatctgagagaaggaaaaaaaaagagagaaaaattaggaaaaaaaagtgagggactgaagacctatgtccacacaaaaacctgagctttaatcataattgccagaacttgaaggcaaccaagatgtctttcaggaggtgaagggatgcataaaccgtggtacatctagagcacagactattatgcagcactaaaaacagacaagctatcaagctatggaaagacatagacggggtcaggcgaggtggctcacacctgtaatcccagcactttgagaggctgaggcaggtggatcacttgaagctaggagttccagaccagcctgggcaacatggtgcaaccctgtctctacaaaaaatacaaaaattagccaggggcggtggtgtgtgcctgtagtcccagctattctgtagtcccagctgttggggaggctgaggtgggaggattgcttgagcctgagaggttgaggctgcagtgagcctgaacatgccactgcactctagcctgggcgacagagtgaaaccttgtctcaaacaaacaaacaaacaaacgaaacaaacgagcaaaaaaacccaggaaacaaaaaaataaaacccacacacaaaaaaagccaccatagaggaatcttaactgtgtgttactaagtgaaagaagccaatctgaaacagctactactgtatgattcaagctatacgacgttcttttttttttgagacgaagtcttgctctgttgcccaggctggagcgcaacggggcgatcttggctcactgcaagctctgcctcctgggttcacgccattctcctgcctcagcctcccgagtagctggaactaaaagcgcccgctaccatgcccagctaattttttgtatttttagtagagacggggtttcatcatgttagccaggatgggctcgatctcctgacctcgtgatccgcctgcctcggcctcccaaagtactgggattacaggcgtgagccaccgcgtccggcctatatgacattcttgaaaagagaaaactatggagagtgaaagatcaggggttgtcaggggttgggggaggggagaacaaataggtggagcacagagaatgtttaggacagtgaaactactctgtatgacagtataatgggagatacatgtccttatacatttgcccaaacccatagaatgtataaaaccaagagtgaactctaaactatggactctgggtgataacaatgtgtcagtataggttcaccaattgtaacaaatgtaccactctggtgggggatgttgacagtgggaaaggttacacacatgtggggtcaggcggtatggggaaatctctgtactttctcctcaataaaaataaagtctactttttaggctgggcatagtggcttatatttgtaatcccagcactttgggaggccgtggtggcagaggattgcttgagtgcaggagcttgagaccagcctgggcaacatagttagaccccgttctgcaaaacaaaacgaaacaaaaattagctgggcatggtggcgtgcatgtgtagtcccagctatttgggaggctgcattgggaagactgcttgagcccaggaggttgaggctacagtgaaccctcatcgtgccaccgcgctccagcctgggcaacagagtgagaccctgcctcaaaaaaagaaagaaaaaataaagtatatatatataggtatatatatatatttttttaagtgggggaagtttgtaaaatgggctgattataaatgcatggctcttaatcagcttacagtaaatttttccttgtcttgcacggacaagaaatgggaagttccaggtaattcagggctttgcttggatattgcattttcttttgttctttttttttctgagacggagtctcattctgtcacccaggctggagtgcagtggtgcaatcttagctcacttcaacctccgtctcctgagttcaagcaattctcctgcctcagtctccccagtagctgggattacaggcgtgcgccaccacgccaggctaatttttgtatttttagtagagaccgggtttcaccatgttggccaggtggtctcgaactcttgacctcgtgatctacccacctcagcctcccaaagtgctgggattacaggcgtgaatcactgcgcccggccaatattgcattttcaaagaatgagaacactgtgaaatactctgcacgctaaaaccacatggactataatttaatctttaattttgttgttgtcattctcaaaggctcttcaatatatcttaaagctgtgtttctccaagagtggccaaggaaaaccctcagctctcagccttctcatctgatagaggtgtctgttcaaaaactgccattttctgagcccccatccacccctagtccacttgacctacagttttagagtagtgaaagtcaaaatatgaacgttaattatcattgtacttaagagatgcagacattctgcttaaatgagagttctgtatcatagactcatttacctcatctccttcaagtctttgctaaaacgtctccctccccatgagaatgttgttgatttaaaattgcatctcaggccaggtgtggtggctcacgcctgtaatcccaacactttcaagggcagaggtgggcagatcacctgaggtcaggcgttcaagaccagcctggccaacgcggcgaaaccccatctctactaaaaatacaaaaaattagtcaggagtgatggtggatgcctgtaaccccagctactggggaggctgaggcaggagaatcacttgaatccaagaggcagagattgcagtgagccgagatcatgccactgcactgcagcctgggtgacagagcaagactccatctcaaaaatatatatatatataaaatttcatctcaccttcttcccaatagtacccaccctccctatcacccttccttctctgtggcacctacaacatctaactgaacacaccatttatttatctattgtttattcattcattcactcattcattcattgactcattcattcattcatttacttgtatgactctcatctctagaatgcaagctttacaaaggcagctgctgggactacaacacctaggacagtgtctagtacatagaagatgttcggtaaatacctgtgccaagttgcataatatcatttgcccactgtctttctcaagaggattttttaaaaactataaagcaaattcttcttttattctttgagtgatgttctgtgtgtgtagtaccagagaaaaagagctggaaccacatcctctaatctcttaattctgaagtctgggcctgttgctctaaagatcatttttccttaataccactgagatcctcaatttactatgaggatcatgagtttacaactgcattgtcctgtgagggctacctctagaagggcttgtcgcccctattgtgaacaaagtggactgaagctgctgcagctgagatacacctgcactgaaagaggatttgtctaagtctaacccatgttactgtgatacaaacaagctactgaccaaaagaggtagacgcttcctcctcagattctgaatgaatatgctaatacatggatcctatctcaagctacttcttacacagcattggctgactctgaacagatgcctttacccatttccttttttttttttaatccaaaatgtgtttattgagatggtttcccactcatcttgattcagagtgctttgggtgctgcttcctcctgaaggaacatccttctgtagccttccttttcctcctgtaggctggcagagaacagtggagcaggcaacacacaaaactaccgtttgtgcatggctacagaccatggtgattttatagcatcctgggcatgtcatatccatgaagtaggaatcgggactctgcaccaggcgtttcttcttctgtttcctcttctcttctggagaaggatgaaggagatccctgtcgagaggcatgttctcgtgggtaggtcgccactgccggaaaggacccatttcctatccttcaagctcatctgcccagcagcaccagcacacaaaccaaagtccaggaacactggaagatccctactccccgcacctctccaatgaccctttttaagttcagacctaagaagagtcacctccctaataccgcagaggctacctgctcaccctcatctgtgtctctgctacaacacaaactggaatgcttttgtgtcggaatggtaagaaatgccttgtgtgggtggccctccagtccccagtccaggggatgctgagaaactgtggggcagagtaggggacacaaacaggaaaaagcaagtttgtttctagtgttatgctcacagggtggcaggatatacctgctgagcattcccagaaggtccccaaggaaaccattactgtaagtctctcactttcttctctgtctggtggttggggtggggagagggaaggagggctatcaagagggggatgggcacccttccagaggtcagagttatgatgcccaggaataaaaggtgttgaattcaggatggaatgtgaaggtgaacagcaaagggcttgtcaacatgggttgtcactggattacaccggatggattaaggtagggatgggggaaggagtagaaggtgagttgggagggaggggcttgtgtggcactgagacccccagcagggatggggagaaggggtgttggccacctaagcttcctggtttgatccttttttggctggtttcagctggggaagtgaagggtcctaaggcttggatatggagaggtgggaatatggagaggtggggatatggagaggcggggataaggagaggtggggataaggagagtggccccgcagctcccctggtgaaccagaatactttctcagggttgttcccaggctggagggagggaattttaggggtacgtaaggtgactccaaggagccttgggtgcaagtactgggggatcccagagacccagaagatgggggtagaaaggaaggtgtttgccttcacggggagtagcctcaaaataagagggactgagggaagtcattccaaatgcagtgggtaggtagtttaggctcttccaatgggatggggtggagcttagacctctgcaaaagaagggggtcattcggaggggacggtgcacagctgaggcgttgggctcctaaactggaaacaggaggctctaagaggcactgccttttcctccagcctcggtgtggtgggggtggtgagtgtctggaaccgggtttcccgaatcaggacaggagtctgaatggatctcacaaaaaccggccagggagggagagaaccaggggagactcctcacaccgggaggtgggggtggcggcaaactgagaacccgggcttggggcgcgggattttctcaacagaccatagggtccactaatgtggacggcagggatttggggaaactaagggggactctcactttggacaccaagggctgaggacggattggggaagaggatacggtttctactggggtgctgatggaggttccccactcgggacgcgaggcactgagtgggtcccccaaactggatatgggatcctgggaacggagcgagggctctaaattagagccctggggtgggggtggggggctgtaaattaggttgggaggaaactgggggctctgagggcggcttctcgctccgactggggaaatggagcatgtggggactggggagcactagggctatctcccgcccgacccgaggagattggggttctcttcaattctggacagcagggacctgagagggaagaccgggggggttcccgatccggaaccgagctaccttgaaggcaccgggaagcgcttcattccgggagggcgttcccgcggccgggcccccgcgccggggtgggtggggggtgcggccgcgccctggtcccggcccgcaccgggattcgggggtctcgctcggccccggagacccaggagccccgcgggaggggggtcccggcgccgccgcctccgcgggcgcccgggctcgcgggcgagcgcggggctttatgcgcgcagggcggcggggggaggagccggcaggtcggcccccggcgggccctcccctcggccgtccccgcccgcccgcccgagcggggtcgggggagggggcagcatggcctgtccgtccggcccccttcgccgcgctcctcatctgccccgcgccgagcgccgccgccgccgccgccgccgccgctccgctgcccgcgccgcccgcggctcccgatggagactgacgcgccccagcccggcctcgcctccccggactcgccgcacgacccctggtacggcccggcccggcctgcttggcccgcgcccgccccggccccgccaacatggccgatccgggtccggccgggcctccccggagcccgggcccgcgccccctgcgccctggcgcccggcgctcacgcgggccctttgtgtctctcctcctcccgcagcaagatgttcatcgggggactcagttggcagactacgcagggtgagcgagcccgggagcgcccgccggtccggcagggcaccccggaccccccggcgccccggacccggacaccccagcccggccctgcgccctgctgaccccgggcgccctcgcgccctctttcgcgccccgcccggagaccccgagagcgcagggcgatccgcgagcgcacccggcccagcgggtggaggggagcagatgaggggttcagggggtatcggggggtgggctgggcccccgggacccgccggcggcagcgccaactccgctcgcacctgcggctcaaacttttgtgaggctgctcccggagcggcgggaacccggccggagccgtcccccttccagcccagctcggccctcggcttcccggggccccggtgggcgccaggaggctcagcgggaacggggcgagggcggtggggggcggcggcagtggagaacgcgcgggcagcttggcgcgggggcggccgggccgctccggggtcaccgggggcaaaggacgggggaggggggaagggcgcggggcccgggctggtccgaaggcgggtgtgtggttacagaagggctgcgcgaatacttcggccagttcggggaggtgaaggagtgtctggtgatgcgggaccccctgaccaagagatccaggtgagcccctcaccccctcctcctgctcccggctcgcccccctccacccgccactcactgccttgtaaccatctgcctctccctcactacggcgcgcaggggtttcggcttcgtcactttcatggaccaggcgggggtggataaagtgctggcgcaatcgcggcacgagctcgactccaaaacagtgagtggccctcggggcttcgggggtcctttgggagagggaggctgccggaggagagggtcaggactctccccaggggacagctggacggggtccatgaggaaggagggagtttttctgagtaagagggctgccatgctctgaaactttgtcactagagttgggggggagagggaggagaaaaatccctggcctgccatgagatgctacatcccccctcccctagtcctggtgaggggagaggcagccgccaccctctccctagaagtactaatcatgatgcctcagagcagagcttggggtggggctaggtccctcccccagcccaaattgggtgagtcagggtagcactgacccacccggtggcttctgtgaactctaactagtatttggctctgcgacaccccctcttcatccagaccaatggcaaagcatcccttgaagccccctccctctctccttccctcctcccccgacttttggtcaatgagctccttgctttgtgtggaagacagggacctgctttgcccacggaggggatttatgagaaaggctctagcttgcctggaaacgacccttcggaagactagatcttaggagaagctgcttggttggcattcaaactcatggaacattttgctgttgtcccacagctccttcgtgtcttagaccctgcagggggcgctggctccagggcagatggaaaagtagaaaagtcagaggagggggttactcccatgtgatgggggtgtctgtctgctgggggcagggatagtgtggatctcttctctccatgcttccctgctgtcccccagccttgggcctctctgcttgggtcagtccctggctcccgtttacctgcaacaatagctgcttgtgcccaagaatttgtcaaattaccgcctgtccccagctcctgttatctctgcccagtggctcccgctcccgctcgcagtaatgagcaaatgaggccaggcctcaactttgccggctctgaaaggatcttcttggcgcagcctgagtgacccaagcctggaaatggagagacagtggcctattgtttttggtgattatctgccatcaagctgcctgttctgctaccatcccctgtcctcagaatgcactgatggcttctgcagtgctgaggaagctgagatttaggggctgggggatggaggagtggaagattgataaaggggaagagaatgagggaggaaggagggtgagatgagcatccttaggagatggggctgaaaagggccagggctttgtctgtgtttggcgtcctccagcctgggaaagggggtgggagggaggtttactgtggggagtctattttgagctctgactttcaccttttatttacttgttgggttttatttatgttgccagctgtgagtcacagtggaggtggggtgtgtcagggatggggtgtgcgtgggtctgtgggatcgtggcttgggtaccatctccccatcggggtctgtgtagggggactgtgtgtggtgcgctggtggctggggcggctgcttctgggagaaagagaaggatggacatgtccgtggaggtgtggaattgaaacttcaggcgggagaaatgggcagttgtgatttttccctggagcccagtgggacttggcaggagaggaggcattgccccagtgtggattttggaggttccatctctgtggacagattccagtgggggagcctgtaggaggctagttcctggtctgtgccattcagagagaagccagagccagctgcctagaacgaggctgagttttgaacagaaggaactttgggaaaagatagatcttccctgcgattggctggtgaacttatgaatgacgtccacccatgtgggtggcaaaaagctctggcctgacctggccctgtaggccctgcatggatcacagcgtctcatgccctgtcttttgctgtttgtcgtacagctatagtacccaggagtacacccagatgcatcttgatttttccctctggttgttcacagccaagggcaaaggtggcctgctggtaatagcacctttgtttgtgcaatgaagggcagttcacaaagggccgctttcacccgcgttatctcatctgattccccgcagctgcccctgggaaaagcgggtgtgattgtccccactttgcagatgaaggaactgaggctcacagagttcgagtgcattaccaagatcacaggcttggcaagaggcccagagtttctaggtcaagtcccatgccctttcacgtcaccgaagactgcactctgccttgccccaagcctagctgcattatcaaggagctgtttgctcacagcctcaaggagagctatttgatgttgatagtactgcgaaaacagaactgagcctactcctgatggttatgaactctcagcttgtagccttttgcagacaaagagtattcccatttgcagggtttccaaagcctgaattgcataccttacctagataggtcatctgtgtgaagtcagttacgcaaggaaggccctcgatttacctgatacttgaaggaataagacggcttacattttttttgtttttgtttttgctgtgagctagacaccatgccaaatgctttgtatgcattatctccaataatctgctgatgaccctttgaggtgggtgttattatttgcccattttgcaggtgaacttgaccctgacgttcaaagaggggaaataacttgtccatggtctcacagctgggaagcagtgcaaatgggatttgaacccagcagtgggacgttagggtctaaatgcttaactggctgggcgtggtgactcgtgcctgtaatcccgggactttggaaggctgaggcgggcggctcacctgaggtcaggagtttgaaaccagtctggccaacatggtgaaaccccgtctctactaaaaatacaaaaattagctgggtgtggtggtgcgcacctgtaatcccagctactagggaggctgaggcaggagaatcacttgaacccgagaggcagaggttgcagtgagctgagatcgtgccactgcactccagcctgggtgatagagtgagactctgtctgaagaaaaaataaaaataaatgcttaaccactattctctcctcctagaggcttttgtgatttctgtcacctttgtgtcctgggaggagagaggtcctgagggctgaaggctgtgtggtcgctcttctaaaaatgcgataaccaagaccccttctacctctcccttttcttgtagattgaccctaaggtggccttccctcggcgagcacagcccaaggtaggtgtgtctatgtctgggaggagctctcttactatgggcaatgctgggcagtgattttcccagtatttcctgctctggaagatgcttctggaacctctgcttggagtgtttgtggaatgggctgggctgggaagaggggattcttgacgtccttgctctgtggcctgaagacactatatgtctttccacgtgagctctggggtggactggagaggggcttgtgtgtgttgggagaaaggggagctactcagaggattcatcgtcctgtatttgaacccagtagagtttggagcctgagtctaattccaacatcatagaccacagccttgatgtccaggcctctggaagtgaaatacaggacagacttagaccctaaggccgcgctacaggcaggctagggagctacccttggatccccccagtcaccctttgcagaggcagaggggaccacagactctgtcacctgttgtctttcagtttagatgtctgtggctgctttctcaatgctctcttaccctgctgctctggcgagttctcccagtgagagggtcaaggtgcgcagaaaatggatttctgagcagttgagtgatacaacactcaaaaaacttttggtgcagggcaggggcctaagagtctattctaggcctcagggcaactggccaggtcttccttttgaagcaattgaatatagaggacagaaggagagactgattgcggaacatggggtcaggacccctgagtttactgacttatcatgggtcctaggacgaggtccctctctaggagagttcggtttcctcctttgccaggtggaactagagctctttaagattccgggccagtgaattccatcaagtcccccaactcctgccagggctgaaggagaggaagagttttgggagacaggaaaggggcatctctggaagggtccagtagagggcctgaaagcaattatggagcaggtattcgaaggaagccgcaccagggagcacatggttggaactgggttaattccattaagcagtttggtgacagaaggtgctttagtgttaggatggggctgggaattgccgcggattagccatgcgctcctggggtaattaggaccatgtgttcttcctaaaacagggctggggccacagggctgccagaggttgtgttgggaggaggctgatgaggaaaatgtcggcactgagttcagggagactctgtgatggaccttggggggtctcccaggagggccagtgaggtcttagtgttaggctgtgggtctgggtcactggcccgcccccttccctgtgttagtccttagggaaggcattttctggacatagtccctagggagggaggcaggaaggaggcacactcgagccagccagggtgtgggtgcacagctgcccatgacaggcctagaggcgggggtccaagagggagcttgcgggggggggcctttaaagaggctggggccacagagagcttgtcagctggcatcctggcaggggggctcgagcccctgctggtggcggtaggccacaggactcagatgcccactttctcattccctcccctaacagatggtgactcgaacgaagaagatctttgtgggggggctgtcggtgaacaccacggtggaggacgtgaagcaatattttgagcagtttgggaaggtgggtttaaactgggggcgctcgctgctggggctgtgaacacactgtagaatggggcactagcaagccgaatccagccaggtcattccattcctgcaaaagatgagagtggggctggatcctgctgtgggggcagaccaggccaatccaccttgcagcctcctggctcatctgtgagcttcagactcaggatatccctcgggacagagaagccacacagtagctggccctgttgttgcccttccactgtatttttctcttacttatcttcattctcacaagggaggcagtgctcccacagccagttcaatcaagtcagcccgtggcctcctgggagtttgcacctgtccaggccacaggctattgaacctttccccactccttccaggcgaggatgataaggaggcaataaatatgactcccaattgcactcggcaccctatttgcacaggtggggagcttggagccagagctggggggctgctggtcccctgggtattggggggaactgatgagagcaccccccaattcctgatcaggcccagaggattggctgtgagctgtaaggggcatggagctttaatttctgggcctctgaagaggtagatgttgtggcgacatccgacattagggtgtcctctgaaaggtggacaatgtgaactttggagtcccatggggagatggcagagagggtcctacgtttgaagtctaggagggaaagagggttgttttgcttggggccggggtccctggtctttcttcttttaggtgagacaggcgagaggctgggtctctactttcccatcaagacacttcgagtcacccccaggcaagcgaagggggacgtggcctgggaaatgggcctgggattgtgtgggggggggaggtgtcccctggccagctgaggctggtggtgtgggggaccagaggcctcggctttcgtgcctcggtgggcacctgggtccgggacagagggcaggtcgggcgggcccgggccccagagggtagggcgctcctgggaagcagcaggcccggctcggctgcggcggggtgtctttgtgtctgagcgccgagcattagagctcgcactaatctgatccagcagctgtgattggaggccgcctgcccccggggccggcgttgccatggcaaccgggccccaggagaagccgtcagcggccgcgtcttttgttcgggcctaaatcggcgttggcatgtgaaaccggcccggggaggccagggggagccggagaataggctgccagggagcgagggggacagccgggaatgccaagggccccgcggcggggggccccccgcccggatcgaggggccgccgccgaggggggaacaatggtcagccgccatggctgccactcaggcttagcggccgccgaacttggcggctcggctcctactggtcagcaggcctcggccgcctcccctccccccgcccgatcccccctgccctcgggttcccatggagaccaaagcctattaaggacactgggccgggagcctccctcccctcagctcgccccaggaggggacaccggtgggggtaacccggacccccagccatcttccttgccccctgccctggcctcaaccccaccgtcccactaggggcctctccagccaaggcccaggttgaagggtgtagtggggccagggatggtggccttccttgcagggttgggtggaggaaggtgggagaagttgtggatttgggctgaatccatttgtgggtcaggcagggactcagagctgtaggattaggggggagggtgtggctggttcgttcattcattcattcattcattcaaaaaatgattgacctccagtcaaggtgctcaataggatggtggtcatggccctaaatgacacagacgatgtcctcatgcaaccttcaagccattagtatctggctgctctctccccagctttgccacgttccccccgtgtaactatgggcaagtccctcccttgtaaagataataataatagctattatttattaggcacttactatatcctgggtctgtgagttaagagtgttacatgcactatctcactaaatcctctcatagccaggcttggtggtgcacacctgtagtcccagctaccaaggagggtgagatgggaggattgcttgagcctgggagttcaagactagcctgggcaatatagcgagaacccttttccaaaaaaaaaaaaggtgtctttcatttaacttcaacctgtgagatagacactgttatgcctatttcacagatgaggaaccaaagccagagaaacatcaagtcacctgcccaaggttacccaaccagcaaatgcaggatccaggattccagctcaggcccgtcctacccaaagcctgtgctttgaccacaatccttctttctgggtttctgtttttcattggttaagtgaggggtgggcaagatgtgctgaacctgaaatgattgtcccattcgggtggtccagctgatttgggattgggactcagagtgggtccataggatgggagtgagagtgccactctgttgcgtgggccccagtacaggcagctctttgagaagagagatgtcatgagattctccagggaccttgttgcctcctggctcagtggggtcctggttctcccagtgggagtcagaggcccactgtagcttgatgcctaaggagagctggaggatcacggtagttcagggtgtttaatgaggcaggggagggcctttagaaggtagatgatggggtcgggcctggtggctcacgcctgtaatcccagcactttgggaggctgaggcgggtggatcacttgaggccaggagttcgagaccagcctggccaacatggtgaaaccccatctctactaaaatacaaaaattagccaggagtggtggcatgcacctgtaatcccagctactcaggaggctgaggcaggagaattccttaaacctgggaggcgggggctgcagttagccgagatcatgccacagaactccagcctgggtgacagagtaagactctgtctccaaaaaaaaagaaggtggtggatgctgggcctggaagtagagggaaggagagtagggaagaggctggttacccatggcttgatggcttgagaaaagtttttttttaatcctttggatgtctggtcatttgggggagggttggggcctggagtaggattgggttgggtatcagaggcagcccctgatttataccaaaggtgactcagaccttaactaagaaagagggcaaggaggaggcaccagatgcaggcaaatggaaggtggcaccaaggcctttggtgaccgtatatccaaggggtacctagaggaagtaacaagagtagactggggtccaagagaggatggatgatgtagatcctccccctttcccagtctccttcccttcccccagtcagtgggaggcaaagcagcccaggcactgaactctacttgctttaattacagcctctagcaaaaggaaacctcaattagaggaaaagatctgtagccggagaggggagtccagtctggttgctgtcctcctggccttttacagaaagggatgaggcttttgcttccccatcttgtcattttcctccctcccatatttccttctctagcatcttctctgtgcctccccagtttggtcaaggtcttgctgtgtgatcttgggcaggcaacttcacctctctgagcctattttcttatctacaccatggggatcttaccatgcagggaatgttgggaggacaatggagcttaataaatgcaggctggtgcattgagatgatggtgattgaaaagggttttcagtggggttgcagaaggaaagttgtcccctgtgcagggagcaggttgaaggtcaagcctggagtgggcaagagggcagtgggttgccagagcccctgttccttggtggtagtgggttccgctggtatctgctgggtcctccatggcgggctgtgtttcaggtggacgacgccatgctgatgtttgacaaaaccaccaaccggcaccgaggtgagtgtggccccctcccccttcccaggctgggccccgtggtcagccagggggctgcaggtcacagctgccctttcatctcgccttctgacatcctatccccctggatctgcgtcctctcccaggcctggccttacagaaggcttttgtcccaccatttcctgtgctagaaacttgccgaattgcagacacacgagaggaacagaggagtacccacccccccagtccctgcaacccactgagtctcctacccccaccctagtggtgtctgcctctgcccgggcttaccttgtccctggtaaccagagcttaggccaggccgcccagggtcaggctgactccacagccccaggcagtcacctcctgcccagcccccagcccccagccccgttgcctctgaacctgtgagcatctgggccacaccgtgtgcgtgtgcgccacctggctgtttttctcccgagggccttaccttctgagaaatccctttccagtccctggggcacacccaggaggagacagggttgtttctccagttgtttcaggacttttagtccattttgggagtggggtatgtgctctgtgtgtgtgtgtatttgtatctgtgcaaaagggggtatctgtgcctaaatatctgtttatatctggtatgtcagggtaactgcatgtgtctgcgtgatacgcaggtatctagatgtgtgcatgcgtgaatgtgtgtctatgtacatttgtatgtttggacatgtacacctttgtgtaagtttaaatgagtgtgcatgtgtgttccttcttccctctttggaaaacacctgaggactagaaaaagcatgttgagtgtattctcatcacagctctaccactttctaacttgctgtgtgaccttgggcaagttacttcacttacctgaaccttattttcctcatctgtattctgggacttgaaaccctgtctcagtggatagttgagaggattccaggctgtgagcagagcctttcattaactctcactcgccagagagagaggagcggggatattggtacgacctggggttgagttttgaccctgcgctctggttctgaccttgcctttatcctttgtccaacctctagggttcgggtttgtcacgtttgagagtgaggacatcgtggagaaagtgtgtgaaattcattttcatgaaatcaacaacaaaatggtgagttgggtccgggcgcagtggctcacgcctgtaagccaagcactttggggaggttgaggtgggcagattacatgaggtcaggagtttgagaccagattggccaacacagtgaaaccctgtctctactaaaaatacaaaaattagccaggcatggtggtgcgtgcctgtaatcccagctacttgggaggctgaggcaggagaatcgcttgaacccgggaggtggaggttgcagtgagctgagattgtgccactgcacttcagcctgggcaacagagtgagtgagactccgtctcaaacaaaacaaaacaaaaacaaaaacatggtgagttgggattggatggagcgcaggcacagagaagactggggctccttgtggggcctgccagggaagctatgaggttctaaaggcaggcagaggggcttcgagtgagtggaggcagagccagttcttccaacccctaaaaacctagacagggaggcagtgtcacacggtagttaatcaggcagatgacctcccttctctgagcctcagtttccacatctgtcaaatgggactggaaaagctcctccatcatagtattggtagtattggtgtaagcattcattgaacgattgcatgcaaagccgtttacacactccccagcacatagtgagtgctccatcagtggtaaccatgaaatagttttcagctggacagtgaaattaataaaattaataaaggggctttccagggaacaagagggctaatgactctagctctgtgggaaagactaaccgccaggtctcattgcaggtggaatgtaagaaagctcagccaaaggaggtgatgtcgccaacgggctcagcccgggggaggtctcgagtcatgccctacggaatggacgccttcatgctgggcatcggcatgctgggtatgcgcgagcctgcgcctgcggcttctttctgccagaactgctcccagggctagcaggggctgtgtgggtgttgcacctcccctgtggtctgccctcctcctgtctgagtcattgagcaggagtggggacaagggatctgtcgggtctggcagtcctacccaaggtggggtggtttggttggggggtgctgccctctggtggtagccagcagaaaggtccaaccatattcattggtcctgtcaatctgtccattctctcgtccatccatccctccatctgtccattcctctatccattcatccatccagtacacagttattgagcaactctatatgccagacattatgccaggaactgcaacaatgactttctttacaatctggcagggaaaacaagtaagaagataaaatagatttcagatgcagaagtgtagggtgccgagggagtgtggtcacagggaacttgaccgtgacttggagaagtgggaaaagaagttacatttaagttgagtctgcgggtggagtaggagccagtgatggggaggctggagagacgggaaggggaaaagtgttccaggcggagggaacagcatttgcaaaggccaaaggcctttggagggggcaaaaggaaggctgcctggtcttattcattcaggtaatatttattgagcaacttctgagaaggagagcctgctctcatggggctctccttcaagttggagacaggagtaaatgggcactgccactacagagtgactggaggctgtgggaggcccctaaacccacctggaggttgaggagacttcctggaagaggtgaaggctgccatgagccttgaaagctgagcaggagtcagctgtgctttgggtccaagactgagggtggtaaatctgagtttggccccccaggaagctcataggctccctggggagatgagatgtgtacacacagaaagagaacagtacaagggggtctttatgccaggcatgggggagtggcacacagagaggtactctgggaattcagaggagggggcacggcatgggctagagggtcagaagtcggggaggcgagcagcctccaaatagggcacagtcttccttgaagcttttcttttttctttaacatgttatttggaagtaatcccaaactcagaggagctgcaaaaataaaacagtacaaagaacatccatataccctgttatcagattcacctgttcttaacattttgcccccattttggttgatcagttttactctatgtgtatatatgtgtgtgtatgtgtgtttgcaaatatgtatgtacacatgtatagacacacagacttgtgatttttcactgaatcatttgagggctagttacatgcatcgtggccctttaccctttgatgcttcctaagattagggatattctttcatgtaaccacagtttagttatcaacttcctaagtttataattgatacaatatttttttctttcttttttttttttttttgagacggagtctcactctttcgcaggccagactgcagtggcgggatcttggctcactggaagctccgcctcctgggttcacgccattctcctgcctcagtctcccgagtagctgggactacaggcgcccgccaccgtgcccagctaattttttgtatttttagtagagacggggtttcactgtgttagccaggatggtcttgatctcctgacctcgtgatctgcccgcctcagcctcccaaagtgctgggattacaggcgtgagccaccgcgcccggccttgatacaatatttttatctaatctactttctattttccaattttatcaattgacccaataatgctcttttttttttttttttttttttttttggtagagacggggtctcactatgttgcccagctggtctcgaactcctggcctcaagcaatcttctcacctcaggttcccaaagtgttgtggtggtaggcatgagccaccatgcccagccagacccagtaatgctctttatagaatatttttgtccttcagaataagatccaggctagaatcaggtattgtagttagttgtcttgtctctttcactttgttttatttagaacattgagaaagttttattctaaggtgattcatgagctgttttcacccttcatttaagaggtggaaaaagaagttaggcaccttggctcacgcctgtaatcccagcactttgggaggctgaggcgggtggatcacctgaggttgggagttcgagaccagcctgaccaacacggagaaaccctgtctcaactaaaaatacaaaattagctgggggtagtggcacatgcctttattcccagctcctcgggaggcttaggcaggagaattgcttgaacctgggaggcggaggtggcggtgagccgagatcatgccattgcactccagcctggggaacaagagtgaaactccatctcaaaaaaaaaaaagtggaaaaagaaattatctaacaaatagtgagatcggtggttaagaggcttggagcccgtcagatctgaattttaatcttaattgcaccattattgctaactattggatttttctttgagaagacagaaaatcagcacttaaagaaatcatgagtactttctggccaagtgtggtggctcatgcttgtaattccagaccaaggcaggaggatcacttgaggctagtagttcgagaccagcctgggcaatacagcaagaccccatctctacaaaaaaattaaaaattagccaggcatagcagcacacaccttgtagtcacagctactagggaggctgaggcaggagaatcacttgagcccagaagtttgaggctgcagtgacctacaattgtaccactgtgcactccagcctgggcaaaagagcaagatcctgtctctaaaaaagaaaaaagaaaaaaaaatcattatataagttcagataatgatcatcagtactaagaaaagccaaggtgacatgatagaaattgtagctgatgggaaggaggacacctatgggaagatgtttcggagtcttgtacaatgagagggactcaggcatgtagtcatctggaaagagtgctccaggcaaaggcaccagcatgtgcaaaggccctgaggtgggaatgagcttggcaaagctgaaaaacagcaaggaagccaatgtggctggagcagagggagggaggagcagtgtgcaggagatgaggacaggagggaagcaggagccagagctcaaagagcattggattattctcagccaaaaagtgtcacctttcagagcctcagtttcctgtctgtaaaatggggtgcctaacagtacctacctctaaggcgagtttaacgggataatagtgtgcagtgtgcttggcacagggcttggtatgaagaaggtatttggagggtatagctattattcatgataaaggaaggtgaggggacatgagtggctcaggtccttctccatgatcaggatccgccctgtggatgagccatctgacactgcccccttgccccatcaggttacccaggtttccaagccacaacctacgccagccggagttatacaggcctcgcccctggctacacctaccagttccccggtaagtcctgctcagtatccctctgctgccagcatgcccctggttcccgggcagtctgatttctcagggtggtgtctaggggtgcatggctgggggtctgcttgctggaggcttggaaggaagggcatgtctgaggaaagagggcctctccccacccatcccccccaaacccctccccagaagctggggacaggggctcccagcgtggccctgcatggcaccgttttctcccaggccatcctctgcctgcctcctgcctgtctctcctccccacccgactccagggttgccacttccaccagagagggcattgggcttgtagtgggggcctctccgagggccattgttggttgcatcatcacagacacctataatggccaggctctaggctgagctctttcaagtccagacaaggtattatgctgagaccctaaatgctgaaaaccagttgaaaagcattatcattaccacgctcatttgtaagccaacataaagataacactagacctgaaagtaaatgtcaggaagcccagttctggacttcccatgatgactattcaatgcagttttctttgaaataagaaatacaaacttttgcaaggccatttatttatttatttacttgggggtcttatttatttggagggcccctaagcacttacatcctctgcctcagggctgttcagcttggagaactttgtgtacgggacgttgcctaattctctcaataatctcaaaaatcctcattttagagatgaggacataggctcagaggaagaatgacaaagctaagatgagccaactaggaagtggcagagctgggacttgaacccaagcctgacctattctacctattctagggccgtcgcttttcatcaggctgccttcccccaacacacacacacacacacaagaagaagaggattctgggagatgtttttggtaatagtcaaattgtaagccttttagagacaccagagcctggacatggtgactcacgcctgtaatcccagcactttaagagcctgagatgggaggatggcttgagcccatgagtttgagatcagcctgggcaacatagtgaggccttgtctctacaagttagccaggcatgatgttgtgtgcctgtggtcccagctactgaggaggctgaggtgggaggatcgcttgagcccaggaggtcgagtgtgtagtgagctgtgttcatgccactgcattccagcctgggcagcagagtgagaccctgtctttttttttttttttttttaaataaaaagggccaggcgcggtggttcatgcctgtaatcccagcactttgggaggccaagacgggcggatcacgaggtcaggagatcgagaccatcctggctaatacagtgaaaccccgtctctactaaaaatacaaaaaattatccgggcgtggtggcgggcgcctgtagtctcagcttcttgggaggctgaggcaggagaatggcgtgaacccggaaggcggagcttgcagtgagccgagatcgcgccactgcactccagaccgggcgacagagcgagactccatttcaaaaaaaaaaaaaagagagaaagaaagaaaaagaaaagaaacagaaaagaaggaaacaagccaacacctggaatcgtagctccagccctgccccgtgcccagggtataggtggcaactctgctccctctctctgtctctcctctgtgtctgtctccttgccctcccctgccttctgggaactgtgctctccccctccccagctcttgggtcctgtgcatggcctgtctcctcacccagtgtccctgtgggtgcatttgtcctccctgggccatgtccaaggggcctcccctgcttcttcctaagctgttttacgtttcattttagaattccgtgtagagcggacccctctcccgagcgccccagtcctccccgagcttacaggtcagtcgctcggattttgtatacctctcaggccacatggggagaaacagaaggggcccagggagtttcctggggaaagctagcgggatccttttctcctgcccgccagccctccggctgtggggacacagcagactgtgcctgggcactggccagtctgggcggctacatggcccttaagggtggggcatagggccaagccaagcagatggaggcaaagtcactcattcatccatttggcaaatatttatctagcacctctcgtgtgccaggctccatggaggctctgggatcccgcagtgaacaagccagggtctcaaactcattgcaaagtgggctgggtggggacgtctgcacaccagcgtgggcatacctgccctcggtgccagctgactcttgccgggaggggatacagactcactatgctcagatctcatgtttttccagagatgccagaaacctggcttttgctttcgtatgaatttttccattatttttcaatgttggcaacagattctaaatgtttaaaacactgtgagccaaatgaaatattgccaagggccgaatccagccctttggtgacttctggacaagtggggtgaaggtgacagggggccggtttcctggctggcaccttcactcgggccagccagctcagctgcggagccagccttgagccgaggagactgcaagcacgtggggtgggctgcagggggtttctctgtccaagctgcttctcccccaccccacccccagactctcccctcaacctggccatgtgtggaagacgtgagcatggaccctgctttagataagaccttccttccaaggggtgctcagggttcccccaaaatgggggagaggaagagaaacctggagtgaaggaaggggtggggaggagaaccctagagatgcaggtaacagaggctcttccctgaaaagagggagagtttggccactagttgtcagggtggagggctggaaggaggtccttgttactcatttaagaactgtgtgtgctgggcgtggtggttcacgcctataatcccagcactctgagaggccaaagcaggagtatcccttgaggccagaagttcaagactagcctgggcaacatggtgaaaccccatctctactaaaaaaaataaaaaactagccaggtgtggtggtggtgcatgcctgtagtcccagctacttgggaggctgaggtgggaggatcgtttgagcccaagaggtgaaggctgcggtgagccatgattgcatcactgcactccagcctgggcaacagagcaccatgtgttacggacctactgtgcacaggatgccctcccagaccctggggacagagcggggataagacagaggcaggccctgatctcacagaactcgcagtttagagaggggagcaaatacttattatataaataagtcattctttacagtgtggtaagcacatgctggggttggctcctctgactttatggaaatgcctaaatgagccaaacaacagacctcagagcccagtccctggccttaaagaaatgacagaagaaatgtcccttttagagatatcttggcaggcaagggagtaggtacaagatcaacagtgcttgggcacctaggatctgaactttcctctagccttggagaaaaggagacttgggtggttttttcatgcattcgataaatattcattgtaccagacaccactccaggcactggggccacaacagtgagtgacacagacaaggttcctgtcttcctggaactgaaattccagaggaaggagacagcagtaaacaagtaaacaggccgggggtggtggctcatgcctgtaatcccagcactttgggaggctgcagcaggtggattacttgaagtcaggagttcaagaccagcttggccaacatgttgaaaccccatctctattaaaaatacaaaaattagctgggcatggtggtgcatgcctgtaatcccagcactttgggaacctgaggcaggcagatcacctgaggtcaagagtttgagaccagcctggccaacatggtgaaaccccatctctactaaaaatacaaaaaaaattagccaggcatgatggtgcacacctgtggtcccagctacttaggaggctgagccaggagaatcacttgaatccaggaggcagaggtcgcagtgagctgagatcatgccactgcactccagactgggcaacagagctagactctgtctcaaaaaaaaaaaaaaaaaatcaagtaaaacaagaaaggcttacctgagtatccccaaagcaaataagatatttttgggctgggtgttgtggctcatgcctgtaatcccaacactttgagaggccaacacaggaggatagcttgaagtcaggagttcgagaccagcttgggcaacataccaagaccctatcttttattttattttatttatttattttttttgagatgaagttgtgctcttgttgcccaggctggagtgcaatggcgcggtcttggctcaccgcaacctccacctcctgggtgcaagcgattctcctgtctcagcctcccatgtagctgggattacaggcatgcaccaccacacctggctaattttgttttttgttttttgtttagtagagacggggtttctccatgttggtcaggctggacttgaactcccgacttcaggtgatccgcccgcctcggcctcccaaagtgctgggatcacaggcatgagccaccgcacccagcctttccaagaccctatctttacaaaaaaattaattaaaaaaaaaaaaagatatttttggagggtgagaagttccatgaggaaattaaagcagggaaatgtgctaaggcgttatggttggggacaaggggccgcctgagtgggggtattcagggaaagcttcttagaggaggtggcatctgagtgagaaggagcccactgtatgaagtttttaggaaagattcacagtaggaggtgctcacctctcagccccagggagccccaggctcaagccattcaagccactgggtgttttaagcagattccctttctactctttcagcagttattaagcacctgccgtgtacaaggcaaggtgctaggtgctgcagaggtggcgatgatggcagacagcaaacaaggggataggtgcctgtgtctgaagagatggcagacaaagaggctggggggatttgggggaggcagtggtcatttctgggtggtcagggaggcccttagggtgctctcaggagacaggggcgaggggagcaggacaggcagcagaaggtgcggtgcaacgctatggcctcggtgtgagcccagcctcagcctgacccctagagcgctctacctgggggcagcaggcctgggggcctgtcccatgtctgtctatcgccaggtgtcgtgggctgcgaagaaggacgtgagctcccaggcacctctgggccaagtgatccctgttttgccaagggcatcctggagaagggggcagctgcgggcaaccttcgcagcttctcagggttgggtgccctgcctccaccctccatgaggtttgggttattcaagcatgtccccccagaccaggggagaaattgaggctcagctactcactgggaagctgtcctctctcccacctttttccatccatgccacaggtcaggacacagatggtgtggcccaaggtagccttttctgccttgaccctggggctacatggaaccctctgaggtagggccaggctggacaggctctgcctaaaaggtaggggcctccttcacccatctctgcccctcaccgccatgctgatgtgcccatccctttcctttcagccattcctctcactgcctacggaccaatggcggcggcagcggcggcagcggctgtggttcgagggacaggtgagctcttctgaggtgcaggaagagagatgagggagcacagggagcagagaagtccaggggaggggagaaggccactgccacccctttgcagagggacacttgttcattcactcaagtatcacctgattacctgctctgtgctgggcatcgtgccagcatgggcgagccagccctcagcaagactgacagggtcggctgggcgcggtggctcctgcctataatcctggcactttgggaggccaaggtgggcagatcacctgaggtcaggagttccagagcagcctggccaacatggtgagaccccgtctctactaaaaatacaaaaattagctgggcgtggtggtgcgcgcctgtaatcccagctactcgggaggccaaggcaggagaatcgcttgaacccgggaggcggaggttgcagtgagctgagatcacgtcactgcactccagcctgggcaacagagtgagactccgtctgtctcaaaagaaaaaaaaaaaagactgacagggtctctgccttccagggcttgcagcctggtggtggcatcaggtattaaaaaggcaataatgctgatggctgatgctgctgcactagggggagtccggtaccagaggagctcccagctggggcctctaggaaaggcgagggaaggcttccaagaggaagggcctcttaactttgcattcaaaggcaaagaggaggaaaagtgtttctggttgagggaatagcatatgcaaaggcttggaggccagtgggtggggaaagtgcggaagtggggagtggagaacggaggcaggaggagcccgggtggtggggagacagtggaaattgcaagtagcagagggacgcgggtcagggtttagaacatgcattcagctgctaggtggggagaggttgggaaggggctcaggaggtgaggctgctgagtggtcagacgagatgatgggggtcagggctaggggtgactgggtggatgggcatggggagatctccaggaggtgggcccacaggactttctgaaatgtgggggtccaggttagggtgggtgggacaggcttgagggggtgccgtggggtggcagagggcaccagggctatcaccgtcttctttctgggttgccaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttggggtgagtggccaggcctagcggcccccacctcaccccccacaccttgagagacccccaagttggggaagggagagaacttctttgtctctgggggcaaaaggagggtgagggaggatgaatggagaaagatcactaaggaagagttgtgggggttatcattcattcagtgggcacttagttatcgcctctgaatgccaggcatagtgggctctaggtgcaaatgagacacatggcatctctgctcacatggaggtttgattccaggggtgccctggttttatccagggtacggtttgtgcagattccctggccctctgttggagaatctttgagcagacctgcagtggggggtgatccgggtaggcagacctgcagtgggggggcgatccggacaggtagagagaggtcagtgcctcacttcagatgtcctgcagagagagaaggagcccctgatcttcctctatttcccaggaatctaggagtcaaattctttccttttcagggccctttgattgccacagccttcaccaatgggtaccactgaagcaggggacggtggcaggaggtgaggatgtgggggtgggcaggtggtggggtggcactggggaagcctgtcctgggccatcgaatctgggacacagaccccatccctgccctcaagaaccacagtcccaggggagacagatctttataccagctgtggtcaataaagatgaaaagctgctcaccctactccatttaaacacagaaatcaaagcaacagtaaggcttcacatcccacctatcaggttggcaaagattattattattattatttttgagacaagatatcgttctgtcacccacacctcctgggctcaagggatcctcccacctcagactcctcccgagtagctgggactgcaagcacatgccaccatgcctggctaatttttttactttttttgtagagacagggtttcactgtgttgcccaggctggtctcaaactcctgggctcaagggatcctcctgccctggtcccccaaagtgctgggattacaggtgtgagccaccagcgcaggccacaaagattttttaagatcgtttattattattactattattttattttatttttgtagatggagtctcgctctgtcacccaggctggagtgcagtggcgcaatcttggctcactgcaaactcgtcccctgggttcaagcaattctcgtgtctcagcctcccgagtagctgggattacaggcatgtgctaccgcacccagctaattttggtattttttttgtttttagcagagacgagttttgccatgttggccaggctggtctcaaactcctggcctcaagtgatccatctgcctcggcctcccaaagtgctgggattacaggggtgagccaccgtgcccagccctattattattatttttaatagagatgtggtctcactgccacccaggctggagtgcagtgtgcaatcacagctcgctgcagcctggaactcctaggctcaagccatcctccacctcagcctcccaagtagcggggaccacaagagcatgccaccatgcctggctaagtttttaaaaaatttttttgtagagatggggtctcattatgtggcccaggttggtcttgaactcctggctcaaacgatcttcctctgccttggcctcccaaagtgctgggatttcaggcatgagccaccgggcccagccacaaagattttttaagttgaacactgcccagcattgatcaagatatgggagaagcaagtaagtacagtggctcaggggttcccggggcagtctggcagtgtttgtcccagtttcaaacattcatgcccttggacccaacaattccacttctaggcatttatttttaaaactgcaaataactgaaatatccatcaaaaggaaagtggttaaacaaattagtgtgtgtacagtggtatagtacacagctatcaaaacaggataccttggccgggcgcagtggctcacgcctataatcccagcactttgcggggccaaggcaggcggatcacctgaggtcaggagttctagaccagcctggacaacatggtaaaaccccatctctactaaaaatacaaaacttggctggcgtgatggtgcgcacttgtaatctcagctactcgggaggctgagggacaagaatcgcttgaacccagaaagcgaaggctgcagtgagccgagatcaggccactgcactccagcctgggcaacagagcaagactccacctcaacaaacaaaaaacaacaggatacctcgacttgtgggactgtgtacacggccatcacagtgtctatccagatggtgggagactgtgagcccatgacattctgttcattcacccattcatttatgagccccattccaggaaagaggatgaacaagacagacaaagtcctctctcatttcacaggacaaaaatcaagtgaacatatgagataattccagactgtgcatgacagggctattttagatgtggggtttagagaaggtatctctgagaaggggacatttaaataaatccagccattcgaaatctggggaaagaggcatccaaccagggaacagaaagtgcaaagtctggctgggtgtggtggctcacattcgtaatcccagatctttgggaggccaaggcaggaggatggcttgaggacaagagtttgagactagcctgggcaatatagtgaatccccatctctgctacaacaacaaaaatgagcagagtgtgtttgctttcacctgtagtcccagatactacctgtaatcccagagtctcaggaggctgaggcaggaggatcacttgagcctagggaggttgaggctgcagtgaactatgatcgctgtcactgcactccagcctgggcaacagagctggactctgtctctaaaaaaataagaagaagaaagtaggtagtttacgaacaaagctcttctgggagagaactggggagggctgcgtgtgctccgggagcccccataacctcctggctgtgttcccagcgccccagcctgcagctgactgaggaccacgagtgagccagcgagggggcgggagacctcagccgcagccgccgccccctcccctgcagcgactcggacccgctactgcctgcccccaactccccgggcccggcccctgccctgctgcccccaacagcgtctggctcccctactaacgtccccctcttcgcccttgcccccatccccacccgcccctctcccggccctgcttttatttattttggattagccggttgcccaccccagccctctggtccatccctccctccgtgccgcgcccccctaggaccgccccctccccaaaaggcttttggatttgtgcatagctggagtgaaggcggagggagcctgctacaggccgcagcccaacccctgttttttattcagatttcccctcctttaccctttccctttttttttttttttttttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctccgtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgttgctgggcttgtgaatgtcttgtgtctctgtgcattcagggatacctcattttcctgttttagggatggcaggactcacctccatcctcttagggtcctggcaggatccaagaattaaattgacacaagatagatgaacagggccagtcagtcacagtggctcatgcctgtaatcccagcactgtgggaggcagaggtgggcagatcaattgaggtcaggagttcgagaccaggctggtcaacatggcgaaaccccatctctactaaaaatacaaaaattagccgagtgtggtggtgggtgcctgtggtcccagctactcaggaggctgaggcaggaaagtctcttgaaccctggagctggaggctgcggtgagctgagatcatgccaccgcactctagcctgggtgagagtgagactctgtctcaaaaaaaaaaaaaaaaaaaagaataggagaaaagcgtacacatttatttattaaaagttgtgcatggcatgggagcctccataaagaaatgaaggcagagtgtggttgctcacacctgtaatcccagtacttggggaggctgaggcaaaaggagtgcttgaggccaggggttcaagaccagcctgggcaacttagtgagaccttcatctatataaaatattaaattatttaggtatggtggcacaagcctgtggtcccagctactcaggggacagaggtgggaagattgcttgagccctgggagttggaggctgcagtgagccatgttcttgacactgcattccagcctggaggacagagcaagatgctctcattctcaaaaaaaaagaagagagagagagggagaaatgaagacctaaagaagcagttagagttactgatatactggattggacaaagaatagtaaattatgaaaaagccactcaattatgtggagaagcttaaaagataacagctattttgggccaggcatggtggctcacgcctatactcccagcactttgggaggccaaggcgggcggatcgcctgagctcaggtgttcgaaaccaccctgtgcaacatgaaaccccgtctctactaaaatacaaaaaattagctgggtgtggtggcacgcacctgtagtcccagctacttgggaggctgaggcataagaatcgtttgagcccaggaggcagaggttgcagtgagccaaggtcgcgccactgcactccagcctgggtgacggagtgagactgtctcaaagaaaaaaaaaaaaaagctattttggctgggcacgttggctcacaactgtaatcgaaacactttgggaggctgaggaaggcggatcccttgagtccagcagttcgagacttgcctgggtgatatggtaaaaccccatctctacaaaaaaatacaaaaattagccggttgtgtggtggtgcaggcctgtagtctcagctacttgggaggctgagatgggaggatttcttgagccagggagacagaggctgcagtgagctgagattgcaccactgtactccagcctgggtgacagagcaagaccctgtctcaaaaaaaaaaaagaattactttaacaagggcctgcacagaatcatctcggtgccgacttcccgccctcgaagataaggatgttgcctttccttccagtacaggttgggggtctttcactcaggaatttcatcatcttctgcttttaagaaacagcacaaaggtgagagtgatcatcttgttcctgctgtttttcaagtgcctttaacttaaataatcagagtggatatttttaaatattctctgcactttctccctcctgctttcctcctgggaaggtctttactttccacttgacccagagcttagtgttgacaatgagatgccacttcacactcattgctgggattacaggcgtgcaccaccgcacccagcccttcaaacagatatgtgtacgccagtgttcacagcagcaatattcatgatagccaaaaggtagaaacaacccaaaagtccatcaatggataaatggatacgtaaaatgtgatctatccatacaatggactatttattcagccttaaaaaggaaggaaattgggctgaatgtggtggctcacacctgtaatccccagcactttgggagaccaaagcaggtggattacctgaggtcaggagtttgagaccagcctggccaacatggtgaaaccctgtctctactaaaaatacaaaaattagccagacgtggtggtgggcacctgtaatcccagctacttgggaggctgaggcagaagaatcgcttgaacccaggaggtggaggttgcagtgagccaagatagtgccactgtactccagcctccaccctgggtgacagagcaagactctgtctcaaaaaaaaaaaaaaaaaaggaagggaatactgtcatatactacaacatggatgaaccttgaggacatcagcttacatcgtgttatatgaaataagactgtggatgaaatactatatgattccacttatacaaggtactgagattagtcaaattcacagaaacaaaaagtagaatggtggttaccagagcctggggcaagggagaaggagagttgtttaatgggtgcagttttggatttgcaagatgaaaaatgttatcagtgtgaatatactgaacactactgaactgcctattcaaatatggttaagatggtaaactttatatattttttaccagaattaaaaaatacttaaagtttgaaatgcatacagaagtgcttatgaataaaatgacttgagagctatgatttgctttaaaatagccaataaaaaagaagtatgtgggtgatatggtttggctctgtgtccccacccaaatctcatctggaattgaaatccccagggagggatctggtgggaggtgattggattatgggggtggttccccccatgctgttctcatgatagtgagttctcacaagatccagtggtttaaaagtaacactccccactctgctctctctctcctgctgccatgtaagatgtgctttgcttcccctttgccttctgccatgattgtaagtttcctgaggcttcccagccatgtggaactatcaaacctcctttctttataaattacccagtctcaggtagtatctttatagcagtgtgagaacagactaatacagagaattggtaccagctctcatgagatccgatgattatataagggggagttttcctacacaaggtctcttctcttgtcttgccaccatgtgagacatgcctttcaacttttgccatgattgtgaggcctccccagccaggtgtaactataaatccattaaatctttttttcttcccagtctcaggtacgtctttatcagcagcatgaaaactgactaatacatgtgaaaatgcctggatgtccaggcagaagtcagctgcaggggcagagccctcatggggaacctctgctaggtgtactgctatacagataacctgaaacttgtagatgtgactttggaattggataacaggcagaggtcggaacagtttagggggggctcagaagaagacaggaagatgtgggaaagcttggaacttcttagagacttgttgaatggtattgaccaaaatgttgatagtgatatggataatgaagtccaggctgagatggtctcagatggagatgaggaatttacttggtcctggagcaaaggtcattcttgctatgctttagcaaagggactggtggcattttgctcctgccctagagatctgtggaactttgaacttgagagagattatttaggttatctggcagaagaaaaattctaagcaaaaaagcattcaagaggtgagtggccttttctgaaagcattctatcatgtgcattcacaaagagatggtttgaaattgggacttatgtttaaaagggaagcagagcataaaggtttggaaaacttgcagcctgaccatgtggtagaaaagaaaaacccattttctggggattcaagccagctgcagaaatttgcataagtaacaaaaagccaaatgtgttaatggccaagaccatgggggaaaatgtctccaaggcacatcagaaatcttcatgacagcccctaccatcacaggcacagaggcctaggacagaaaaatggtttcgtgggtcagatccagggctccattgctctgtgtagcccccagacatggtgccctgcatcccagccactccagctccagctgtggctaaaaggagccaaggtacagctcgggccattgcttcagagggtgcaagccacaagcattgtcagcttccatgtggtgataggcctgcaggtgtgcagaagaaaagagttgaggtttgggaacctctgtctaggttttagaggatgtatggtgatatggtttggctgtgtccccacccaaatctcatcttgaattcccacgtgttgtgggagggacctggtgtgaggtaattgaataatgggggcaggtctttcctgtgctgttctcatgatagtgaataagtctcataagatctgatgattctataagggggagtttccctacacaaggtctcttctcttacctgccaccatgtgagacatgcctttcactttctgccatgattgtgaagcatcctcagccatgtggaagtgtaagtccgttaaatctttttttcttcccagcctcagaagtgtctttatcagcagcatgaaaatggactaatacatatgaaaatgcctggatgtccaggcagaagtctgctgcaggggcagagccctcatggaaaacctctgctagggcagtgcagaagggaaacgtggggttggagcccccacacaaaatccccactggggcattgcctagtgcagctgagaagagggccatcatcttccagaccccagaaaggtagatccactgacagctcacaccatgtgcctggaaaagccacaggtacatagcccctgaaagcagccatgggggctgtaccctgcaaagccacaggatggagctgccttaggccttaggaacccaccccttacatcagtgtgtagggtccagccccacagggtcagtgggtctctccccatgtgcagagacgagagagtgtagaaataaagacacaagacaaagagataaaagaaaagacagctgggcccggggaaccactaccaccaagtcacggagaccggtagtggccctgaatgtctggctgcactgttatttattggatacaaagcaaaaggggcagggtaaagagtgcgagtcatctccaatgatacgtaaggtcacgtgggtcacgtgtccactggacagggggcccttccctgcctggcagccgaggcagagagagagagggagagagagagacagcttacgccattgtttctgcttattagagacttttagtactttcactaatttgctactgctatctagaaggcagagccaggtgtacaggatggaacatgaaggcggactaggagcgtgaccactgaagcacagcatcacagggagacggttaggcctccagataaccatgggcgagcctgactaatgtcaggccctccacaagaggtggaggagtagagtcttctctaaactcccccagggaaagggagactccctttcccggtctgctaagcagtgggtgttttcccttgacacttatgctaccactagaccacggtccacctggcaacgggcgtcttcacagacactggcgttaccgctagaccaaggagccctctggtggccctgtccgggcataacagaagactcgcactcttgtcttccggtcacacctcactatgtcccctcagctcccatctctgcatggtctggtttttcctaagttatgattatagagcgaggattattataatattggaataaagagtcattgctaccaactaatgattattgatattcatatataatcatatctaagatctatatctagtataactattcttgttttatattttattatactggaacagctcatgtcctcagtctcttgcctcggcgcctgggtggcttgtcgcccacacagtgtgccctggatgtgagacatgcagtcaaaggagatcatttcagagctttaaggtttaatgaccgcactgctgggtttcggacttgcatggggcctgtgacccctttgttttggccaatttctctcatttggaatgggaacatttacccaatgcctgtatctgcgttgtttcttggaagtaaccaacttgtttcttattttacagactcataggtggagggacttaccttgtctcagatgagactttaaacttggacttttgggttattgctggaatgaattaagactttggaggactgtggggaaggcatgattgattttgaaatgtgaaaaggacataagatttgggaggagccaaggaggaatgatatggtttggctctgttttcccaccaaaatctcatctcaaattgtattccccaagtgtggaagaaaggacctggtggaaggtgattggattatgggggcgttttcccccatggtgttctcaaaaaaaaaaaaaaagaagagaaaaaatatatagtatatttgagttttaaagcataataacacccagtaacctctatccaacccaatagtcatttcaaaaaaaaaaacaaaaaaacaaaaaaacagtggtttaaaactacataactatcagaatcacctagaaaaaaaaatttttttttttcgagatggagtttcactctggttgcccaggctggagtgcaatgatgcgatcttggttcacggcaacctctgcctcncgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccattttactcacaggattgggactacatgagaaaaagatataaagtgctgacttagcacagtgcctggaatacagcacacaggaaatgggagttgctaaatagattacaagcttcttcccagggaggtgttaagccctaggaggggaaagaaatcacctccccgtcctatccaatccctgagggcaaagggtgctgccctctagtcccagatcagcaggaagcaggtaaatgtggggcatggagccagcttttccatcccttcttggagtttacaggctgccctgccacaccagccccagcgccagggccccgtggtccctgcccacctttgccattctggactcctccaccagcagccccaggcagaactagaagaggtatagtcctgtggccctcaggcagcgccccaccttagcacgccttgcattctcgaggcctggcccaggagaggcccacgtaagaacaaggtattttccagccccttcacccaccttcttctgcaggccaatttcactcagctttcattgccccaggcagggagcggccagtgcagcttccttaggagctgacaagccaaaggaaggagcagcaagcaccgccctgaaagctccagcaccagcagcaacgggctgccatagcacaggggccttccccgcagccctgggccagctgtccatccctgccatctgataggaaacccagactcccagagaaacaagtccctgtcctagggggtctggggatgcccagcctcatggcctgtctatcctgttgggtccagaactctggacaagggaggttcccaaccccctgatgaccacctgggcagccttggtagctctgagtgtcagagaagctgcggcctccttacagttgcccacgctcagggatataagcagtgagcagggcttggcccttcctaaggaaggagctatgtaaacagcaggaccagctcagggatggtctcatctcagcccctttggtgagactcttccagattaggaaggaaaacagaacgggaaggcgggtctcccccctccccctggctccaagttcccctcccctcccccagcccagagcacatgagcagttagagcagaggtaatctaatccgcagcggggtgctttcactcggtgagtaagtccccaggaatggtgagctgggtatatttatcctgataaccgtctgtcctcagtaagggccaatccacaattaggccagatccactctgccccacccacccccagcccagggacctagggcctggacactgactaggaactcagtctccttgaggggccttccctgccaatttgggttcttgtcaactgtctcctctccaagaattaagctccagagagcaggggccttgtcggtcttgttcgatgccatatccccagcagctagaatgaatggctgaatgacagaggggctgtgaagaggaggaggatggggaagcagcagtgagcagagcaaacagccagtgcggaggaggggagccaggatgccctgatcccaggcccagcggatgagtgggggcccctcagcggatcctctaacctctctggatgtcttctctatcaagaaaatgggcagaacccgatttgtccccattcctagtagcatgctctgaggagataatacaattatgggtgagatttatatagcacctttgagctcttccgagttagtctaaatccaagattctgctattatctgaatcccagacaggaactgctctgctaagaggatggatgagaaacgatcaataccatagtgtcatttaaatatttaatagccatgcctggaggttacaaagactcagccaccaattctcctccgctgactcatgcctcactcaacaggaactgcattttacccttacagccctgaaggaagtgtgggctggggggtgacacacaggaagccaggggagaaggcccaggagtcttccagtcagccgccaggggaggagggggtggtcatttggatgaagtggttcttccccaggcttcctacaggcctagcttaggagggtggcttcctgtatgctgaggagctcttccttgcagagggtgacacaatatgagtgtgcagacagactggctttattggctgcctggcttgtgcccaaggtcacagggcacaggtaaccagagacctgagaaaataatggctgcaaggcaactccagcagtcaccctgagctccaggcagaagaccaactgtgccaggcccatctgcaccaggcacacacaaggcccacccatcaggctcctggctgcagccacttccccatcaaattgggctccaggagcttaagcaacagcaggtgagacaaggctgcccaggttgactctgagcacttctatgcatctgccttaggctacagacacaggagttcaggccaggctggccaaacaccagagtctttctcttctttttttctttttttgagacaagtcttgttctgccactcaggctagaggcctgatcacagctcattgcagcctagaattcttgggctcaagggatcttcctgcctcagcctcccgagtagctaggactaaaagcacatgccaccacactaggcttttaaaaacttttttgtagagacagggtctcactatgttgcccaagctggtcttgaactcctggcctcaagccatcttcctgcctgggccttcccaaagtgctgagattacagacaggagccaccatgcccatccccagagtctctttcatattgtaaataactcatctctcctgtccagaatcagtgggccctccctcctccagaggtcccagaacattgtggacacatttcattggtcagatgtcatccacctctttaggtcgcccagagatgctagaccttttcaggtcaagtccagggccccattccaggcccaactcacagctccttcaatgggtaaaacccagattcacatacaaaaaagacagcctcaaacccaggagactcatgggctggaaaggttctcagctgttccaaatcgaccccagcccattcctgcaatctgggctcttccaggcaagttgatctgttgcagagcagggcggctccttgggcctctcacccctgctaatcaccaacagaggttaggaggggctcaaagtgagtcatcgtcccacagagacccgaacaaaaagttcaaaagtttgcctgttcctgagatgagctgcagtttttttgcgatttttgtggatttcatagcattagttacccactctttgctaatcaggttctcactaaccagccagcaccttccccttttttcaggcagcaaggtcatttcccgaagtcagctctcgcttgcctgacttccccagttctcttttctaagtccctttaatagctcccacatttagctggtcactaagtcacatcaattcttccttcgcggggcctctccctgtcatcacttgcctccctttcctttcatcaccacagccaaccacttggactagcattcgaatccatgctcagtgcctacctgaacttgactgcagccccctgccctgggttctcccaatctaacgcttcctgcacacaccatcggcccgaacttcttggcacccagcctttttggggcatgcctcacacttcactcttgcttctccccctagactgcaggtcctctgtgggcaagaacatcctcctgctcctgaatccccacagcatggataccctcataggcctcctttttttttgaaatggagtcttgctctgtcaaccaggctggagtgcagtggcatgatctcagctcactgcagcctccacctcccgggttcaaatgatcctcctgcctcagtctcccaagtagctggaactacaggtacacaccacacctggctaatttttgtattttcttagtagagtcgaagtttcacattgttggacaggcttgtctcgaactcctgacttcaagtgatccacccacctcggcattccaaagtgctgggattacaagcataagccactgtgcccggccctcacaggcctcttagaggggcttgaatgaatgtgtgcagagcaaggggtggagttataatactcacccactgttgccctctctgcctataaaacaaggtcagaaaccctggggatggcattctgttcttgaccctctcagaatatggccccaaactaaccttcactgcctccttggtccccctcactgcaacccatgtctccagccaaactggactccccgcttccctttttgccagcgtgcctttcttcacaatactgaatgtgtcccaccactacctctatcatcattcacctggtttgagcctctcgcacaaggatatccatacccccaggggacagatggaagccaggggtacaggaagccacctcaggataaacccagaacactctgaggatcaaatgtactcaggggcaagaaatgtaaatcattgtcttaaaacaaacaaggctacattatggagtcaaatgcaaaatgcaagtgaaatcgtaagataaaaagagaggcttcaaggcctgcatggtggcttatgcttgtaatcccagcactttgggaggccgagacagggagattgcttgaggccaggagttcgaaaccatgttggcctggccaacatggtgaaacctcatctctactctactaaaaatacaaaatttagttgagcatggtggtgcatgcctgtaatcccagcctcttgggaggctgaggcaggagaatggcttaaacccaggaggcagaagttgcagtgaacagagattgcgccactgcactccagcctgggcgacagagtaagactctgtctcaaaaaaacaaaacaaaaaaaacagataagattttgctcttggggactttggcaaacaattttaagcagcaccacaaagcccccactgtccacacataaaaccacccctgcccatatcacagatttggctggtctgctgtcgttgggagctaggatggtcacacagttctttggacaccctctgggcatcccacctgcatggcagtgtggtagagtggaaggaatgggccatctaacagtgaggaggatgggttcaaatccgccactcactagcctgggtgaccagtgactagataattctgggctttagtttactcaggcacctcatagcgcacagtgagtaatggatgaaaaagaatgtgagagccatcctggtggctgggataaaataaacgtaagcctcccactctgacacacaggagacactcagtcaatagatccacatcactgattttcatctcccttaaggccagcagggggaggagtcggagccagggactgcagccagggatcctgggagctgtgacaggttgtcactaactcagccttcttgctgagcaaaccactgacctcaccctttgtgtctcgggttcattccaagtcctccttggagaacatcagctgagcccaggcgcctccaactcactgcctagcaaggacagaggcaagcgagggaagctgcagggccccaacgcctccacccccaccccatccctactgcctgccgggaagtcacagctgtctgagaggcctgtggctttgaacccagaatcgcaacaatagaaggaactgcccaagctccatggtagctcccagaggaacccaggagagagcagcctctgctcctgccacggaagctctgagcccagcagagtgccaaaaagggatccaaagacggggctgcgaggctagaaagcagctcaggagggggtgaggagtggaacaacccttcctgagcatctaccaggagcccagccttgcagccccatttgttgccagggattagaatgcagacacccagagccgccccataaggccccacgaggactgcgctgcctgactgcagagatcacccatgttcttcccaggatgccccacaaggagaggaatgatcgctttcagcagctgtccgtcctctgctcgtcaccactctccactcccacaacacacatccccagagcccccagaggaatccaaaaaggcgggcctgctgggttccgctctactgctgcccactccaagtctcctgttctcttttctttctgcctcctcctcaccctctgcctcaggaggggtcttgagccacagaggagcccctagtggtggtacagagagctcaagaattctgagaaggctggtgcactccatgttctggtctaacttgttgatgtgcaaggtcgacgcgcacaagtgttttccccctgtgctacgctgcttgtggtcccatctgaacctcagggtgcaagatgggcctgccccgggaaccaacctctgacctcgcagagatgacatcagaatcattaagagacacacaggcagacaagggactccactgtaggcaccaaaccagccaacacgggacagccagcaagacagccagcctagattttccaacccacagtcagcatagctgttcccttcaatggacagccacatgtctcacccaagcacttttcccactgagcaaaaaagtaggcagttccatgtcttgccctctgtactgctgtttttaactactctgtgtctgggcacaagagggctgcagagggcacaacacgctggggaaacacaagcctgagcatagagctgtcctcagccactggctctcgaccctgacgtgcaatctgccatgaggtgtgtcaccagtccttggctaatcatcataaggtatggacatctgcaactgatttttttctttttttgagacagggtcttgctctgttacccaggctggagggtggaatacagtggcatgatcacagctcactgcaatctccacctcctgggatcccacctcagcctcatgaatagctggaactataggtgtgtgccaccatgcccagatgatctttttttttttttttttttgagacggagtctcactctgtcgcccaggctggcgtacagtggcgccatctcagctcactgcaacctctgcctcccgggttcaagcaattccctgcctcagcctcccgagtagctaggattacaggtgcctgccaccacacccagctaatttttgtatttttagtagagacaaggtttcaccatcttggccaggctggtcttgaactcctgacctcgtgatccacccaccttggcctcccaaagtgctggcattacaggtgtgagccactgtgcctggccccagctgatcttttaattttatttatgtatttatttatttatttatttgagacaaggtctcactctgtcacccaggctggagtgcagtggtgtgatcatagctcactgcaacctcaaacttctgggctcaagtgatcttcccacctcagcctcccaagtcatgagggctacagtgcatgccaccacacttggctaagttttctattttttgtagacagggtcttaggatgttgccagggctagcctggaactcctgggctcaagcgatcctcctgcctcagtctctcacagtgctaggattacgggcatgagccactgcacctggtcattgcttgcttgcttatgtatgtacgtgtgtgtgtgtgtgtgtgtatacacacacacacacacacacacacacacagaatctcacttctattgcccaggctggggtacagtggcatgatcacggttcactgcaacctctgcctcttggggtcaagcaattcttgtgcctcagcctcccaagtagctggaattacaagcatgtgccaacacgccctgctaatttttatatttttagtagagatagggtttcaccatgttggccaggctggtctcgaactcctgctggccattgcttttattttggagaaaataaactgaagtgggttcaagatgactccatgaccatcagccccacccgcatgtgttccagtgcatttacttgagtgaaagaaagagctaggagtgcaaagaatgccagacacacccttggtgtcatctgaaggctatgtcctggcagcgcaccatttgaaaccactatcatagatggtcacgagtgctgagaagaagtgggggaggggagtcaggctagctgcccccagaatgctccccgagctgaccctcagtgacccttttgcctccctagaagtgtctacctcatccagccctgggtcttcttgggcacacaaattttggaagccatctgctgatttcagggctctaggaaatgctgaggccccttgacagctggcgtccccacagagagttggcacctcctgaataaggagtggtctcaggagggcccatcccatgcacagaagctccaagtctcgtctcagtccccccaccccactgagctttgtaggctccccaggcacaatcataggcagcaggcctgacccaacccagggcgctggtgggatggcatcactgagctacaaaggaggaatgccccggccactgtcctgaagagggcaaggccaatttctccggaggcccggagccttgccaactctccgcatggggaaatctgcctcttcctggacagggaggaagcagatggagctgcagagtcacgctgggaaaccacaatagaaaaaaaggagagaagatattttcctgaaacaaaaagcacccagggagacctctgggctttcagtctggctagtggagttcacgtgtaggtatatcaaggtgcaggggagagggatagggtgggaacagaactcaaatgagaccacgtcgtagttagcctgcaagaagcccactaactccaaagctgaggaagcaggccaagcagatgccaagcctcatgggtaaactgaacggaggtgcctgtgcccgggggttcatgcagcagagagggttccagggctccaaccaggcttggctggcctggcctccctccaccatgcccagctggctatgccagggattgatgggggagggggtacacacctcgcccctggtttggattttattgcaggagacactctggggctccgcaaatccagcccagcagagccagagggcaacagcagtacgtggccgcaatgcccagaaacaccacacagaaagtccccatgtacacacgtggagcattccagaaggttgtttggaagttggattttgagctgtggagaatgtcttctaatagaaacaatactctgaggggaaactgggtgactgttcaggtagactatttacatcactagctccagtggatgctaggttctgcagtgtctgcagagattgctgtcttgccatgaggtgctagggtgaaccccatcattcctccttcaggcagtacctgctctgtgcctagctatgtatggggggcacagctgtccttggacgctcctaagctaaacttcccaaggacaagaaatcccgtgcttctgccccctaactactgtactgcaacacagggagcttcgtggtcagctagggaacttctgacgggaaccaaactgtcgggtggggctgctccttctcctcctgcccatctttatgttcagacaggaaatggtcaccaaaaaagccagggagctgagcaagcacctgtcccactactgcccttcctggtgccactggtttctcctttttaaagggtggaagtttctgctgggtgtggtggatcacgcctgtaatcccagcactttgggagcccgaggccaacggatcacctgaggtcaagagttccaaaccagcctggccaatgtggtgagaccctgtctccactaaaaatacaaaaatttaggccaggcggggtggctcacgcctataatcccagcactttgggaggctgaggcaggtggatcacaggtcaggagttcgagaccagcctggccagcatggtgaaaccccgtctctactgaaaatacaaaaaattagccaggcatggtggcgcatgcctgtagtcccagctacttgggaggctgaggcaggagaatcgcttgaacccaggaggcggaggttgcagtgagccagtatcgtgccactgcactccaacctgggcaacagagtgagactccatctcaaaaacaaaaacaaaattagccaggcatggtggtgcatgcctgtaatcccagctactcaggaggctgagtgaggcaacggaattgcttgaacctgggaggcggaggttgcagtgacctgagatcacaccactgcactccagcctgggtgacagagcgagactctgtctcagataaataaataaataataaattaaattaaataaaaaatctgagctaatctgaataaattgagagatttcacatgaaagccaggatttctggcttcccaggaacagtcagaagagctagctagcaacactggtctgcttggctaccttctttggaacaacatgaaatctagctcccttttttttttttttttggcccacttcatccattcacatgacctgcctggcctctgcaggtaagtgagtatgcaacaaaaatgtagcacaggttttgtcgctgaactacgtggtttcaggtccagctctgccacttgctagcatgacacctctttgagctcagttccctcatctatagaataggtataataactgccccttatataatggggactgtggggttcccaagcctcactcaagccatttagaggaacaaataagataacaatcataaagcagtcctggtacatcacaagcacacagccatgcatatcattagtgcctatctcaccaggtgacaggtgacagatgggggatgaggagctgtcccacccacaaagctgacatccctgattgccccaccagagcaagtgcatgcccagcactgcaagccataagcaactgcagagaaggtgctctgacaggtgtcagttaggtagtctgactctcccacagtggctccagagtcacctgttaagacactgggaccagaccatcagactgtaaacaagatctgggctaaaaagctgagaggctttgcaggacccaaccaaaacagcaatctctctccctggctttgaagccattcccaagttcaaagggtcaccaagcggatgcatctggaggcccctgcattcgtggtgtgggaagctcagtgcacaagccaacaggaagaagggcactgctgatcctcccaggagtccagtccaaaagctggcatcgcagccccacagtgctcccaatgacgcaagtgccaagaaaggagtccagggatggcccttctgaagtctctgcctcctaactctgccagagcattcgccattggaacatcgacactaacccacccaggactgactccagaggccctgagtgtcaggcataacagtgcccacccactcagggtggcctgcacctggccccacaatccaccctcttcctgctggctcagttcagctccctacccctggagcaaaagtattccacattctctttttttccctttcaaagggaaagggaggaagagagccccccaagggagctaaactttatatcagaagtcttaatctggcatctggagctgaccctcctggggatctgtggaccacctgaagtttcactaccatgtccctaccacactactctggggagagatcccactagtcatggcccaaaggggttgggaatctgaatgaaaccactgccatgggcaggcctgacagtgcaccaccctgcccctgtcagatcacagcttggtcctttgaagacaagtctgatcactaggggctgaagctgaagctgcctcatcttcacctcaatcccaggtgatcagaatttctggaatgggacctgcctggacactgacccaggcagcaaactccagtgaagccaccccagttcaggaggcacaaaacagatgtggcctcgcttgggtatccaaggcagagccacctgcacctgtctcacgtgcctcctccaagaccctccctccgatgctctcactgggacagcctcacctttactagtgatggctccaatcgcgttcacaaacacatagtgtgcacgggcactatgctgggcatgggaggggcaaatatacaatgcctgtctccggggagcactgactagtgggagactgtcataaacgaggggcagaaggccctgaaagcggcagtgggccaggaggaaaggggaggggctttccaggcagaggtggaaaacagcctgggaaagtgcccagacagaggggatgggagctcagagtgcaagtcccagcttgatggaagaggagtcaagggccgagggcccactggggagtctggacttacaagggcaagccacagaaggaaggcggtcagcagcggaacagcaggaccaggcttgcactttacatcactcaggcaggggagatcagagggaggcagggctcaattggaggaagagcaagagttgcaatactctacatgaaatcaggtaaaatcaatgttacctggaaactgagtggatatggagaaggagtgaggagtgcaggatgcctcccatgtttgtttcctgcaggagggatggaacagatgagacagggaagaaggtctgcggcaggggtcaggtaatgacggtaacaaggatcaggagttacaccaagaacaggcagagccacagggttccctgagccagggcccaaggacgtttttctctggccaaggcacctatctaagtaacagtttgttaaattatatggtacccttctcctgaacacaagttgttctccctgtctggctttgggagaacctcaggaagttgcatgcagcctgctctgggaattctcagagtgttcaggaagaccatgggctcccttcctctgcccgcacccatctgcacgagtctgcctctgaaattcaaatagaaagccagccccatctctgacagccgtcctccaggaaaaagaggggtcagcctaagcaggttatcagaggaaccagatccttcctgccacatgagcatgcggctcaccactggggccagagggcccaggacacaatctcaggcctcaaaccctcatggaaatgcccttcagaactgacccacggccccagccccagctgaccacagagagactttgcacagataaagctcatctcatggccaagtgtggtggctcatgcctgtaatcccagcactttgcgaggcagaggcgggcagatcacttgaggtcaggagtccgagtccagcctggccaacatggagaaaccctgtctctactaaaaatacaaaaattggtgtggtggtacacgcctgtaatcccagctattcaggaggctgaggcaggagaattgcttgaacctgggaggcagaggttgcagtgagccaagattatgccactgcactccagcctgagcgacagagcgagactcgggctttaaaaaaaaaaaaaaagctcatctcactgtaggataacagatgccccaaaggccagccccatctcagctatcgtagcaaggtcatccccaaaaggtcattccaatgaagatgcaaagcctaatgactgtccttggccttgtggctcaggataagtttgattagcttgaaagatccaactggacacagggcaccaaatcactaccaatgaactaaacacacatgcttgcacacacgtccgccctccaggcctctgcatgagctattccctctccctagacctctctcctgtcttctttaccaggctaaatcctttctaatcccttgagactcataatagcttagtttatcttcttcaacgagaggataaaaaggatccatcctgcctacctagagaaaaagcaacgtgttgcttttctgctgggaaggtctctttccaaaatcttattacagaatgaccatttaagtaaaggacaaaggttggggccttttctaaatgttgaggttctatttaaacacacaacaaaaggctgggcatggtggctcatgcctgtaatccaagcattttgggaggccaaggcgggacgattgcttgagggcagaaatttgagaccagactgggcaacacagcaagaccctgtctctacaaaaaatttttaaaaattcgccaggtgctatagcacatgcctgtaatcccagttacttaggaagctgaggctggaagatggattgaacccaggtgtttgaagctgcaagtgagctatgatggcatcactgcactccagcctgggcaacagagaaatcctatctcttaaaacacacacaaaacagagtcagtttaggatcccatttcctccaggaagccctccctgaccttactctcctacaaagggtttgaggctccattcctttgagttcccaaagcactgtgcacttctcctatgagaacacctcaagctggtaggaactgtctgcctaaggggccatgtctcacagcctaggaatagcacattgtgggtagggagtacgcctatattcatcttcatctgagcattgggcagagcctagcatataataggggctccatggatgataccaaacaaatcaacaaatgacctgcgccaagtcagtctgctgctgagatcagccttgccacttcagctcatgccacctcctggtcctccctaagagctcactgtatgcaaagcccggtgaggtagagcaacacaggagcacagggcccaagttgttcctactcttctatcccagaatgtcccatctactgtgatctagttgccaccacccctccccaaccagcaaaactcctaccctaaaataaacaaacaaaaaaatagctgggcatggtggccacatctgtaatcccagcactttgggaggctgaggtgggtggatcacaaggtcaggagttcaagaccagcctggccaagatggtgaaaccccatctctactaaaaatacaaaacttggtcgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccaggcgtggtggcgggcacctgtagtcccagctactcgggaggctgaggcaggagaatggcgtgaacccgggaggcggagcttgcagtgagcagagatcgcgccactgcactccagcctggatgacagagtgagactccgtctcggaaaaaaaaaaaaaaaatacaaaacttagctgggcgcagtggcagacgcttgtaatcccagctacttaggaggctgaggcagggaagtgtttgaacctgggaggcaaaggttgcagtaagccaagatcacgccactgcactccagcctgggtgacagagcgagactctgtctcaaaacaaataaataaataaaataaaataaaataaataataaataataaaaaaaaatcaaaggaatagtccacaagactttgtggctggagcatagccccttgtgggtacttaaggtttaaactcactgggtggcctatctggcttcctttgtgggtggggaagaggagctccaagaggtgggctcagggcataggaatgaggcagctgggagggagttggggcctgggactgggtgactctctggcttggtgctggggaaggaggaggaggggcatcacgtagcaacagagcaagaaggaacaggagtgtggcagccccaggccctgcagatctggtcacacctctccccatggagcagaggaggcaggggacatgagctggaatgtgcgattttctcaaacgtgcaccaccggaatgtgtcagcaacaccaagtgtggggctgtgtagcccagagagactgacagcatcgattatcatgactgaagcacagatgggatgagccacaaagcacgtacagattagtgaggctgagggagttcacaggcagggaaactagccagggaggaagaagacaacacgttctcagacgagaatgggaaaaggaggggaagaaaaaaaaaaacaaaacaatgttttcctgacatttttgttaacttctttagtcttcaaaaaaaaagaatgcggccgggcacagtggctcacgcctgtaatcccagcactttgggaggccgaggtgggtggatcacaaggtcaggagatcaagaccatcctggctaacacggtgaaaccccgtctctactaaaaaatacaaaaaattagccgggtgttgtggcgggcacctgtagtcccagctacttgggaggctgaggcaggagaatggcgtgaacccaggaggcggagctttcagtgagccgagatcgcacgactgcactccagcctgggcgacagagcgagactccatctcaaaaaaaaaaaaaaaaaaaagaatgctagaaatattatagtaaatttgtggacaaacataaaaggtggactacatagtacgggtttcataatatatgtagaaataacaaaaaacaggagggggaaatggaaatatactgttcttacattatacgtgaaatggtatggtatgatttgaaggcagattgtgattaatttaaacctgcaaaccacagagtgaccactaaaatcaaaccaatgaagtatagctaaataagcaaagagtggaaataaaacagaaccctaaaaaatactcaatgaatctaaaacaaggcaagaggccagacacaatggctcacacctataatcccagcgcattgggaggccaaagcaggaggattgcttgaggccaggagttagagaccagcctgggcaacacagtgagattccgtctctacaaaaataaaaataaaaaattaggctgggcacagtggctcatgcctttaatcccagcactttgggaggctgaggtgggcagatcacttgaggtcaggagttcgagtccagcctggccaacatggtgaaaccccatctctactaaaaatacaaaaattagctgggcatggtagcgcatgcctgttatcccagttcctccagaggctgaggcatgagaatcacttgaacctgggaggcagaggttgcagtgagccatgcactccagcctgggggacagagaaagactctgtctcaaaaaaaaaaaaaaaaaaagaaaaaagaaaagaaaaagaaaaaagaaaaatttagccaggccaggcgcggtggctcatgcctgtaatcccagccctttgggaggctgaggcaggcagatcgtgagatcaggagatcgagaccatcctggctaacatggtaaaaccctgtctctactaaaaatacaaaaaaattagctaggcatggtggtgcgtgcctgtagtctcagctactcaggaggctgaggcaggagaatcacttgaacccgggaggcagaggttgcagtgagccaggattgcgccactgcactccagcctgggcaatagagtgagaatctgtcttaaaaaaaaaaaaaaaaagaaaaatgtagccgggcatgttagcatatgcctgtaattccagctactcgagaggctaaggcaggaggatcacttgagcctaggagtttgacactgtagtaagccatgactgtaccactgcacttcagcctgggtgacagcaagaccctgtctctataaaaaaaaattttaaaaaaaagaaggctagaaaagaagaaataaacagatggcacaaatggaaaatgaatggcaacatgatagacttcagtctaaccacattgataattactttaaaatctaaaaggtttatatactccaattaaaaggcagagattttcagcctgggtagaaatgcagtatttaatacatgctatctacaagaaacatactttacatataaagacacagatagattcagtataaagcaatggagaaagatataccatgcaaacactaatatcaaggaaggcagagtggccctttgagggagccagctggcagctgccactaaactctggtgtgccctcgcctgctcctgagttgccactgtttgccctcaccccagaacaagtcagctaggaagccacaccacagctatggctttcaaagccatccgtggaactagaggtggcaatttattaaatcagaattaccctagcctgccgcaacatcaaatctctggagaaggtgtgtgctgacttgatcagaggtgcaaaggaaaagaatctcaaagtgaaggatcagttcagatgcctatcaagactctgagaatcactataagaaaaacgcctcgtgatgaaggttctaggacaagggatcgtttccagatgagaatccgcaagtgactcactgacctggatggtcctcccgagattgctaagcagattacgtccatctgtactgagctgagattcaaggttaaagtcaccactgcagatgtttcaagcaactattttattaacagaatagcagttgtttaaaagaaaaaaagaaagaaagttgaagtgcttctgttaatatcaggcaaggcagacttccagacaggaatattaccagaggtaaagagggacatttcataatgatgagtcaactcatcatgaagacataatcatcctaaatgtacacccactcaacaacagagctctaaagtagataaagcaaaaatggacaaaattgaaaagaaaaagtgacaaatccacaatcctagttggaaactggagactttgactctccagttgagaaagctcaataattgagaaaaaactcttccaaaggaagccagtggaagatataagcaaataacccaagagaggtgaagagcaggaggacagagggctgccagactgctggtctggggaacatgagggaccccagcctttgctcacggtagaagagggggctggaggatggccacagagcaggaaatgctccctcctctgtccacagcccctagaccttccccagagggaagcacgccagctcacaccacacttctcctggggtcattttcagtccctgataaccctggataggggtcagtgttcaacagcccccactgccctcagcagacacctggttgactatgtttcctcaattactgcacccccaagcacaccatatacaatccacagatgactttcacacacacacacacacacacacacacacacacacacacacacacacacacacacacacaccagactgtcccctctcttccctcctccccagtggcaccgcgtggcatcaccctcattggcgagcaggaatcagaacagagtctacaatgtcagcaaagggctgtatgcgacagtcactgaatccaatcccagctccaccactaatcagcaactaacctcgggcaagttgctcacctctctgtgcttcagtgtcgtcagctagaatacctacttcagagggctgttgtgaggaaatgataagggaacgtaagggaggtatttagaacagtggctgccacagagtgagtaacactatattaatgctggcagttatggccaggtgcagtggttcacgtctgtaatcccaaaactttgggaggctgaggcgggtggatcacctgaggtcaggagtttgagaccagcctggccaacatggtgaaactccatctctactaaaaatacaaaacttagtcagatatggtgttgggcacctgtgatcccagatacgtgggaggctgaggcacgagaatcgcttgaacctgggaagcagaggttgcagtgagccaagattgcaccactgcactccagcctgggcgacagagcaagactctgtctcaaaataaataaataaataaataataaaataaaaatccacaaaaccccttttgtaattgtggtcttagatggaagctcaatatataaacagagaaaagtaagcagctctgactgaagaagatgacggccacaaactcccaaccataggaggaaatgacatcctaaggttccttccagctctggaagcaccagaggactctaagaaagaatggatcagtccagaagcacagagggggagtgcagactgataatacccaacaggccgttaggagggaaaatctcagacagtcgaagcagggagaagaggaaggacagagcccaagccagtggtgcccaaaggagctgctaccagcaatgccctcaattgccagtgatcagccaatcaagcatcccccaggatggtgacaccccagcccccatgctttggccaaagtcaggcagataacagctgtctcctggtcactgttcctgctgctctagaggcacaaacaggatgtttagaagcagatgaccacaagtgaccacaggaagccatgacaaccgcctccaggtaacgatcttcttccccagcttctttccggcttggctgcctccaaagaccagacaaaaagacttcaagtgccaacttccaaagagagagaagggggaggagttcttggaaagttcaggacacagcagaagaggccatttgaggtggtgaggcagggaagaaatgagaccacccagctatcccaacagctacctcacctcaaagacgcattgtgcctgatgaagctaagcaggggtgaagaaactgcacatccactgcttgggacagaggaccttccaagacaggcagcatgtgaccaggcagactcaggagggctgccaagtcgtgtctctgaggagtgactgcagtgttccaggcatcacgaccactcctccacacccaccccagaggagcccatcccactcagctgtcccagagcacatcagtgatgagaaactgccttagccggccagccgagccaggagtacacaggggaaatggcaaatccagaggaaaccaagtgcaggccattggacactcccatttccacctaaggaagaggaatgttcctggaaacagagggggcaaagctcggccaggactctctgagccacttcaaacctccaacagagcccagggtgggtcccacagatcaactacccctaaaggggtacagtcactgggccagcttcatgacacagctgtgtccactcagtgtacaaccaccaagttcacagtccagaaaaccaactctccttttttctactgctactaggagcctcaggggccagaccaccccatgaggctttctggatgcctagagtgctaggagaagcccagggctgatctgggagtggatctcagcacagctccctgtggcagctctcactaatattagtgttagatgagcgattagtataaaccaagccaccaagccacctcctcccccaccacttcctcatgaaagccaccaaagaggctcaggggaaattaaaagtcatataaccaaaacccaacttaacaccaccagcccaagggtgtggccatttcacctccacagcagagttccaaacattctccaacccatggcgccatgaagagtcctaaatcacattcttccagaaagtaactgaagtcagattcttcccccaggcctagctaagcaaccaaacagggccaattgcactaagtgtccaccaccaaggccacgggaaatgcagccaacctaaagatgaagtggaagcttaaattcgaagagtgggccaggtgcaatggctcacgtctgtaatcccaacactttgggaggccgaggtgagcagatcacttgaggccaggagttcaagaccagcctggccaacatggcgaaaccccatctctactaaaaatacaaaaaattagctgggtgtgatggcaggtgcctgtgatcccagctactcgggaggctgaggcaggagaatcacttgaacccaggaggtggaggttgcaatgagctgagatcacgccactgcactccagcctgggcaacggaacgagactctgtctcaaaaaaaatcaattaattaaaaaataaataaggcccggcatggtggctcacgcctgtaatcccagcactttgggaggccaaggcaggtggatcacttgaggtcaggagtttgagaccagcctggcgaacatggtgaaaccccacctctaccaaaactacaaaaaacagccagcatagtggcgcatgcctgtaatcccagctactcaggaggctgaggcaggagaatcacttgaacatgggaggtggaggctgcagtgagctgagatcacgcccctgcactccagcctggatgacaaagcaagactccatctcaataaataaataaacaaacaggccgctgcggtggctcactcctgtaatcccagcactttgggaggtgaggtgggcagatcatttgaggtcaggaattcaagaccagcctggccaacatggtgaaacgctgtctccactaaaaatacaaaaattagctgggcgtggtcgtgggcgcctgtaatcccagctatttgggaggctgaggcaggagaattgcttgaacccgggaggcagagactgcagtgagccaagattgtgccactgtactccagcctgggcaacagagcgagacttggtctcaaaaataaataaacaaacaaacaaataaatgccaagagaatgataccaaaagccaaaccctccaccccaggagttgtcaagattatcccaagaatgaacgataaccatcaccagttactgagcactttgaaagtatttcgggaaagtatgtcaggaaatgcacctatttcatggattaggagaccaaggctcagagtgtaaagtgatctgccagggtcacacaagtagtaggcaacagcattgatacagaaccaagtgtggctgatgtcagaggctgggttctatgccacctccccaccccaaacccagagagaactcaggttctccagaggaggaagtggtttgctgcaggctcagcatcactgtgggtgtcgcagttcatacccatttaatcaccaaccaccatcaagtagttattaagtgaccgcagagagaacagcacagtgcttggtggcaaggggtatttgaaaggcagataaaatccctgtcttcaaagagcttacggggcagagcgggagacagaagaaagcctaatttacacagatctgtaaagttttaccttagcaggagggtcaacaggctggttagttttatcggggaaaaaagccttctcaaaaaggtggattcagctaagattttaaaggcagagggtaaggtgagtcaggagaaggctattttctgcaacttgaaccaacatctagactcaaggcagaactgagtggttggcatggtcagaagtcaaatgtaattcagagactgcaatacaagataccccctagatctggcaactgcatttgtcattaaacatcgagcacagagagttcttagaatcccccaaagcaggggccaagtaggaatatgtgtgaggcaagtgagacccaatgtaggcaacagagagggtcaaatacaaggctggagctattgaggttaaccaagtggtgacacagagtacacacatcccatgaagcctgatctgatttttcaaaagaaacgacatgtaatgaaactccgtctctactaaaaatacaaaaattagatgggcgtggtggcgggcgcctgtaatcccaactactcgggaggttgaggtaggagaattgcttgaacccaggaggcggaggttgcagttgagccgagatcatgccactgcactccagcctgggtgacgcagtgagactctgtctcaaaaaaaaaaaaaaaaaaaaaggaacaacatggactttttggtgcaatctcctgatgttttaaatgttggcaactaatttggaatattttgaataccatgcagaccaagcaacaagggtctgcagaccaaatctgacccgtagatttctgatttctaccttgaggtttcccatatgaaaaaccagaaagaagaccaggcatagtggctcacgcctgtaatcccagctctttggaaggccaaggcaggtggatcacctgaggtcaggagtttgagactagcctgaccattatggtgaaaccccgtctctactaaaaatatgaaaagtagccaggcatgatggcacactcctgtagtctcagctactcaggaggctgagacaggagaattgcttgaaccccagaggcggaggttgcagtgagctgagatcacgccactgcactctagcctgggtgacagagcgagactccatctcaaaaaagaaaaaaaagaaaaagaaaaaagagaccgggctagttgtgggaagacccacccaaggtgcaggttcttgcatcattgcctgtggtaacactgggtgtgttcccttcccctaactcctctgggcttcagtttagcttcctctgcaagtagaaaataactactatctacctcaaagggtggctatcagaaccatataaaaaatgatcgtcaatggacaaataattaaaatgtggtttatacatccattgtatatagatacagtgaattattcagccttaaaaagggagattctgcccatttgccacagcatggaaggacgtgctaagtaagataagccagacacaacaagaaaaacattgcatgatctcacttatatgtactatatacatatatttatttatttattattttacttatttttgagatcgagtctttctctgtcacccaagctggagtgcagtggcgtgatcttggctcattccagcctccacctcttgggttcaggcgattctcctgcctcaggctcccaagtggctgagactacaggcccgtgccaccacgcttggctaatttttatatttttggtagagagggtttcgccatgttggccaggctggtctcgaactcctaacctcagatgatccacccacctcagcctcccaaagtgctgggattacaggcgtgagccaccacgtccagtccaatatatatatttatatatctataaagaggtcaaatacagagatcgagaatgaaacagtggttactatgggtggaagtggagaatggggagacgtgggtcaaagaatactaagtagcagatacacgagatgcacaagtttagaaatctaatgtatgatatgagggctgaagttaagaaaatcgtactcgggattttcggatttttgttacataagtagatttagctgctcttggcacacaggaaagtagctgtgagatgactgacaggttaatctgcttcactttagcaaccaccttactatctgtacgtatcctatgacaacatgttgtaaacctcgaatatacacaataaggtttagtggttcttttgtttttgttttgttttttttgaaatggagtctcgctctgtcacccagactggagtgcaatggtgtgatctcggctcactgcaacctccgcctcccaggttcaagagattctcctgcctcagcctcccaaatagctggaattacaggcacgtgccaccacgcccagctaatttttgtaattttagtagagacggggtttcaccatgttggccaggctggtcttgatctcttgacctcaagatccacctgccttggcctcccaaagtgctgggattacaggtgtgagccacaatgcccggcctaaggtttagttttttaaaaaataaagaagcacatgaaaatatttcctcaagcttaacgtgctacacaaatgcccattatctaatacaggcccagagaagagagggggcgctaacagagaacaggcagtagatggggcctgggagagtgaaaaggaaatgagaagggagtagatgagaagggagagtggaaaggaaatgagttgagtctctgctggtgcgcagaccggaagaatctggacaatagaattcacgtcaggggtggaaatataaatttgggagtcaccagcacacaggttataaaagaggtcatgcagttgattaactgaccgaggtgcatagttgaaaaacaaggagttcagagaaatcctttgggaaaacacccaggtgcacctccactcagggatcagaggagacttgggaaaagaaggtgggagggtctctggagaagcaagcggagcttaaggaagggagaaaaaaatatgcagctaaagggtgagacaggtgtctcagcaaaagagcaaacgtggaagaatgggtcagactgtgttaaaatttaaaaaggaacaggccgggcgcggtggctcacacctgtaatcccagcactgggagaccgaggcaggcagatcacaaggtcaggagttcaagaccagcctggccactatggtgaaacccatctctactaaaaccacaaaaattagctgggcatggtggcgggcgcctgtagtcccagctactcaggaggctgaggcagaagaatcacttgaacccgggaggcggaggttgcagtgagccaagatcatgccactgcactccagcctgggtgacagagaaagactctgtctcaaaaaagataataataaatttaaaaataaataaaataaaaaggagcaaagtaaaaaagttagtaagtgcaggtcaggcacaatggctcacatctgtaattccaacactttgggaggccgaggtgggcggattacctgagctcaggagttcgagaccagcctggccaacatggcaaacgaaaccccatctctaccaaaaatacaaaattagccaggtatggtggtgtgtgcctgtaatctcagctactgcggactgcggggggttggggggggtggggcggaggcaggaggatcgcttgaccctgggagacagaggttgcagtgagccaagatcatgccactgtactccattctgggcggcagagcaagactctctaaaaaacaaaacaaaaaactgaagttagtaaaagcagaaaagtaaaaagagggaaacaggcaagacacatggtggctcacacttataataccagcactttggaaagccaaggcagaaggattgcttgaggccaggagttcgagaccagcctgagaaacataatgagactccggctgtataaaaaataaaaaattggccaggcatggtggcacgtgcctgtagtcccagctgctcaggaggctgagggcaggaggatcgcttgagttggaggttacagtgagctgtgatcagatcactgtacttcatcctgggcaagagaacaagaccctgtgagaaaagagaaagaagagaagagaaggagaggagaaaaacggaaccagaagaaaaaggagagccaggtggacctgcagatggggacctcggggccacatggggccacagccatctacactgacagaagatgatgaccatgaggtataaaagggggtagaaagatggggacgtggggggtggagtaaagcgtgagcaaatagaggccatccttgaggatctgtctactatgtgctaagcacctcactcagtctcccaacaatgtggaaggcaggcattacacccatttcatagcctgctttcaatagggtttttttttgttgttgttgttgtttttgagacggaatctcgctctgtcacccaggctggagtgcagtggcctgatcttggctcaccgcaacctccgcctcccaggttcaaggaattctcctgcctcagcctcccgagtagctgggattacaagcatgcgccaccacgcccagctaattttgtattttagtagagatggggtttctccatgttggtcaagctggtctcgaactcccaacttcaggcctcaggtgttccacctgcctcagcctcccaaggctgggattacagacatgagccaccgcgcctggcctcagtagggtttttatgttttagaagaggccaaagtctccaaggctcattcaaaacaatacacacagaccgggatccagaagagaatcggcctgaagctccctggagctccctggagggttccaccccccttgctccagctcacccagagttctacgattcaaaacagctggaaatgtgtgccctgctctccccaacaagaaaacagaacagaacatggctgtttctgccaagcgaattctgaataagctgcattccatttcattaaaacaattacctgagctccagccaagaattacataaagcttcctcccagcaccaccccctcccccataaaacacacatcatgctgctttcaaataggcagagtgaagctctgagccctcgctagaagacctcatagtcctcgccaagtggccagcctcggcatctctgcacgctgacatagatgacatgaggctgaaagaagaccttggcatgaagccctcccctcatgagagcctgctggctgcccgaaatgtttctagtaggcaccagggccctcacctctgcctcagagccaagagggccactggtgccagaatccagctatttccccaaaacagactggaggtccaagagggccagctttgagtcagcacaaactagacaggagggaccaagggagtggggattccaggagggggagcctgaaggctggaaaactggatggtcagacttgagctataagcaaaagcctggggacactcagccatcactgcccacaggttaatggtgttccactggccacagataaggggttcatgatgtgaggcaaaagacatctcctccccgcccacaggcctcaagctgcccagagaccgttccctgaattatgtaaagccttgctgtggctgggcaccgtggctcacacctgtaatcccagcactttgggaggacaaggcgggcggatcacctgaggtcaggagttcgagaccaggctggccaacatggtgaaaccccatctctactaaaattacaaaaattagtcaggcgtgatgacgcacgcccataatcctagctactgcggaggctgaggcacaagaatcacttgaacctgggaggcagaggttgcagtgagccaagatcacaccattgcactccagcctgggtgacagagtaagactccgtctcaaaaaaaaaaaaaaaagtcttgctctgcatcccatcagcctagacaacccatctcaaactccaaccagagttcggcatctcacatgcttcaaccctggtctgattaatgtcatcatgctcaaataactcatgaggctgcctccacacctatggacacacactgtctctgggcctgtcttttttctgcacaggtcacagcactgtgctccccatttcccagatgatagtcagcagtcactgtcacctgaggcccccccagctactgtctctgctcacccagtcttcccaccacctgctcaatcacaggagaccagcagtcattcaggccaaccataggcaggcgcaggccagcacctaggcccaacaactccaagcccatcatggaaaagcagggtttccttacttttctccaacttttcattataaaaatgtctaagcacacagagaagttgagaggcccgggtactctcacttagattgaatggctgtcattgttttaccactttgtgtaaacgcatggcccttgtgctctctgccctttatgtgtatatcctttttttcattatatcatttaaaactaagttgagctgggtgcagtggctcacacctgtaatctcagcactttgggaggccgaggtgggtggatcacctgaggtcgggagtttgagaccagcctgaccagcctgaccaacatggagaaacctggtttctactaaaaataaaaaaattagccaggcgtggtggtgcatgcctgtaatcccagctactcgggagactgaggcagcagaatcgcttgaacccaggaggcagaggttgtagtgagctgagatggtgccactgcactccagcctgggcaacaagagcaaaactctgcctcaaaacaaacaaacaaaaaaaaacaaataaaactaagttgaggccaggtggggtagctcacacctgtaatcccagcactttgggaggctgaggcaggtggatcacctgaggtcaggagttgaagaccagcctaaacaatatggtgaaaccccacctctactaaaaatacaaaaattagccgggtgtggtggcatgcacccatagtcccagctactcaggaggctgagacaggagaattgcttaagcccaggaggcggaggttgcagtgagccaagatcgcgctgctgcactccagcctgggtgacagggcaagactctgcctcaaaaataaaaaatgaaaaaataaaaataagttgcaagacatcatgacacttcactcctaaatactttagcatgcacctaacaataacaatattctcccataaaaccacaataccacaatcacacaagaaataagcattaaaagtccgtctttaagggaagatttggccactggggttccactgggcctggccaaccgcatgttctgtctaccactggcccagcatccaaggcctccctggagaggccagccctgagcaccactggttaggcaatcggttagttagttggaagacttatcagggtatgaatgtacactcaaggccagatatgagactcccaacaagacccagactgcaaaaggcagagtggaccccgtgaggctgtcgatggagtctcagggcccatcccaggtgaggagggcaccctgaagccatttccatgacttgctttgtgaacatttctgagaaaactcagcttcctgattctctcttcctctccccctcccataggacatccttcattctccaccataaagttttcaacaactccctcctctggatacgggaaagacaaggagcatgttcgggtgcagcggggctgggggcacaggaaggcttctgattcctgagcagaggaggtggcaagggaccacaggggacctgccccaggttctccttggcagtggtgctgtaagctcactgctctgtctcaagagtaacaggtgactggagaggtgaccagggagggaggattggggcctcccctggaacaggagacactccccccaggaccctgcatcccatcctgagtgtgtgtccccaagaaagaacaaaaaggccgggtgcagtggctcacgcctgtaatgccaacactttgggaggccgaggcgggtggatcacctgaagtcgggagttcgagaccagcctgaccaacatggagaaactccgtctctactaaaaatacaaaattagctgggcatggtggctcatgcccccagctacttgggggactgaggcaggagaatcgcttgaacctgggaggtggaggttgtggtgagctgagatcatgccattgccctccagcctgggcaataagagtgaaactcaggaaaaaaaaaaaaaaagaacaaaagacagacaagaagctgcagagaacagggaaatgacagatgtggaagacaacagagaatagggtgggtgcagaaaaatgttagtgtcctagaaacagaaaacagtcaaaccaatgggcaacccatatcagatgcagtattatgaacagaagtgtaaagaatgcaccaggcacaatggctcatgcctgtaatcccagcattttgggaggttgatgcaggcacattgcttgaggccaggtgttcaagaacagcctgggaaacatggtgaaaccctgtctccacaaaaaatttcaaaaattagcggggcgttacagcatatgcctgtagtcctagctactcgggaggctgagggaagaggaacacttgggcctgggaggcagaggctgcagaccctgtctccaaaaaaaagtgtacaaaacagttggctgcaagtcccgctcagcagccagaccacctggattcaaatcctagcactgccattcactagttgtagaacttgggcaagtgggctcacctctctgtgtctcagtttcctcacttataaaacaggtagtagtaatacgactactaataaaacctgcctcatatggccagcttgattcaagcaaacaatgcatgtgaagtgcccagcacagtgcctgcacataataagagctcaataaatattatgagaaaaagttctgtaaacactgtaaaaaagaaaagtaccccctaggccagagtgcagtgatgcgatctcggcttactgcaatctctgcctcccgggttcaagcgattctcctgcctcagcctcctgagtagctgagactacaggcacgcgccaccacgcccagctaatttttgtatttttagtagagattgggtttcaccacattggccaggctggtcttgaactcctgacctcaaaagatgcacccacttcagcctcccaaagtgctgggattacaggtgtgagccaccatgcccggcagattttgttattattaatgaaggcactgagactaggatgatccccggaaaggctgcaatgaggctggaagtttattcaacatctctggagcgaggtaaagacgcaagagaagcttcagagtcagatactccaagcaggatgactaaataggagaggagggctgctcagtggcccaccaataactctggccttccatcagcctctccagccaagggtacacccagtctcttcaatgcatgaccatcactagggaagctggaaaaaaggaatactgagatattccctcaaaagaccttgaacctatagtgacagggctttgggttccagtaggctgagcatttctccatcaagctatgtctgcccaggcagcagacagcttcacatatcagaaagtgtacccgctgaagaatcaaacccaccaaggtttgaatcccagctctgccccttactagcacaagcccaggagaaggtctggcactgatgcagagcccaccaggagggcactatcgctgcatgggtaaatgccgcctctgccacacgcccagcagctgggtgccctgactctgccctaacacacagagggaccacagacaggaaagcccaaagtccagactttccatggaaacagggaggctccatagctcccaatgccccaggcaactcctctgcccccctagcactacccccaaggacaatgaggcactgttttccaaagggtcaagactgctgagaagctgaaagaagacatgtccagattccagcagcaactgggcactgccaacagctggctgttccccctgctagaggatgggaaggcaaagctacccagtcttgcactggacacaccctttgccatttcctgggatgggcccctagggcagagattgttaaaggtaactatcaattactcagcaggccccaaggctcatccccctggttagtcaccagcacctaccaccttatgatgattaagataaccggatctggaattggatgagcctgggttcaaatcccagcactaccactaaacttccctgagctcaggtttccacatgtataaagtggagcgaaaacacctccctttctgaaaggttgtgatacagctcgtaaagtgctgagtacagtgcctgtctcccatgaagcgcacatgatcatgattagaccacagttgtggtcaaagcccccaccaagtacactgagaacatgaacagaggaagagcaagcaatcgggttagaacacacagtcagagtgcatctcagtgttgtgggaactctgtccaggaaactccggccagaacttgaacagagcgaactctgggccaaaccagcatctaaacagtaataagaaaagccaccaagcagccaccccaaagaacaaagtggagagaacacacagggaagggcagaacacgctgtgttgatatttttctgctcagagagctataaatttgtaacttattaagcagcacatggtgagtctgtcattggcaactatgggaaggagaagagttccccattttttattagaccaaaaaacaaagtcacagaggaggtgatgcaccctctggccttgctaccggacacaccataaactctcccctgtgttagggaccaggaggcacacggctgagagcacgctcaggagaaaaataaaaacaagaggtctgggctttgtgtccaccctaaggaaaacagctgagccaccctaaggaaaacagctgatggcagtgtgctgagccgccatccagacagctgacggggccccagtgcaaaggcaaattcctctcccctcctgcacaccccattcctcccaccccaggctccggtcagtcaggcgtggcttgccccttgggagctcaggccaaggaagtcgggcagcccggatgtaagcaactgggagtctatggtagaaagcagtagaagttacaggtgatcgccatcacccagtggcaacccctccttcaagtgcccttgcctcctccccaggaaaaaaagtcttctcggtatacaagagccacagatctgggagctaggaattgggcttccagttatggttttgtcatttcatggctgtgcagccttgggcaagagaatcagcctctcttcgtctcggctttctcaatctgtaaaaaggcaggtggtcatgacagcattggctttaaggtggaatctgataaaagggttgttgtgaggatatcacaaatcgaggtagagggaagtactccacaaacagcaatttaaatccctacaatcccctctcccgtatacagtactctctttcctttcagaactcagtttcctggccctaaatggaagactgtcagaagacaggaattccagatttcgatggcgagctctacaaagactttctcagtccttgaaacagcacggggactgccgagaagcaacagaactgcaccagcactttagaaactgtaactttgctcccagttcccactgggaaagcactgagactcttagatcctggttcaaagaacatcccccagcctccttccagctgagctatttttatgtgaaaaaaaaaaatacctgcctggaagccatgccaaccttgagcacactggaaaaatgggtgccaagcctgacccaaaggcagaaccacgcttggcagccatctcactctgcaaaacaggcaggaccctacaccaaccccagctccaggatctcaggggcaccctgatcccaaaaggaagctggagggaagcagtcaagtccagcacctacaaatagccagtcttaacttagtgcccggcgctgcttggtagaggtccatcagtcctgtctgctgaatctactcctcagagcctgggacagaggaagcatcagtggtcacacaagccacccacagtccagagaggaaagacaaggctcctgcagagaagaaacgttgcccccctcctcacctcccaagctcagggccctccagctacaggcgtgaaggggagggagagacagcgaatcctcccactcctgcgttcacgccacccaaggcattcctagaaccctggcaccaacccccttgggtttagagtcggcttccaggagatactttctttcccctaacaccagatcaagactggactgaaaagagtagccttggggctccaataacaggaaaacagtaaaactctgttctgggcatcctgtcctctttcacctgcgtggcttccagcagggcctgacgcagagagggtggaggggactctgctagccaggacacgttcagggatggtcataccttggggcccaccttccacctcattcccctggcatttcaccagaatctaggggtggggagagaatcagaactcccaaattaccgttctagacttagataccatggtagacggactggtctgtgaattgaggggctggtccacagagcggggaggtcagtgagagaaaatgagtgatgggtccttgaaacggggtgaccagatttgaagtggggggtcagaagagcaggcagactgggaaacttgtctttgaaatgggggtgtggtcatcacacgctcatctctagcttttgcatctgacttgtgaaatgaaaggggtgggctccgaggggttatccctgaaggggggtgctagtctgtgaagtggggggcggccctggagggacggggagcaggtcgaggaaatgagggagcagcccatgagatcgggcagctgctccccgagttgggcggtcgatctgtgaggtgggggtggggagaggtctgcgaggtgagggtcccgtagctgacgaggtggtctgccgcaggaagtctcgtccctgcagcggacggggtgggtccctgaggggcgggctggtccctggggcccttctgggagatggtgatgggtccccgaggtcgggggtccagaggtgaagccgtcccagacggggggtcgctgctgtgcggtcggtgccggggccggcctggcccgagactaaggcccggttagggatcccagccccgcggagccccggccggcagggacaggagctgaggccggggccgccgagggtgggatcccgcggcccctgccgctcgctggcgccctcctggccccaagctgcgcgcctctcgcctcctcctccctcggcctcccgctcactcaccgaggtcgtccatggccggaccacgggcgccggctcagggtcgcgctagctgcccgtcccggggccgctcgtctatgccccgcaacttttccgccgcgagcctcggcccggaacggaacgcgccgccgccgcgcgcgcccgcgcccgcgcccgccgcgcgccccgcccccggccgccccctgtgcacgcgcgccccgcccccggacacccccgcgagcttgctggccccgccccctgcgcacgctggtcccgcccccgccaagagcccgggcagtgggcgtcgctgggcggggcggtggcgccccctcgcggctaagcgggcaggtgggcggctcccaggcctccagccactcccatccatctttctgtccctctcaaagtcacttgcctgaccctgcggatgacaaatccgtccacagtcagccatgtgtctgtgcattcgtcagccactgggtcatcacatgcctgtccactggacagtcagttttgcccacctgtccgtctgtcacctgtaggtcaccacccaggaggaccataaatcagtaccaggcaaggcccggagcccgtggctgacctttcctggggtcgtcctctggatcaatggcagtgcagctcgcagttcaccctttctggcccaaacccaatacctgtgtggttccatctctcttaatattacttccacacagccaccctccctagacacttttccaaaactgcatggggcagaggggtccccagattagacattaaagggaaaactacaggaaagtcacacccagtgctcccacacactcggaaattgggtaataataacaactaccatttattgagtgtctgaatagacagacactatatagctattctctaaattaatcctcctagaggtacttccctacccgttgggatgggtgatggcagtttgtggattttatataaaactgctctgcaagtacagcttcgagttccccttgtccctcaagaatccaggccttctgggtcagatcaggtcctccagaaagcagatgagatgctgagataaagctaggggtaatgcccgtgacagagaaggggaaataagcagggttgggcaaggagactcagatctgacaaacaggtcaacccatcagggaattccaggacaaaaaaaatgagaagtctccttgggcagaagtatccgggttccaatgctcccaccatgttcagtcattttataaaggcagatccaagcagcttctgtggctgccacattctcctataataaattcaagaccaaagactgttcctcaaacactctattgcgtggttttccagcatcttgcacatacctctattttgttttagtttttgtgtttttgtttttgtttgagatggagtcccaatctgtcgcccaggttggagtgcagtggtgcaatctcagctcactgcaacctccgcctcccaggttcaagtgattctcctgcctcctgctgggattacaggcgcataccaccatgcctggctaatttttgtatttttagtagagatggggtttcaccatgttggccaggctggtcttgaactcctgatctcaggtgatctcctgcctcctggtgggattacaggcgtgtactaccatgcctggctaatttttgtatttttagtagagacagggtttcaccatgttggccaggctggtcttgaactcctgacttcaggtgatccgcccccctcagcctcccaaagtgctgggattacaggtgtgagccaccacgcccagcctgtttttgtgtttttaagacacagtcttgctttgttgcgtaggctgggatgatgaataagactaacatgatgtctaccttcttgaatctaaaggtgcacgcaaaagagcaaagtggttagcatgaaggatgagtagcctcgccccactcccagctgtgtggaacagcatgtgcaaaggtctgtagacaagacatttaatactgaccacaagcctaggagatgagcattgttagccccttttacagctggaagagttgagagtcagaggttgaattactccaggtcatacagctaataagtaaggaaactgagatttgaacctggggaggcttatgccaaggcctggttatgaaacggctaagtgaaactgctaacaacttagaccaaccccagggcatacgcttgtccacttctccaaaggtctaaaacctttctttttcaaagctgtgtggtctggaaatgcgaggcacccattgaatgggcaagtttcccactgctatgcagagttctaaagagaactgaagcttcagagttgagtgctggtgcactcgaacactcaggtccctgccagggatttcctcatgtaaatcattcctaaacccccatttcctccctggcttccttcttcccttggactctcaccccacagcaattaaacttggtgtctagttcaggctgctacaacaaaatactgtagaccgagtgacttataaacaacagaaattattttttcacagttttggaggctgaaagttcaagatcagggtgccagcacagtcaggttctggtgagggccctcttctgggttgcagactgttgactttttgtaccctcacacggctcaaagagggtccctttaataaaggcactaactaatctctttcacgagggccctgccctcatgacctaatcacctgtcaggcctcacctcctaacactatcgaattgagattagatttcaacatatgaattttcaaggatatgaacattcagtcccttgcatttgataaaatcaatcaggttttttcattcttcctaaagattaaacgacattgacagagcagatggacaaccctgctgacttcttgctagtggttcatcttgggcaatttactctgtgcctcagtttcttcccctatagaaaggttaatagtagctacctctcagagtcctcataggactaaataagaaacgacacacctagtacttagaatggtccttgtcaccacaaaataacactcttcactcagcaatagaaacagaactcgaccaggctcacacctgtaatcccagcactttggaaggccaaggcgggcggatcacttgaggtcaggagttcgagaccagcctggccgacatggcgaaacaccatctctactaaaaatatataaattagctgggcatagtggtgtgcaccggtaattccagctgctcaggaggctgaggcaggagaatcacctgaacccaggagacggaggttgcagtgagtcgagactgtgccactgcactcctgcctgcgcgacagagtgagactctgtcaaaaaaaaaaacaaagaaagaaagaaggaaggaaggaagaaaggaaggaaggaaggatggaaggaaggaaggaaggaaagaaagagagagaaaagaaacagaatgcaagccggatatgcaatcaaaacttttcttttttttctttcttttttttgagacagagtctcactctgtcgcccagggtggagtgcagcggcatgatctcagctcactgcaacctctgcctcccgggttcaagtgattctcctgcctcagcctcctgagtagctaggattacaggcacccgctatcacacccgactaatttttgtttttgtttttttttttttttttgagacggagtcttgctctgtcgcccaggctggagtgcggtggcgcgatctcggctcactgcacgctctgcctcccaggttcatgccattctcctgcctcagcctcccaagtagctgggactacaggcgcccgccaccacgcccagctatttttttctatttttagtagagacggggtttcaccgtgttagctaggatggtctcgatctcctgacctcgtgatccgcccatctcggcctctcaaagtgctgggattacaggcgtgagccaccgcgcctggccaatttttgcatttctttaagtagagatggggttcccccatgtgcggccggctttttttggaactccctgacctcaggcgatgtcattctgcttcacttacaaaagaggttggcactgcctgtggtgagccgccgcgccccgtcgcgtgccgacgcctttttatacccgagccntggacatgagtcctgtctcccccgcacccccccactcttgtgcctggcgcagagcgttgatcccgcggccttcgcgccctgtcctgcacccctcctattcgttgcgcgcttcccgctctcgccaggggtgcttggcgtgtacctcgcccgctctgggctgcctgcgccctagacaatctacacgcggctcgtgggttctcgcggcgtcaacagggggcagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatcccattgctacacattacttatcctctctatatttcagtttccttgtttgttgaatgcttcataggatttctgggaagattaaatgaaatgttaaaaaaacaagatctgataatgctgagccagcattcacggcagtaagagggctctgagtagcacctgctcctttcagaaagccttagtgcaccccagtacatctcagtccctaccactcattcaaagtctgtgcactcctgatgaggcacaacctgcctagcatctgaaggtttgggaagactctctactaccgccaataggcggttaaatgctactgcttccccaagagtagatctaatagcaactaatctatttactcatcaagtaatcaagtttcataattaagtttcctgcgtaagtgaaatttccaggaaaacaaaattcacccctttacatacctttctatttatgtatgtatgtacatacatacatacatttctatttagttattggttatgatggagttgttcctaaaatagacacattttctggggttggttttttgttgttgttgttgttgttgttgttttactttttttttttgagacagggtcttgctgtgttgcctaggctggtctcaaacttctgggctcaagtgatcctcccaccttagcttcccaagcagctgggattacaggtgtgcagcaccatacctagctttattaattacaggctcctgaacccacggtctctgtgacagtggtacagcaagcatacctctcacttggtgagttgcttcactttcttggacctcagaattatataaaacactgaacaggaccagatgagcttttcagatcaattaatgattgactaaacttctacctcaccacctgtctttcccagtcagggttctgtaagataagttagcctacataccccaagacacccattctgatgataagttaacttatctcctgtgtgtttaagctaacatttgtcatatactgtccttgggagaactgaaaaaaagtcacttgaatctttctgtgttctggtttggctgaggaaccctggttgagaaagacttcagttgtaaactagaagtccctgctggttaaaactcaggaacaataacttaagtaactgtgagaaatgctgctacggtggcattggaaagtgctgtggcaacagggaggacaaagtggctccatttgtgattctgtcagcccttggactcactgatgggaccgttctcccactgcttttctttctttgagcttcttttctgctatctggctggaaggaatagcttcttgtggacccctctacttccatctaaaagccttctcccttcctcctactttatttctagtttgatgcagactggaatgggggctaattaacttggttaaaagttctgagccaggcaaggtggctcacatctatattcccaacacttcaggaggccgaagggggtgaattgtttgagcccaggagttcaagaccagcctgggaaacatggtgagaccccatctcccctaaaaaatacaaaagttagccaggggtggtggcgtgtgcctatagtctcagctactcgggaggctgaggtgggaggatcacttgagttcaggaggtggagtctgcagtgagccaagattgcgccactgcactgcagcctgggcaacagaatgagaaaaaaaaagttctggattcaggccaggcatgatggctcatgcctataatgccagcactttgggaggccgaggcaggaggatcacttgagcccaggagttcgagaccagcttgggcaacacagcaagatcctgtctccaccaaaaaaaaagtaacaaagaaaaaaattagctggccataggggtacacacctgtagtcccagctacttgagaggctgagacaggaggatggcttgagcctaagagtttgaagtttttggttcataagactatgagggacatttaagtatttggctgcagagttgctgtcaactcattctctggatttcagatgaaagagagtaaagttcctaggaatcgactttagctggcatatcttagaacagtatttggcagcagaagctctgagttccaaattctctgcttattacctgtgaaactttgggcacattatataacctttctgaacctcagttttttccatctatataaaatagataacttgtattgaccttccaggactgcatgtgaaaattgaaataatttaggccgggcacggtggctcatgcctgcaatcccagcactttgggaggccagggcaggcggatgacctgaggtcaggagttcaagagcagcctgaccaatatggtgaaaccccgtctctactaaaaatacaaaaattagctgggcatggtgccgggcacctgtagtcccagctacttgggaggctgagacaggagaattgcttcaacctgggaggcagaggttgcagtgagctgagatcgtgccactgcatccagcctggacgacagagtgagactccagctcaaaaaaaaaaaaaaaaaaagaaaaaaaaaaaagaatttatataatttattagcccctggcatgtaagcatactgtttttacctcaaaccaaatgacatgttattagtgtgcaaaggggtttctattagccagtcaaggcgttttttgtttgtttgtttgtttttttgagatggagtcttgctctgttgcccaggctggagtgcagtgacgtgatctcggctcactgcaacctctgctccccaggttcaagcaattcttctgtctcagcctcccgaacagctaggactacaggagtgcgccaccatgcccggctaatttttgtatttttagtagagaaggagtttcaccatattggtcaggctggtctcgaactcctggcctcaggtgatccacctgcctcagcctcccaaagtgctgggattacaggcgtgaaccaccacgcccagccttgttttgtattttttaagacggagtctcactctgtcgcccaggctggagtgcagtggctccatcttggctgactgcaacctctgccgtcctggttcaaccgattctcctgcctcagcctcccgagtagctgggattacaggcgcctgccaccttgcctggctaattttgtatttttagtacagatggggtttcaccatcttggccaggctggtcttcaactcctgaccccgtgatccacccacctcagcttcccaaagtgctggaattacaggtgtgagccaccgcgcccagtctaccttttttttttttttttttttttgagatggagtcttgctctgtcgcccaggctggagtgcagtggcgtgatctcagctcactgcaacctccgcctcctgatttcaagcaattctcctgcctcagccttcagagtagccgggattacaggcatgcaccaccatgcccggcaaatttttgtattttttaagtagaaacagggtttcgccatgttggccaggctggtcttgaactcctgacctaaagtgatctgcctgcctcggcctcccaaaatgctgggattacaggagtgagccattatgcccggccaagtcagggcttttatagctaagatgcctactacctaaaacatttaagcaacttggcctcctgcaaagaaggatggtgagaagaatggccattatgccatcaactaggtggtgacccaagagtacaccattaatattcacaagtgtatccatggagtgggcttcaagaagtgtgcccctcaggctcttaaagagaccggaaatttgcaatgaaggagatagaaaactccagatatgtgcattgataccaggctcaacaaagctgtctgggccaaagtagtaaggaatgtccatactgtgtccatgtgcagtggatggtccagaaaacataatgaggttagaaattcaccaaataagctctatactttggttatatacttgttaccactttcacaaatctacagtcagtgtggatgggaactaactgctgatcatcaaatacatcaaatgaagttataaaaactacaaaaaaataaaaaataaaaggtttaatacttgtcttcactttacattctgtgtgttcaaagcattaaagtcctacagatgtcacattaaaatgattaatgggaattattaacccaaactggtttccaaatttatgaaaaacagtacagatcactgaatacgaggttgagatgctagctactggatccaaattcctcatcttttttcacgaccttttcccttattaatgatggttatatttctttgtatttaccctctagataacttggggaaattctgatgactctgtgcttctagtccctcctttcctagagatattaataaagaacactgggaccgggcatggtggctcatgcctgtaatcccagcactttgggaggccaaggtgggcagatcacctgaggtcgggagtttgagaccagcctgaccaacatggagaaaccctgtctctactaaaaatacaaaattagctgggcgtggtggcgtgcacctgtaatcccagctacttgggaggctgaggcaggagaatcgcttgaacctgggaggcagaggttgtggtgagctgagatcgcgccattgcactccagcctgggcaacgtgagcaaaactctgtctctaaaaaaaaaaaaattcattaaacatttactgtggccgggcacggcagctcaaggctgtattcccggcactttgggaggctgaggcaggcagatcacctgaggtcaggagttcaagacgagccttgccaacatggtgaaacccctctctactaaaaatacaaaaattaaccaggcatggtggtgcatgcctgtaatcccgggtgctcgggaagctgaggcaagagaatctcaaacccaggaggcagaggttgcagtgagccgagatcacgccactgcctccagcgtgggcaacagagtgagactccatctcaaaaaaacaaaacaaaacaaaacaaaacacatttactgaatactcagtgccaaccactgagaacatgataaggaaaaacagacatgctgtggaaggtgggtgagcaggagaggggcagagactcaacacatcccttaaatagatgtataaacgcatgtataaatcagcccttttggatatcacgagagccacaggtagagaacctaagtatagccaggcacagtggctcacgcctgtaatcagcacctttgggaggctgaggtgggcagatcacgaggtcaggagatcgagaccatcttggctacggtgaaacctcatctctactaaaaatacaaaaaattagccaggcgtggtagtgggcacctgtagacccagctacttgggaggctgaggcaggagaatggcatgaacccaggaggcggaacttgcagtgagccaagatcacgccactgcactccagcctcagcgacagagcgagactcttgtctcaattaaaaaaaaaaaaaaagaacctaagtataaaagaatgaagacttgtggctcacgcctataatcccagcactttgggaggccgaggcgggtggactgtgaggtcatgagttcgagaccagcctggccaacatggtgaaaccccgtctctattaaaaatacaaaaattagctgggcgtggtggcgggcgcctgtagtcccagctactcgggaggctgaggcaagagaatcacttgaaaccggaaggtggaggttgcagtgagctgagattgcaccactgtactccagcctgggtggaagagtgaaactccgtctcaaaaaaaaaaaaaaaaaaaaaaggaatggacttttttggccagtgcagtgactcatacctgtaatcccagcactttgggaggcgaagatgggcggatcacttgaggccaggggttcgagaccagcctggtcaacatggtgaaaccctgtctctactaaaaatgcaaaaactagctgagtgtggtggcgggtgcctgtaatcccagctactccggaggctgaggcacaaaaatcacttgaacctggagggtggaggttgcagtgagccaagatcatgccactgcactccagcctgggtgatggggcaggactccacctcaaaaaaaaaaaaaaaactttcttgaggaagtgggaggctgaggcaggaggattgcttgagaccaggagtttgagaccatatggggcaacatggcaagaccccgtttctacaaaaattttaagtattagccaggtgtggtggtgcacacctatagtcccagctatttgggaggctgaggcaggaggatctcttgagtctagaagtttgcgaccagcctgggcaacatagtgagaccccgtcccaaaggaaaaagaaaattgcaaagtagagaagacatttgaaagaatcaaacacggccaggtgctgtggctcatgcctgtaatcccagtactttaggaggctgagatgggtggatcacctttgctcaggagtccagacaagcctggggaacatggcaaaatcccgtctctatcaaaaatacaaaaaattagccaggccaagtggcacgcgcctgtggtcctgtacttgggaggctgagatgggaggctctcttgagtctgggaggtggacattacaatgagctgagatcatgccactgcactctaacctgggtgatagagtgagactccatctcaaaaacaaataaaataaaaattcaaggcaggaataaaacagtaactacataatgagctcacattttaataaaagagatataacaaatgaacaaaagtccattaaaatgttagggaaaaaacccaataggatgagttactaactagaaggggagaagggatttggagtggttaggagagccctttctgagaagataagctgagacctgtgccaagagggaggcagccatgcaaatactgagaggaaggaaaaaaacgaagggccagtgcagagatctagagaggaaaagaacttgtcttgctggagaagcagtcaaggtagccaaggagagtactgagaagagtacgttggagtgagtaggtagggactctatggagtagggccttaaaggcgatgattaggccaggcgcggtggctcacacctgtaatcccagcactttgggaggccgaggcgggtggatcacggtcaggagttcaagaccaacctggccaagatggtgaaaccacgtctctactaaaaatacaaaaaaaataagccgggcctggtggcagtcgcctgtaatcccagctactcgggaggctgaggcagagaattgcttgaacacgggaggcggaggttgcagtgagccgagatcgagccactgcactccagcctaggcaacacaacgagactccgtctcaaaaaaaaaaaacaaaacaaacaaacaaaaaaaaaacaaaggcagtgattagcagttcgggttttgtttccacttacactagcgagagcatcagtaatgaacaaggggaagagtgaagccactgactcgcgaggtgactgtgggcaagttcctgaatcttgctaacactctttaaccccctggaaaactgttcgctaatcgtcacattaaacggctgcgaacgggccacggtcaaggcttcggggctgcagccgcgagtttacctgtcctccaggaccgattccatgggctccaccccgtctgtgtccacggcgcgtagccggtcggcgaaggcgatagctttctccagtcgcgccactgcctcgcggctgccgaagtccacaagcgctagacgctccaggtgctcgatcaccgcagccgtgatccggccactgccctggaggagggatgaggcggggagtgtgggtcaccggcgctccgaagtgcctcccggcttgctccgccacccgcctagatggccctggcctttacctgaggatccgccttggaggtgaagccctggcgcccgcccagaggggcccgaaggcccagccacaccaaccgcgaccacatttcttccttccttggcccccgcagtgcgcccgcgcgtaacgccgagcgacgcgcctgagagtgatgacatcagagtgcgccgtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcaggtgagccctcccgcctctgttcccaggccctgcattctcggcgctgtgtcccaccacactcatcgtattttacggggattgggactggactggaagggtggagaaaagtcgcagtgaggccagtggcaggagctcgctcccctaccatcaccaccgaggccacttgggtgtctctccgaatgacaaatattggggcagtgcttttcaagaagcacagtcacatcctttggttcatttggtgttcaccctaaactcgcaaggtgggcatagttactcatattttatacataaaaaactaacacccagaaataggaagtgattaatccgagttcactagcatcaggtttccttggttctttcgcaggtggtgcacttttccactattactgctggggtctgggcgggattatacttcagaattcagactggagggtcacatttttttgttgttataaacccttcgttagcctgtttctctctcttgaccagtccccgcaactgcagccaggaaatgtttattctggcccaatggatgtggaactgctttgaattgttaagaacagcaccgggcaaagcacttccaataagttaacccaacacatcctcacagcaattccccgaggtagttgctgtcttcatcccatttacagttagtcacatagccagtaagtcctggaacccagatttgaacctaagtctttcactaacacaaagtgatgattatttttcaaatttcacttaattttaacggttccctcacaactccttttccagtctccctcaggtcttatacttgatttattcattatggtacttctggtttttatttatttttgaggcagagtctcactctgtctcccagcctggagtgcaatggcacaatctcagctcactgcaacctccgcctcccaggttcaagctattctcatgcctcagccacccgagtagctgggcttacaggcatgcgccaccatgcccagctaatttttgtatttttagtataaacagggtctcgccatgttggccaggttggtctctaacttctggcctcaagtgatccacctgccttggtctcccaaaatgctgcgattataggcgtgagccaccacacctgaccggtacttgttttttaaaaagtatgtggtttgaatcatggttataagtctttataatcagcttgattttacttttgtactgtcatattttatttacaaagcttgcaacttaagcttcatgtaggtctttataatgtgttttctcctcctaccagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcattatttgcctctggaactcagtgcattttatggaactattaccctgttaccctacaaacctcatatatacagtggggagagttttgtgttttgtaacttaaaggtgaagaaaaagtgacttgtcttaagctaggtggtacagtatggcaatcagaaacctcacattttttttttttgagacagtctggttctgtcacccaggctggagtgcagtggcgcaatcttgtcttactgcaaactccacctcctgggttccaatgattctcctgcctcagtctcccaagtagctgggattacaggcatgcatcaccatgcccagctagtttttgtatttttagtagagatggggtttcaccatgttggctggtcttgaactcttgacctcccgaagtgctgggattacaggcatgagccaccgcacccagccaaaacctcactgatttctaaaatttccacaataggctatacaaatacactatggtaccaaaaaaggatcaggagagcacttacttacctcagaatgtcacgtaatccccacaattaattgagtaatttggttttattagatacccaaagtagtatgaaacttgaattacaggccgggtatggtggctcatgcctgtagtcttaacactttgggaagctgggatgggcggatcacttgagctcaggaatttgagaccagcctgggcaacatagcgaaaccctgtctctacaaaaaaattagctgggtatggtggtgtgtgcctgtagtcccagctactctaaaggctgaggtgggagaattacctgagcctgagaggtggagactgcagtgagctgtgattgtaccactgcactccaggctgggtgacacagcaagaccctgtctgaaaaataaaccaagaaacttgatttatagaaggccctaattctattgtcttttctccactttaccaattgctacatcatatttaatgtgacttgtccttaatgtcatttcaaaacattcttcatttatattttatgactggctagggtccattatccaaggattataaaagatgtttggaacccagccaagggaggccaggcagcaagctgaagtataatgcatctgtcctaaactcagactggccacaaccaaaacagctctatagggactcagaagtgcaggctgttatattacaaaatggcaaagacaatgagattctctattccgttaattattacaaaatggcaaagacaatgagattctctattccgtactgtatatgccttacttttgcgttaccagtttaatgtaatacaatatgaaataccttgttgcctcttgaaccttaccacgaaagtgttcctttgaaccttaagaataaaccagctggctgggcgcggtggctcacgccagtaatcccagcactttgggagactgaggtgggcagatcacctgaggttgggagtttgagactagcctgaccaacatggagaaaccccatctctacttaaaatacaaaaaattagccaggtgtggtggcacatgcctgtaatcacagctactcaggagggtgaggcaggagaattgcttgaacctgggaggtggaggttgtggtgagccaagatcatgccattgcactccagcctgggcaacaaaagcgaaactctgtctcaaaaaataaaataaaataaaataaaccagctctggccaggcacagtggctcagacctgtaatcctagcactttgggaggctgaggtgggcagatcacctgaggttaggagctcaagaccagcctggccaacatgtgaaaccttgtctctactaaaaacacaaaaaattagcccagcgtggtggcacgtgcctgtagtcccagctattcgggaggctgaggcaggagaattgcttcaacctgggaggcagaggttgcggtgagccaagatcgcgccattgcactccagcctgggcaacaagagtgaaactccgtctcaaaaaaataaaaaataaaataaaaaaataaaaacagacacaaagtgctctccctcactggctcaagctctggtgattggagaggtgagaaggggggccgggtgcagtggctcacacctgtaatcccagcactttgggaggccaaggcaggcggatcacctgaggtcgggagtttgagaccagccttaccaacatggagaaaccccgtctctactaaaaatacaaaaaaaattagtcgggtgtggtagagcctgcctgtaatcccggctactcaggaggctgaggcaggagaatcgcttgagaccaggaggtggaggttgcggtgagccaagatcatgccattgcactccaacctgggcaatgagagtgaaacttgctctcaaaaaaaaaaaaaaaaaaaaaaaaaagaggtgagaagagaaccaggagacactgtgtcctggaaaccaagaaggagaagcattttagaaggaatggtaatagacagtggcaaattcagcagatgagcaagggaaagtatagagggaaaaacgcaggtttgggcattaaggaaatcagcaggcaaggcatttgcagtcatgttaaggataaaagtgagctatagcagaaggttaggaaggagtgtataggaaggaaattgatgggctgggcgcagtggctcacacctgtaatcccagcactttgggaggccaaggagggaggatcacttgaggccaggagtttgagaccagcctgggcgacacagtgaaacaccgtctctaccaaaactacaaaaattagctgggcgagatggcgcgtgtttgtagtgcagtccctgccactcaggaggatgaggtgggaggataacctgagcccaggaggttgaggctgcagtgagctgagatcgtgccacttgcattccagcctgggcaacagccagaccctgtctccaaaaataaaaaaaataaaatagaaagtatggctaaaatggggtggggattgtgtgttagggaaagaaagcagcgatggaagggctgaaaatggttggagatgaaacgtctctgacagctttgtgcctcccaagggcatactgttcagtcggcgtcttccttggttccagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatctgacttggcaagagtggtaaccaccccttgtgcgggattgggagtcctggagagacaccctgtttggtttaactttttctagatctagagaacctagacattcttatgtgtgtcttttctccgtgcaggtatactctggttacaggtttatcctcactgcctgggagaagaagctcccgattgcaattctgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgcttcatgaatttgtgtgtcattcttgcacaggggtcatactaacctctgtatcattccaattttagtatatgtgctgctgaagagagcactaaaactaatttttttttttttttgagacaggatctggctctgtcacccaggccgaagtgcaatggcctgacctcagctcactgcaacttctgcctgccaggttcaagccatcctcccacctctgcctcccaagtagctaggactacaggcgtgcaccaccatacccaactaattgtttttattttttgtagagacagggtctcactttgtcacccaggctggtctcgaagtcctgagctcaagctctccacccgcctcagcctcccaaagtgctgactttataggcacgagctaccacacccggccaaaacttttttttttgagacagtctcgctctgttgcccaggctggagtgcagtggtgtgatcttggctcactgcatcctctgcctcctggattcaagtgattctcctgcctcagcctcccaagtagctgagattacaggcacgtaccactacacctggctaattttttatagttttggtagagacgaggtttcaccatattggccaagctggtctcaaactcctgacctcaagtgatctgcctgccttggcctcccaaagtgctgggattacaggcgtgaaccaccgtgcccgggtgttttgttttgttttgttttgtctttgagatggagtctcgctctgtagcccaggctagagtgcagtggcatgatcttggctcactgcaacctctgcctcccagattcaagcaattctcctggctcagcctcccgagtagctgggactacaggtgcccaccaccatgcccggctaatttttgtattttcagttcaccatgttggccaggctggtcttgaactcctggcctcaagtgatccacctgccttagcctccaaaagtgctgggattacaggcatgagccaccaagcccggccagtggtcatctttccatgtcctaagtgctatggtattgtgactgataggctgatgttcacaagcattccctggaccctgctcttcgtttatctttgcattcacttgtttcatttctttacagatccctaaggagcatccgttttttctcaaactaatcaaagctcgctgagtgcagcctgtagggggcaacaaatcaacacctctctgccagcccatttctcaacccggcagctttcccagccaaagagttaaggtctaggctgaggagatttgccccagaacaaagactttttcaaagaagcagctgcattcatttcctttttatctcacctggcaggagaaatggcctgggacatatgtaggccagagtggtctctggagcgccaacccaaggatctcactaattttgtggggtaagggtagaaggaaatgactaaatttataatccaaatggttaagtgtctttaactgaaccattttgatataatttttgaaaaaataagcaatggccatgaattaattttttataaccaagagataaaggaatctttcaaaaatagcacagcagctgggcgtggtggctcaagcctgtaatctcagcactttgggaggccaaagcgggcggatcacgaggtcatgagatcgagaccatcctggctaacacggtgaaaccccgtctctattaaaaatacaaaaaaatgggccaggcacagtggctcacttctgtaatcccagcactttaggaggccaagacaggcggatcacaaggtcaggagtttgagaccagtctggctaacacgatgaaaccccttccctactaaaaacacaaaaaaattagctgggcgtggtggcgggtgcctgtaatcccagttacttgggagactgaggcaggagaatcgcttgaacctgggaggcagaggttgcagtgagccaagatcacgccactgcactccagcctgggtgacagagcgagactcaaaaaacaaacaaacaaacaaaattagccaggcgtcgtggcaggcgcctatcgttccagctacttgggaggctgaggcaggagaacggtgtgaacccgggaggcggagcttgcagtgagctgacatcgcgccactgcactccagcttgggcgacagagcaagactccgtctcaaaaaaaataaaaataaaaaataaaaaataaaaatagcacaccagggccaggcacagcggctcacgcctgtaatccctgcactttgggaggcataggcgggtggatcacaaggtcaggagatggagaccatcctggccaacatgatgaaaccccgtctctactaaaaatacaaaaattagccaggcatggtgggatgtgcttgtagtcccagctactcaggaggctgacgcaggagaatcgcttgaaccagggaggcggaggttgcagtgagccgagattgtgccactgaacggcctgggtgaaagagaaagactctgtctcaaaaacaaaacaaaacaaaacaaaaaaaccacactaggtatgtggattgtatgtttatatatttaattatatatatatatattttttgagacggatctcgctctttctcttttgcccaggctggagtgcagtggcgcaatcttggctcactgcaagctctgcctcctgggttcatgggactacgggcgccagccaccacgcccagctaacttttttgtatttttaatagagacggggtttcgctgtgttagccaggatggtcttgatctcctgacctcgtgatccacccgcctcagcctcccaaagtgtacctgtttgtcttttttaaaaaagattgcaaatgaggctcggtgggaggccgaggtgggcagatcacctgaggtcaggagttccagactagcctggccaacatggtgaaaactgtctctactgaaaatacaaaaattagccgggcgtagtggccagtgcctgtaaccccagctactcgggaggctgaggctgaagaatcgcttgagcagaggaggcagaggctgcagtgagccaaggtcatgccactgcactctggcccgggcgatagagcaagactccgtctcaaaaaaaaaattatatagacacatatatatacataaaataataataataggcccggcgcggtggcttatgtgagtctgtaatcccagcactttggagggctgaggcgggtggatcacccgaagtcaggagttcgaaaccagccagcctgaccaacatggtgaaaccctgcctctactaaaaatacagaattagctgggcatggtagccggcgcctgtaatcccagctacttgggaggccgaggcaggagaatcgcttgaacctgggaggcggaggttgcagtgagctgagatagcatcattgcactccagcctgggcaacaagagcaaaactccgtctcaaaaaataaaataaaataaaaataatagtaataaaaagtaaaaaaatagaaaaagattacaaatcaaggcttgcttaatgtaataaagactttctcaagaaaaattaaagtgcattatcctttcctctccttccccttaggaaaacagtatttatcgaacatttactatacaacaagcacttaggaagcatttacacaacatatttggacacttaattcccacaaccctatgataagagcactattatttcgggtaacctgcccaaggtcaccaagagggtgactaggccaggaatgaaggccagtctgtccagttctgagttcgctctcggactttctgctgtagaaacccggtggggtaacagcagctgtacctgcggaagaaggacaaagctcaagaaacttccagaagtgacccaggctgggttctgaaagatgaacatgccttcacgaggtaggaaaagggaggaaaccactcatgcaaaaagcatggctgttacaccaccaaatctcttcggttttttttttcccttcaatgtgggggtggaaatttaagtgtagatttggggcgcctcagaggcctgtggctcgcccaacatcccctggcctctctgcttggccacctctcctctcagctcccctttgttccctgcaccccactttccctaccccctaatccgtccccgggataaaagcaatgcaggcgatgcccacaggaaaccggcaggaggagctgggtgacagggaagagcgacccggagagtcacatccacgtgagttcgccctcttttcacactctagcgcccattctgtccttcctgctggattctggctcaggagaagagcgccgccaggaccccaggaagctgcagacaggagccgctgacacctccacctcacgcggacgccacctagtgtgaccattaccagccactgcgcctgcgcagactcgggttttctgtgcgcgccagaggggcggggcctgggccgggaaggggcagaagtagaccggcggctgggccgccattcaccaatagaaaagagagatcgagagccacgtgctcataagatatccaatcacaatcacatcctgtggcggcggattggggggcgtggactagaggttgatcgggttgggcacacagcatcacgtgacacgaaaaggtaaataaggccacgtggctttttctccttggcttcggcgaaacattacgtcacactaccgtctctgaacaattatttaatgaacttatgtgatgcgctagacaatgtgaagacaatgcggttgctagaaattgtaatctctccatcaaattactctgtccagcttatttccttgtttcttcattcaaatcatcctagacattcaactagttttccgtatcctactttcatacaaatgctcatttaaagataattaagggaatttattctctctttcccaagccttgataatgaaaaagaggtaggttattttgttgttggttttttgttttcttttttcttttttttttttttttgagacagggtctcattctatcacccaggccagagtgcagtctcactgcagcctcaaccttctgggctcaggtgatactcccatctcagcctcccgagtagctgggactacagccatgcaacaccttgctgattttttgtagagacgggatttcaccgtgttgtccaggctggactcaagcaagcctcagcttctcaaagtgctgggatttacaggcctgagctaccacgcccggcccaagagatagatttttacatcagaggatatctttagagcctttagtagccctgtgactgctctctctctctcgtttgttctgtcatctaaataaataaataaataaataagaagaagtaagcaccattttcctaaaagcccacttttcttccatccaacagggacttgcaatttctttccactgaagaaatattttttatggccttcacagttcgttgaagattaaggccaggtctaacttgattttgcatcccttgaaattcttcatagcacaatatgcaaagaagggttcttcggtttatgcttgttgaatttgaatttgagaatagtcccattcttgcctgccaaagaattaaaaagacttaaaaagaattaattttaattaaaaagaattaaaaagatagcacttctctgaattatctggatttgggttccaaggtcagctatgccacccaggaattagtgacttttggcaatccattgcatctttaagccagtttcctcatccatcagatgtggatataacagtacctacaactatagaacttcaaggatgacaagataattgtgcaaaagacatgacaccgtctggagcatacagcataatatatacaaggatgccagtttgaagagtagggaagaaagtctcagagcagactgaattgtagacagatactaacactaaatcattgtcttgtggccagccccgaatacattgtatcctcagcattttgtgtggtgcctggcccagagtaagtgttcaataaataatcattgaatggatgaataaaatgagggaccgggcgtggtggctcacgcctgtaatcccagcactttgggaggccaagtcgggcagatcacgaggtcaggagatcgagaacatcctggccaacatagtgaaaccctgtctctaaaatacaaaaaattagctgggcgtggtggtgcgtgcctatagtcccagctactcaggaggctgaggcaggggaatctcttgaacccgggaggcagaggttacagtgagccgagattgcgccactacactccagcctggtgacagagtgagaatctgtctcaaaaaaaaaattataaataaataaataaatgagggagaaattatgccaaaagataagtccacacacactcccttcttcaaatggaaggtcttctattgcccaccacatacccagaagtggtggctgttctgtcagtttccagtggtctgaaactgcttaatggtgccttttgatagtggacagagtctcactgtgtcacccaggctggagtgcagtggtgttatcttggctcactgcaacctcttcctcccaggttcaagtgattcttctgtctcagcctcctgagtagctgggattacaggtgcacgctaccatgcccagctaaattttgtattttttagtagagatgaggttttgccatgttggccaggctggtctcgaactcctgacctgaggtgatctgccctcttcggcttcccaaagtactgggattacaggcgtgagccaccatgcctggcctcaactttgcttttctgcttcagttcccttctctgcctctccccacttgctctggtgaatttctttttttttttttctttctttggccgagtatcactctgtcacccacgctggagtgcagtggtgtgatctcagctcactacaacctcagcctccctggtttaagccattctcctgcgtcagcctcctgagtagttgggattacaggcctatgccaccatactcggctaatttttgtattttttagtagagacagggttttgccatgttggccaggctggtctcaaactcctggcctcaagtgatctgcccacctagacttctcaaagtcctgggattacaggcgtgagccactgtccctggcttagttctggtgaatttcaatgtaaatgtagtcataaatactcatagaggaattgggctgaagtgacttagtggttaaaagcttgggcactgccaccagacagacctggccaaatcctgattttgccatttgtgtgatcttggacaaatgacttaacttctctgaatttttagttccacatccatgaaatgggagcaaaaatatcaatatcacagagctggtttgaacatttaatgagatgagatgtggaaaactccgaacaaggaagtatgcagtaagtgctccagaaatgcaagctgttattggttttttgttttgttttgttttgttttgttttgtttgggttttgtgtgtgtgtttgtttgagatagtgtctctctctgtcactcaggctggagtgcagtggcgtgatcacagctcactgcagcctccaactcctgggctcaggggatccttccacttcagcctccctagtagcttgaaacagggtctcactctttcacccaggctggagtgcagtggtgtgatcatagctcactgcagcctcaaactcccgggatcaagagatcctcctgcctcagcctcttgagtagctacgatcataggcgcgtgccgccatgctcggcttgttaatgtttattatatttcatgactacagtgtcaaaattagcctgtagagtgtggtgaagtcttttatttagaaaagaaagtcgtggccgtgtgcggtggctcacgcctgtaatcccagcactttgggaggccgaggcgggcggatcacgaggtcaggagatcgagaccatcctggctaacacggtgaaaccccgtctctactgaaaatacaaaaaattagctgggcgtggtggcaggagcctgtaaacccagctactcgggaagctgaggcaggagaatggcgtgaacctgggaggcagagcttgcagtgagccgagattgcagcactgcactccagcctgggcgacagagcgagactccatctcaaaaaaaaaaaaaaaagaaagtcattgtagaaaaatggtttaatacagttgaaaatggaggcagaatcatgagacgggggcaaggtctggctcaaactaaagcctaccacttcaggcagggaagggcagtggttcagcatgtgttttctgttgttagacttgccgagttcaaattccttctctgctgcttactagatgatagcattggaaaagtgacctctcctattgagcctcagcttaggaaaataagatttgctaatagcgccaatacctcacagggctgtcaagaggatttatggacacacagtcctggtacagagtaaataatcagtagatggtgatcgttaatcattactcaggtttcaaggtgcttgcttgcttcctggaagtgtctttctaattcaacttagcttccaaggctggaagaaatgatactcacaaaagactaggcagagtagccaggcgcggcggctcatgcatgtaatcccaacactttgcgaggccgagccaggcagatcacttaagctgaggagtttgagaccagccagggcaacatggcgaaactctgtctctacaaaaaatacaaaaattagccaggcatggtggtgcatgcctatggtcccagctactcgggaggatgaggcgggaggattgcttgagcccgggaggcggaggttgcagtgaggcaaggtggcatcactgcactccagcctgggccacagagcaagactccacctagaaaaaataaatacataaaaataaaagagtaggcagagacctagtttatagacagagaataaaacaatatccaaacatgaggtctttcaacaaggtgctttattggagagtacagtgtgagatgaggcagatagaggtgatgcttttgagaggtgatattcaactctgacaatacttcttggtgtccaggttcttgtgtgccttgttatatggagcttttgaaaagcagatggcagcgttgcggtcgcagttgcaaatgaaggcctcacactctttgtttttgcctggagagggatgaaaggagaggactgagccaaggtggaccctgttttgtacaatctggggcaagaagaattaactggaataagctggcagccattccactgatgcacatttagggctgacagattaagtgaatacaagtacatcaggatgcccagttaaatttgactttcagataaacaatgaatgcaatatttgggacatataccccccaaaaaattatccattgcttatctgaaagtcatatttatctgggcatcctgtgtttttttgttttgttttgtttttaagacggagtttcccttttgtcgcctaggctggagtgcagtggcgtgatctcagctcactgcaacttctgcctcctgagttcaagtgatactcctgcctcagactcctgagtagctgggactacaggtgcttgccaccatgcccagctaatttttgtatttttattagagagggtgtttcatcatgttgtccaggctggtctcaaactccggacctcaagtgatccatttgcctcggcctcccaaagtgctgggatacaggcgtgagccaccatgcccaacctagtttctctactttaaagcatgtattttaaaaattatggaacatccttaaatggaatactacatagacatttagaaaaattaggtatgcctgcacatggaaattttcccaaataaaaaaagctagtgtatgccccaaaaatctggaggaatatgtaactggttatctttgggtagtaggattatagatgccttccactttccataatagatatttatgtagagtttgaagttgcattacttttggcttgtttacttttataaccaaaataaacaataagattacagttaaaatgcatttaaactttattacatataatttacgtatctctgcttaccttcaggaatcttattagttttgtttctctccgatcctttattttatttatttatttttttgagatagagtctcgctgtgtcgcccaggctggagtgcagtggtgggatctcggctcactgcaacctctgcctcccaggttcaagcaattctcttgcctcagcctcccgagtagctgggactacaggcatgcatcactacacccagctaatttttgtatttttagtagagatagggtttcaccatattgaccaggctggtctcgaacttctcacctcaagtgatccacccaccttggacttccaaagtactgtggttacaggcttgagtcactgtgcccaactgagttatttttaattaatatgaacaaacatcctctaatgcaggtttcttgtcttagttgcaaacattaaaaaaaaactgtgtgtgagtgtgtgtgtgtgtgtgtatttctctggggagagggttcatagctttcatcagatttgtaaatttggccttctaaagtggagcaggaggatgtataagcaaattaagccatattattcagtgactaaaatagtaacaatgaaaaaacagtaacaataaaggtttgaggcaatatgaaaaagtcataacaaggtgataagtgaaaaagcagaatgcaagattgtatttattctgcaaagttgtcaagattgttttaaaaaaagaaaaagaaagtttatatctaggctgtgcattcatcaattatttattgagcacctactatatgtcagacactgctctagatctggggatatagcaataaagaaaatagacagtaatcggccaggcacagtgactcacgcctataattccagcactttgggagactgaggcaggcagatcacttgaggtcaggagtttgagaccagcctgggcaacatggtaaaaccccatctctgctaaaaatacaaaaaattagccaagcatggtggtgcacgcttgtaattccagctactcaggaggcttaggcaggagaatcgcttgaacccgggaggcagaggttgcagtgagctgaacggaggttgaggtgatgaagtgagactctgtctcaaaaaagaaaggaagaaaataggcagtaatccctgttctgtggatcttacattctattggaaagatggaatgtaaagaaataagtagccgcacatggtggctcacccctgtaatcccagcactttgggatgccaaggtaggaggattgcttgaagccaggagtttaagacaagcctggccaacgtagtaagacccagtctctacaaaaaaatttttttaattagccaggcgtggtggtgcacgctcgtagtcccagctacttgggaggctgaggtcagcagatcccttgagctcaggaggttgaggctgcagtgacctatggttgcaccactgtgctcatgcctgggtgacagagcaagaccctgtctctaaacaacaacaaaaaaaaacccaaactgtcaccacttacaagctgtgtgatcttgggcaaatagctcagccttctgagcctcagttttcttatctgttaagtgaggataattgtacctatcccatagtgttgttctgaggattaaaggagacactgcccagaaccaagaaaattaacactaaatcatggctgttgttactattatttccccccggcctactgagaaccaactagaattcataggtcaaggaagggataaacctactgctacaggtgattgccgagccagagcacgagtatgaataggtgtgggtgtacgggttgtccagcagaaatttacagctgtccagcttcttggcctggtcatagcagttgtcatgtgtctggcagcacctggaaagtgggagggacagctgagataggagtaagtgcagagcaataggtcagccctcacctgcccactctcaggaacaggtggggatgacttcgccaagatgcttcaggagaaatgatcctatggcttgaaaaaatataagtccttttatcatatatttattgaaagcattttttttttttgagacagagttgctctgttacccaggctggacagcagtgacacgaccttggctcactgaaacctccaactcagtctcccaagtagctggggttacaggcgctcgccaccatgtccggctaatttttgtattttttagtagagacagggtttcaccatgttggccaggctggtctcgaactcctgacctcaagtgatccgcccgcctcggcctcccaaagtgctgggattacaggcatgagccaccgcgcctggcctgaaagcgatttttaacatggttgcaagaatacagtaaaatcctgtattcagaaggtgcagtgacaaccactgctagaaaatgacacgtggatagttgctgtgatgtttactgttgctacattctgccactggagggcagcatcgcccactgttttgcacgtcggtcattgtttccatctctaacggggtgcgttcgctacagggtcctcttggaacatatttgtttatttgacaagaggtgaaaatatgttatccttagcagatatgcaagtcccctttgtatgcctcgtgagatccttggcgtgtgccccaccccgcccccggcaggcactccaattttcctgcaggcggatcacttacttgtccagttcatccacgggggtgcctgagccccccaagccacagtagcagccgtagttgttgtattccaagaaggggtcactccccgggatcacgcacttgatcattttgcggaactgccacacggcccgagggctgatgccgctgtcggcggcggccactgcaagaagacatagccagagttcaaatcggtctgccagcaccccggggacacactgccttcctgctccctcgggtcccacgctgcctccctgacccctgccagctgcctcctctgaagaccgttggacccaggaacctggtaaagtgaaagtgggtagaggtttttttttttttaatgaaaactttatatatataaagtttatatctttgtgtgtgtgtatatatatatatatcttcttctttttcttcttcttcttcttctgggaccctaccgcctcagctaggattacaggcatgtgccacccagctaggcctgatagttttttttttttttttgagatggagtcttgctctgttgcccaggttggagtgcagtgacacgatttcagctcactgcaaactctgcttcccgggttcacgccattctcctgcctcagcctccctaggtcagatagttttaaactatctgcactgtttatccagtgaatatttattgagcacttactatgtgccaggctctgtcctaggagctagagatacagcagtgaacagatataataataataataataataataataataataataataatctctaacctcatggagcttacaacctagtgggagagaaaaacaataaataataaatgtgataaggccgggcacggtggctcatgcctgtaatcccagcactttgggaggccgaggcaggcggatcacaaggtcatgagatcgagaccatcctggctaacacgatgaaaccccgtctttattaaaaatacaaaaaaattagcggggcgtggtggcaggcgcctttagtcccagctactggggaggctgaggcgggagaatggcgtgaacccagcaggtggagcttgcagtgagccgagatcgcaccactgtactccagccttggcgacaaagcaagactctgtctcaataataataagaataataataaatgtgataagtaaggaaactggatactgcattagaaaggggaagaatagagcaggatgaggagaatctaaaagggaggtcacccagcctggccaacatggtgaaaacctgtctctaccaaaaaaaacacacaaaaaattagctgggcatggtggtgtgtgccagctacttgagagctacaagtcccagctacttgagaggctgaggcaagagaattatttgaacccaggagatggaggttgtagtgatctgagatcacgccaccgcactccagcctgggcgacagagtgagccccgtctcaaaaataaaataaagtaaaataaaaataaaaattaaaataaaataaaataaatgggagattggcctaactacttagttgagtaaggtgggaggatcacttgagcccacgagttggaagctgtggtgagctatgatcatgccactgaactccagcctgggtgatagagcaagaccctgtctggaaaaaagaaaataaaggcaagctttcttagctcaggcaatctgagttcagacttgcaggttgaaaaagtgccagccttgagggaaccccaatagaggagcccttaagccccactgggaacctcgaattgagactgcggggctggccatccctgtttgctgtggcctgtggcccccattccagaggagtgagatcttagctcacttgggagagaaaggcgggtggagccggggagacttgcctacctgtgagcagcacagctagcacaaggagtttcatcttgcagtcaaggtgagaaaagaactgagatgaccagtctcaggtatagtcttatagtcagtctccacacaaccctgcccagataaggctggagtgtttgctttgctcttggctgagtttggggctggccttgaatctgtctgttgcaggaatgaccctgacgatttgccagcatgggatcactggaaaatatgttatgcatttgtccttagcaactgttaaccaaagggatggtttctggagttttcagatcttacaatcttgaccctcatacccaccactttgtactcagcccagcttcacgggctggttggggaaagcaaagccgtcagttcagtcggacgctgggataagggagacaagaaggaagtgcagcctgggcaacatagagagacctcatctctaaaaaaaaaaatgttaaccaggtgtggtggtggattgcacctgtgatcccagcaactcaggaggctgagatgggaggatctcgtgagccagggaggtcaaggctgcaatgaacagtgattgagcctctgcagcagagtgagaccctatttcaaaaaaaaaaaaaaaaaagaaagaaagaaaaaagatcgctgcctgcagcctcaatgtcttatcaagtgcctgaatctgtgcactgggtctggttgaatagtcccatcagtcgtgcaccttgcagataaagagacaggttcagagagttgcggtaacttgcccaaggtcacacagttggcaaatgacaaaatagggctccagtttagatctgtctgattccaaggcagaggttttatttttttccaccactccgctctgcagtgtgggtttgtgagaaaaacctgggctttggattccaaaggcctgagtctgaattatagaatactaaagggcattagaactgtcatatcagaggccaggcacggtggctcatgcctgtaatcccagcactttgggaggctgaggctggcagatcacctgaggtggagagttcgagaccagcctgaccaacatggaataaccctgtctctactaaaaacacaaaattagccaggcatggtggcttatgcctgtaatcccagctactccggaggccgaggcaggagaatggcttgaaccctggaggcggaggttgcggtgagctgagatcacgccattgcactccagcctagggaacaagagcaaaactccatctcaaaaaaaaacctgtcacatcacatatctatttatttatatatattttttgagacggagtcttgctctgttgcctaggctggagtgcaatggcgcgatcttggctcactgcaagctctgcctcccaggttcatgccattctcctgcctcagcctcccaagtagctgggactacaggcacccaccaccacgcccggttaatttttttttttgtatttttagtagagatggggtttcaccgcattagccaggatggtctcgatctcctgacctcgtgatccacctgcctcggcctcccaaaatgctgggattacaggcgtgagccaccgcgcccggccaaatatctacataacattgtttagctgaaattcacataacattaaccacgtttaagtaaacaattcgggggcatttagtaccttcacagtgttgtgcaaccatcacctctatggggttccagaacatttttatcactccagaaggaaaccttttacccattagcagtcacactccctcagcccctggtaactgctaatctgcttctctctctctctctcttttttttttgagacagagtttcgctcttgtcgcccaggctggagtgcaatggcacgatctcggcttactgcaacctccgcctcccaggttcaagcgattctcctgcctcagcctctcgtgtagctgggaattacaggcgcctgccagcatgcctggataatttttgtatttttagtagagacaaggtttcaccatgttggtcaggctggtctcaaactcttgacctcaggtgatccactcctcagcctcccaaaatgctgggattataggcatgagccactgtgcctggcctctgatctgcttctctctatatagatttataattggttaacttggtgctcttctgttcctatgtcacctctacaacaaccctgtgggataaggagggcctggttatttaatttatttatctgttttttttttttgagacaaagtgtcgctctgtttcccagactgatgtgcagtgacacgatcatagttcactgcagcctcaacctcctgggctcaagcaatcctcccaccttagcctcccgattagtggggactacagacatgtgtcaccacacctggctaatttaaaaaaattttttgggccaggcacggtggctcatacctgtaatcccagcacttggggagaccgaggcaggcggatcacgaggtcaggtgatggagaccatcctggctaacacagtgaaaccttgtctctactaaagatacaaaaaataagctgggcatggtggcgggtgcctgtaatctcagcaacttgggaggctgaggcagaagaatggcgtgaacccaggaggcagagtttgcagtgagccgagatcacgccactgtactccggcctgggcgacacagcgagactctgtctcaaaaaaatttttggagacacggcgtctccctatgttgcccaggctggtcttgaactcctggcctcaagtgatcctcccatctaagcctcccaaagcattgggatcacaggcgtgagccactgtgcccagcaaccttgatagttttgaggagtattggtcaggatgaccctctcttggaatttgtgtgtgtgtgtgtgtgggtgtgtgtgtgtgtgtttgttgtagtctcactctgtcgcccaggctggagtgcagtggcacaatctcggctcactgcaatctctgtctcccaggttcaagtgattcttgtgcctcagcctctgagtagctgggattacaggcacgtgccaccacgcccagctaattttattattgattttattatttgatcaacgaggtntcttcgtccgacgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctgcatggaactacagaaaagccgccaccacgcctagccaaaaaaattttttaattagctggagttctaattacccaggagttctaggttacagggagttatgatggcaccattgcactctagcctgggtgtcagaaccagaccctgtctaaaaaagaaaaaaaggccaggccgggcacggtgactcacacctgtaatcccagcaatttgggaggccaagatgggtggatcagttgaggtcaggagtttgagacccgcctggccaacatggtgataccctgtctctacaaaaatacaaaaaaattagccgggtgtggtggtgcacacctgtaattccagctactcaggaggttgagacaggagaattgcttgaacccaggatgtagaggttacagtgagccaagatcatgccattgtactccagcctaggtgacagagcaagacttcatctcanaaaaaaaaaaaaaaaaaaagaaagcgggcacagtgggctcatgcctgtaatcccagcactttgggaggccaaggcaggcagatcacctgaggtcaggagtttgagaccagcctggcccaacacggtgaaacccagtctctaccaaaaatacaaaaattagccgggcatggtggtgcatgcctgtaatcccagctactcaggaggctgaggcaggagaatcggttgaacccgggaggtggaggttgcagtgagccaagatctcaccactgctctccagcctaggcgacagagtgagactctgtctcaaaaaaaaaaaaaaaagaaaagaaaaaaaggcccctgtgaaatgtcaagaagtcctggattgttttaaaatgcttaagaagagacagaatggataaagtagacatgacaaaatcttgataaaaccttggaatctgggtgatggtatatgagaattcattatacaattctctttacttttgtgaagtttgaaattttcattattaaaagaacagattttcttcatgaaaaaaattgtgagttttttttgagacagagtttcactcttgtcgcccaggctggagggcaatggcacaacagtcttggctcaccgcaacctccgcctcccaggttcaagcgattctcctgcctcagcctcccgagtagctgggattacaggcatgtgccaccatgcccggctaattttttgttgttcttgtacttttagtagtgacagggtttctccatgttggtcaggctggtcttgactcccgacctcaggttatccacccgcttcggcatcccaaagtgctgagatgacaggcatgagccaccacgcccggcggaaaaaattgttttaatgaatccataagcatcattaactcaaattccctggataccaccttagtctaggtctttcaggctgacctccctgacctgctctttttaatcctgtttagccttcctcaaatgctatttttatcatgttgcttgcttgctcagaaaccactaataaacccctttggtgtctcacagcagacccaactgcactgcctgattttcaaatgtaaccatgatttgggcctaactttcccagacaatctggtttctgcaagtcccaggtccaaacctctacagaggccaggccagactcctctgggatctacaacttcccttcatttggaaagccctgtttcccgctcttgcctagacaaacctgagccaatctcaagccccctgtacccataaaagctttcttggggcaggcgctgtggctcacgcctgtaatcccagcgctttgggaggccgaggcaggcggatcacgaggtcaggagtgagttcgagaccagcctggccaacatgatgaaaccctacctctactacaaatacaaaaaattagctgggggtggtggcaggcacctgtaatcccaactacttgggaggctgaggcaggagaatcacttgaacccaggaggcggaggttgcagtgagccgagaccgtgccactgcactccagcctgggcaacaagaacaagactgtgtttcaaaaaaaaaaaaaaaaaaagctttcttgggccaggcatggtggctcacacctgtaatcccaacactttggaagatcgaggcaggaggagggcttgagcttaggagttcgagaccagactaggcaacacagcaagatcctgtctctatttaaaaaaaaaaattttttttttaaaaagctttctcaactgattattccaatctttactaaatctgtttatttgaacatgcacagcatataaatcaagaaccacacaatttcacaatcatgcgttgtcatttatcattaattatgtgcttttctttgtttgtttgcttggttgttttttgagaaggagtttcgttcttgttgcccaggctggagtgcaatggtgcgatttcagctcattacaacctctgcctcccgggttcaaatgattctcctgtctcagcctcctgagtagctgggattataggcatgcaccaccatgcctggctaattttgtatttttagtagagacagggtttcactgtgttggtcaggctggtcttgaactcctgacctcaggtgatcccctgcctcggcctcccaaagtgctcggattacaggcgtgagccaccgtgcccggccaattatgttatttttgtgtcttcccaaatattacaaagttcttgcatataaagtgggccatgttttatactttggtttttgtttgttgtttgagacaatctccctctgtcgcccaggctggagtgcaatggcacgatcttggctcactgcaacctctgccacccatgttcatgcaattctcctgcctcagcctcccgagtagctgggactataggcgcccgccaccacgcctggccaatcttttatttttagtagagactgggtttcgacatattggccaggctggtctcaaactcctgagctcaagtgatccgccccctcagcctctcaaaatgctgggattataggtgtgagccactgagcccagcctatactttggttctgaccactaagaagcacagtagttagtgttataatgtactacatagtgtaacgtatgtacaccatacattctaggcacccagtaaatatttcagcattggcagactgacttcagccctcagaggagcctctctagggcttaaagaaataagtctccaattagctacaattattgccagacccataagcatgataccctcccatgtatctgttccctcattattgattgagttctgactactgcccggctacgttatggtctatgtatctagccatcctaggcattggaaacccagcagtttatagcacatgctattggtgttcagctcatattttcctcagaacatgctaaaggccacgttcgaacagtttcctttctttttgtttttttattgagatagagtctcactctgttgtccaggctggagtgcagtggcacaatcttggctcactgcaacctctgcctcccaggttcaggcgactctcgtgcctcagcctcccaaatagctgagactacaggcgtgcgccactatgcccaggtaattttttgtatttttagtagagatggggtttcaccgtgtgggccaggatggtctcgaactcctgacctcaagtgatctgcctgcctctgcctcccaaagtgctgggattacaagcatgagccaccgcacccgtcccagtttcctttctctgtttttttgtttgttttttttttttgacggagttttgttcttgttgcccaggctgcaggctggagtacaatggcacaatctcggctcaccgcaacctccgcctcttgggttcaagctattctcctgtctaagcctcccgagtcgctaggattacaggcatgcaccaccacgcccagctaattttgtatttttagtagagacagggtttctccatgttggtcaggctggtctcgaactcctgacctcaggtgatccgcccaactcagcctcccaaagtgctgggattacaggcgcgagccaccgtgcccagccaatttcctttcttaaaaaaattttttgtagagacggagtctggctgtgttacccaggcaggtcttgatctcctggcctcaagtaatcctcctgcttcagcctcctgagttgctgggatgacagatatgaaccacagcaccctggtggacacaattttctttctttcttttttttttttttttgagacggagtctcgctctgtcacccaggctggagtgcagtggcgcgatctcggctcaccacaagctccacctcccaggttcacgccattctcctgcctcagcctcccgagtagctgggactacaggcgcccgccaccgcgcccagctaattttttgtatttttagtagagacggggtttcaccatgttagccaggatggtctcgatcaactgacctcgtgatccgcctgcctcagcctcccaaagtgttgggattacaggcgtgagccgccgcgcccagcctacacaattttcttacaagcagtttcctgtgtctctcttgcctcagatgttctctgcccacggaagcctccttgggaggagcagagtcaaaatgttagggaattaattcccctagagtgatcctggacccatgagggatgagagatggtgaataaataccctagcttcaaggccaagcacagtggctcacactagtcatcccagcactttgagatgccaaggcaggaggatcacatgagcccaggagttcgagaccagcctgggcaacatagtaagacttcgtctctacaaaaaataaaaattaaattaaaaattagctgggcacggtggcgtttgcctgtagtcccagctacttaggaggctggggtgaaaggatcacttgagcccaagagattgaggctgaagtgagctataatcacaccaccacatcccagtctgtgtgacagagtgaaagcctgtcatacacacacacacacacacacacacgtgcacacacaaacacaaaagaaaataaaagaaaatcaccctagcttgctcaactttcttttttttttttctttttgagacggagttttgctctgttgcccaggctggggtgtggtggcatgatctcagctcatgatctcagctcactgcaacctctacctcccaggttcaagcgattctcctgcctcagcctcctgagtagctggaattacaggtgcgtgccaccacttccaacagatttttgtatttttagtagagacggggtttcaccatgttgaccagattggtcttgaactcctgacctcaggtaatctgcctgccttggcctcccaaagtgctgggattacaggcgtgagccaccacacccggcctcaactttctttaaaaaaaaaaaaaaatatgtatatatatatatatataaaatttactttacttatatagagacagagtctcactgtgtttgccaggttggtcctgaactgttagcctcaagcaatcttcctgcctcagccttccaaagtgctaggattacaggtatgagccactgtgcaccatcctcaacttttttttttctttttttctttttttttgcactgttgcccaggctggagtgtagtggtgcaatctcggctcactgcagcaacctctgcctcccaagagattttcctgcctcagcctcccaagcagctggattacaggcatgtgccaccacgaccggctaatttttgtatttttagtagaaatggggtttcaccatgttggccaggctggtctcgaactcctgagctcatgtgatctgcccacctcagcctcccaaaatgctgggattacaggcgtgagccactgcgcccggccccagtcctcaagtttcattgagacaaccctcaggcatgtcctagacagttggagggtccctcacaggactgaaccccagtgcccaaggcagtaacccactcattaacacacactttcttggctttcctctctttcctgttttacatccttgctccgtcaatgaatttactggaatcaactgcaaaataaacaacttgctctgaaatccttttctcaaggtctaagactgtggtgatcaagacagccaaggtccctactctcccaaaacaacacacgggtttgcgttcaaaccgtgtacagctcctgcacctgtccatgcatccgtggagctctgtcaggcgccgactccccgccttggtgtgcaaagcatccacattttgggtcaccaaccagtacagctttccgagtttctcccaggtgctcaaagcccagtgtgcagggttaggctggtgggaggagaattgaggccagcctacgaagtttctcgcccagtaccgctggcggattggggcactccggacaaaatcaccatgctggatgggcctgcggtcagtgcgggcataaagccccactttttctgacctgtagtctggtatccccgattcggtggagattcctgccccagtcatcacaaggagtctcttggaaagggtgatgaagcgctgtaactctttgaccttctcagggtccagaggaggacttgctggcacaaataacccaatggaggctttcgagcacggctggctggggtttgcgatccaacggccttttgctgacctgaaagtcaacgcaaagctcatcttcattctagagaaaaagaagcctcatgtgagaaactggggtggttttttttttttctcattttttgtttgtttgttttcgttttgttttttgagacagagtctccctctgttgcccaggctagagtacagtggcatgatcttggctcactgtaaccgccgcctcccgggttcaagtgattctcctgcctcagcctccagaatagctgggactacatggccaccatgcccggctaattattgtatttttagtagaggcagggtttcaccatgttggccaggctagtctcgaactcctgagctctagtgatctgcccgcctcggcctcccaacgtgctggaattacaggtgtgagcctctgagtctggccctaatgagtcaggttttgtttgattttgttcatgtaattaagcacacacacgcattccttttattttttcatttcccccttattttagtttaccctccactgcaagctctgctacttggacacatcagagagacaagacccctgcccgtcagcttttctagctgtaacaatagagggccgggtgcggtggctcacgtctgaaatcccagcactttgggaggccgacgcaggcagatcacttgagatcaggagttcgagacatgcctggccaacatggtgaaaccccgactctactaaaaatacaaaaaaaattagccgggcatggtggcacgtgcccgtaatcccagctactagggaggctgaggcaggagaattgcttgaacccgggaggcggaggttgcagtgagccgagatcgcgccgttgcactccagcctgggcgaagaagcaagactccgtatcaaaaaaaaaaaaaaaaagaaaaagaaaaaactttgacatattatttgacacaatgcaatgcataaatcctctagtgacatgcaccccgtatgtaaacattattttatgtttggctttccagatctgagatcaggaccccgctttctccttgacattccacagcaaaacgtgaacagctgaacaaacacacagtccggtttcccgagaccaaagggtcaggggaaacccccgctgaaaacgtgcatcagtggaacaactactctcttccaggtcccaccgagggcaaagaggagaaatagaatccctcacaagaaatccacaacttctagaaatccgcagcacacacagaacacacttacctctcacagctctacggacacttcacaccccacagtgggaccgtctgattgcatttgcattttgggacatgtagtccagaaagcttaaatgatgcgagaaaaaccacaagtcccacaatcctccgcgtctcgcaattgacagccccagatcatccaggaacgccccctgtcggctctttctggtcagaggttcccccgttaatataaaagcttttaatcatggatttttttctttgttttcaatttctgtgggcacttagtaggtgtatatatttatagtgtacataagattttttttcttttttcttttttttttttaagacggagttgttgtttttttttttttgaaaaaactccagtctggagtgcagtggcacgatctcggctcactgcaacctccctctcccgggttcaaccgattctcctgcctcagcctcccgagtagctgggattatttttgtatttttagtagagacgggggtttcgccatgttggccaggctcgtcttgaactcctaacctcaggtgatccgcacgccttgacctcccaaagtgctgggattataggcgtgagccactgcgcccggccatcttttctcttattttttgtctttttttcttttctctgtgcctgtctatgctttacccacatgagatgttttgatacaaacatgcaatgtgaaatgagcacgtcattaatcatggatctagatttgacttttttttaaagtttttgtatttttagtagagacagagtttcaccatgttggccaggctggtctcgaactcccgacctcaggtgatccgccaacctcggccccccaaaatgctgggattacaggcctgagccactgttcccggcctagatttgactcattctaaacatcagagtttgtgatccttttcattcacaacgacagtatcaagttatttgctattggtaaaataccttgaacttgtgaagaaatgtgtttatacatatctgaaaaagtgatagtttgttgttgttgttgttgttgtttgtttgtttgtttttgagacggagtctcgctctgttgcccaggctggagtgcaatggtgccatttcggctcactgcaacctccgcctcccgggttcaagcaattctcctgcctcagcctcctgagtagcagggattatgggcgcatgccactacgcccggttaatttttttatttttagtagagacaaggtttcaccatgttagccaggatggtcttgatctcctgacctcgtgatctgcccaccctagcctcccaaagtactgggattacaggcgtgagccactgtgcccagccaaaagtgatgtttttacagttaatatgaagccaaatatattatacctggactaatgtacttaacctgcttggcttctccaattttatttatcatattttttttattaagttaatcaaacaaggcctgcgtctcactcccagggattctgatctacaaatttcctaattgttcctaatgtgtagacaaccagaactgccgctctgcagcatcacctaaatcaataaatgtataagtgtctttggacataaaggtgggcggccagcagggaccttgaagaccacctaaggactcccttcccccattttaagatgaattgggctgagtgcagtggttcccacctgtaataccaacactttgggaggccaaggcaggaggatcacttgagcccaaaagttcaagaccagcttgggcaacatagtgagacccactcactacaaaaaataaacaaaattagcggggtgtggtggtgtgtgcctgtagtcccagctactcaagaggctcaggtgggaggatcactttgagcccaggagatcgaggctgcagtgagccataattgtgcgactgcacttcagcctgggtgacaaagtgagatcccatctcttcaaaaaataataataataaataaagatgaactgaagtgcagagaagtaatgtggaagcttgagaaagagtttttaggtttttggttctatcattgtatctttggaggtaatattggcaaaatgaccatttagtagtttgcccatttctgctttttttttttcttttttttgagacagggtctcgttctgtcacccaggctggagtgcagttgtgacatcacagctcactgcagtttctacttcccaggcccaagggatcctccaacctcatcctctcgagtagctgagatcacaggcatccaccaccacgcccagctaaattttgttattttttatttttgtcgagacacggtctcactatgttgctcaggctggtctcaaactcctgaactcaaggaaagctcttgctttggcctcccaaagtgctgggattacaggtgtgagccaccatgccgggcctgcttatttcgacttggcagcatcgtttcatgaagcccctgactctgtgacaacatacagctctccagaaagatgctttgaagacaaaacagaatagagcacacagccctccatgtctcttccaagtcactatattcattaaaagataaatgactctggtcattgccttttcctgcacaagataatgtctgatggggttagtgatgatacctctgtaatccataaccagatatactcttgcacccaaactttgatatgattgtgctttaatgtaactttgaagcaagtttaatgtgattttgcaggcgccgtacactcaccacttgtatatgagtggctgaaattctgtgttggaccagtctgatggaactgctcccacactatagccctcggtctgtaatcctcagtaagacttgtaagtaaaactaactttaattttttttttttttttttgagagagtctagctctgttgcccaggctggagtgcagtggcgcgatcttcactcactgaagcctctgccttcccggctgaagtgattctgctgcctcggcctccggagtagctaggattacaggcgctcgccactgcgcccggctaatttttgtatttttagtagagatggggtttcgtcatgttggccaggctggttttgaactcgtgacctcaggtgacccacctgcctcggtctcctaaaatgctaggattacaggagtgagccactgcaccccgccacttttattattattattattgtatttatttatttatttatttatttttgagacggagtctcgctctgtcgcccaggctggagtgtagtggagagatctcggcccactacaagctccgcctcccgggttcacgcgattctcctgcctcagcctccggactacaggcgcccgccaccacacccggctaattttttgtatttttttttagtagagacggggtttcaccgtgttagccaggatggtctctatctcttgacctcgtgatccgcccgcctcagcctcccaaagtactgggattacaggcgtgagccaccgcgcccggctatttatttatttatttatttatttatttatttatttattttttgagacggaatattgctctgtgcccaggctggagtgcagtggcacgatctcagatcactgcaacctccgcctcccgggttcaagtgattctcctgcctcagcctcccgagtagctgggattacgggtgcccgccaccatgcccggctaatttttgtatttttagtagagacggggtttcaccatgcttgtcagcatggtctcgaactcctgacctcgcgatccgcccgcctcagcctcccaaagtgctggaattacaggcatgagccactgcgccctgccactttaattatttaaaagcttatttttttattttggggacatggtctcactctttcacccaggcgggagttcagaggcacgatcactgcgcactacagcctcaacctcttggactcaaaccatcctcccacctcagcctcctgagtagctgggactacaggtgggccaccaagcccagctaatttttgtatttttttgtagagacggggtttcaccatgttgcccaggctggtctccaactcctgggctctaggctttccaaagtgttgtgattacgggcgtgagctactgcgcctggccgattctttttaacttagtacacagggagtagtagctccagcaacagcgaaagtcagtagctgtaggatctactaggcggggaaactcatatgacagccccctcctttttttttttttttttttttttttttttgagatggagtttcactcttgttgaccaggctggagtgcaatggcgccatcttggctcaccgcaacctccgcctcccgggttcaagtgattctcctgcctcagcctccccagtatctggggttacaggtgtgagccactgcgcccggccaccccctttttttttcaaggctgcagtgagccatgatcctgtgactgcactccagccactgacagccctttctgcattagttaacctgaccacatctgctgaaagaaagcaccagaagctagactgaaattttcgttgtcaaaaaaattataatcccccccaaaatttaaaaattataatccagcacattttctgcacacattttctgggtatttgatcataacttttaaaaatgtgagaacagtgacattctccttccccattcaccaattttactatgaaaaagttcaaacctaggttattttttcagttctccaagtggaatgatcatcactaatagagattggttgggaattctattgtgcttctaggcccccaaaaatctcatgctctgaggaaaagttagctgagttttcaatttttctcatagtgctggaaaatcatccctggacggtgaagtcatccaagtcttttttgttttgttttgttttttctttctttctttctttcttttttaatttttgtatgctttgtttctatttcttttttttttttgtcatccaagtcagctggtgaaacacacaatttcacttgatagctactgagagagtgtaatgggccacccattctagaattctcaagggctaggaagttcctttgataccctcatgggattaggattagggctttagtctttttctctctctctctttttttttttttttttttttttttgattacaggcgtgagccaccacaccgagccccattatttatttattttattttatgtatgtatgtatgtatgtatgtatttatttatttattttgagacggagtctcgctctatcgcccaggctggagtgcagtggcgcaatctaggctcactgcaacctccgcctaccgggttcaagtgattctcctatgtcagcctcccaagtagctgggattataggcgcccgccaccatgcccagctaatttttgtatttttagtagagacgaggtttcaccatcttggccaggctggtcttgaactcctgaccttgtgatccacccgcctcggcctcccaaagtgctgggattacaggcgtgagccaccgtgcctggcctagtgtttttctcacaactccaccccatccagaattaatggctaaatccttgactggatgatcaaagtaaaagaatctaaattcaccacattgctagtcttttctttttatccaggctgtgaattaaataagaaatctgctgcagtggctcatgcctgtaatccctccccttggggaggccgaggcgggcggatcacttgagcccaggagctggagaccagcatgggcaacatggtgaaaccctgtatctacaaaaaatacagaaaaattagctgggcatggtggtgtgtgcctgtagtcccagctacctaggaggctgaggtgggaagatcgcttgagcccaggagatttaggctgcactgagccgtgattgcacccctgcgctccaacctaagcgactgagaacatgtctcaaaaaaaaaaaaacaaaaaaaaaaacacaaaacaagttagaaataatcacataacacatcagcatcaaacaggccttttaaaatgtcgtttttgaccatcctggctaacacggtgaaaccccatctctactaaaaatagaaaaaattagccggccgtggtggcgggcgcctgtagtcccagctactcgggaggctgaggcaggagaatggcgtgaacccggaaggcggagctcgcagtgagccgagattgcgccactgcactccagcctgggcgacagagcgagactccgtctcaaaaaaaaaaaatgtcatttttgtatatggatgatgagtacatgaatgttcactgaggaattctttgaacttttcgtgtttacaattttttatgataaaatgttgggggaaatgttactttctttttttttttttttttttttttttttggagacggagtctcgctttgtcacccaggctggattacagtggcatgatctcagctcatggcaacctctacctcccaggttcaagcgatcctcctgcctcagcccccctagtagctgggattacaggcaagcgccaccacgccccgttaatttttgtattttgtatttttgtaattttgtatttttgtattttgtatttacagggatgtcgccatgttgccaggctgatcttgaactcctgacctcaggtgatccacctgccttggcctcccaaagcgttgggattacacgctcgagccaccacacctagaccagatgtaggtttctaatagctttctacatcctgaaggaaaacaggcagtgagggtgaaagttgcttcaaattttagaaactgtgaacattctgtggaaataaatccttattatttgagcctctttttgaattaaggtgtccaaacccttttgaattaacatatgatccagcaattttacttctaggtatgtacaccaaagaatagaaaacaggggccaggcgcggtggctcacacctgtaatcccagcactttgggaggccgaggcaggcagatcacttgaggtcaggagttcaagaccagcctgaccaacatggagaaaccccgtctctactaaaaaaaaaaaaaaaaaaaaaatttatatatatatatatttatacatatatatatataaaattagccaggcatggtggcgcatacctgtcatcccagctacttgggaggctgaggcaggagaatcacctgaacccaggaggcagaggttgtggtgagctgagattgcgcctttgcagtccagactgcgcaacaagagcgaaactcagtctcaaaaaaaaaaaaaaggaaaacagaaacttaagctgatatttgcacaccaatagcagcattattcccatagacaaaaggtggaaaccagcaatgaccatctaaaaataaatggataggccgggcgccgtggctcagcactttgggaggctgaggcaggaggatcacttgaggtcaggagcttgagaccagcctggccaacatggtgaaaccctgtctctactaaaaatacaaaaattagccaggattggtggcacgcacctgtaatcccagttagttactcgggaggctgagacaggagaactgcttgaaccccagaggcggaggttgcatgggctgagattgagtctatgtactccagcttgggcaacagagcgagactccccctcaaaaaaaaaaaaaaaaaggataaacagttggtccgggcggcagctcatgcctatagtcccagcactttgggaggccaagatgggaggatcacttgggcccaggagttcgagaccagcctgggcaacatggtgagatcctgtctgtacgaaaaatacagaaagtatccagctgaagtgggaggaggatcacttgaggcctggaagcagaggttgaagtgagctgagatcgcgccactgcattccagcctgggcgacagagccaaaagctgtctcaaaaaagaatgaatgggaccgggcgcggtggctcacggctgtaatcccagcactttgggaaaccaaggcgggtggatcacctgaggccaggagttcaagaccagcctgaccaacatggtgaaaccccgtgtctactaaaaataatcccagctcctcgggaggctgaggcaggagaatcgcttgaacctgggaggcggaggttgatctcgccattgcgctccagcctgggcaacaaaagcaaaacttcgtctcaaaaaaaaaaatagacaagaataaatgggctgggtgaagtggctcacacctgtaattccagcactttgggaggccgaggcaggcagatcacgtgaggtcaggagtttgagaccagcctggccaacatggtgaaatcctgtctctactaaaaatacaaagagtggtggcatgcatctgtaatcccagctacttgagagatggaggcaggagaatcgcttgaatccgggaggcagtggttgcaatgagccgagatcatgccactgcactccagcctgggcaacaagagcaaaaactccatctcaaaaaaaaaaaaaaaaaaaaaaagataacatctcatacagtgaaatattattcagccataaaattaatgaattcctgatatatactacaacatggatgaaccttaaaaacattattctgaatgaaataagactgacctcaaggacaaatattgtatgattccatttatatatataaagtactcacaaagtcatagagatagaaagtagaaaagaggttgccacgggggctggaggagaagggaacagggagtaagggtttaatgggtacagagtctcagtttccacccttgggcatgaaagataaagttctggaggtaagtagtgatgatggttacacaacaatgtgaacatattctatgccagtgaatttacacttaaggttaaaatggtaaattttatgtatactttggcataatttaaaaaaaagtttgaaaaagaaaaaagacaaaacaataatcgtctttggagaagtctgttacactgaatctggagccaagtgaacagaaccctgattttgatcccttttctctcaaaagcccttcgcagtctctgaattaagtctattagcatgttcctcccatagtgctttgcttcatatcaacaaaaacctagctaagtgaaatcagcaacgatatgcagaaaccacctacgcaggtcacaaacatctttctatgattgtataattttcaagcaagcaataagtgaagatttttccataggccctaaactcacctttgcgaaataggaagctggcttattgggagtgatgagcagggggcgtaacaaattagctttgcgcagtggcagtatcgtagccaatgaggtctatccgaggcgcgattattgctaattgaaaacttttcccaataccccgccgtgacgacttgcaatatagtcggcactggcaatttttgacagtctctacggagactgaattttcttgcagttgaacaacagaggctttttttgtgtgtgtgggggtgcttggttttgggaggttgaagagtacttgttcgcaaactctctaaatgagagatggggaagtgtcttaccagctgattcgcgagagcacctgcaagtttacctgttttagtgatttgcgtttatgaaagttggagttgctgattttgtgatctctacttttaaggtaaaagcagggcggtgttgacttttcttgccagttggctgtcctgttttctttctcgcactgttttctttttgagacgaagtctgtcgctcaggctggagtgcactggcgtgatctcggctcgctgcaaactttgccgaacccctgtttagcgatttccgtttgtgaaagttggagttgctgattttgtgatctctacttttaaggtaaatgcagggcggtgttgacttttcttgccagctggctgtcctgttttctttctctcgcactgttgttttctttttgagacgaagtctgtcgctcaggctggagtgcactggcgcgatctcggctcgctgcaaactgccgcccgggttcaagcgattctcgtgcctcagcctcccgactagctgggattacaggcgcctgcccaccgcaccccgctgatttttttgtatttttagtagcgaccccgtttcaccatcttgtccaggctggtcttgaactcctgacctcgtgatccacccgcctcggcctcccagagtgctgggattacaggcgtgagccaccgcgcccagccgtgttctccattcagattttgtcacagtgacgtcctaaaattattcccaactccccccaccctgctgtttccgcaccctcgagcacagctagtcgtccgtctgcgccctccaggctcgctttcccactgctcactctcctcgctcaaaattcaagtctcaaccgagtcatctctgtgacgtcacgttgatttgcataagattccccagcgtcccaagcgaatattcttatggttttcaaaacctgaatgtttgacacgggatgttccaacaacaagaaacctcctatgcagatgggccttaaatacggctggtggagtgggaacacgtcgtatacacggacacacgggcaggcactcaccctcaatgtaatggtagtcatcatccgtgggggagcggggcgcgaacagaacctttccagctttgcgcagtggcagtatcgtagccaatgaggtttatccgaggcgcgattattgctaattgaaaacttttcccaataccccgccatgacgacttgaaatatagtcggcattggcaatttttgacagtctctacggagactgaatttttaaaagtctaaagaaaagggttttaggaagttgtattatagcaggttgtgtcttatgtttggtttgataagttatgagctgttcctatgatagttttttggttgttgttcaggagtattccgtgattgaatgtccggggttctgtgcgggtactgtgagttgttttccaaaatgtatgacactatgttgggaactgggttctaactaagacagttatcgttaatcttttttatccaaatgcagccagcgagtgagctactccacttcctttgtcactgaaggtcacagattcccttaaagggaaggggaactctaaaactaacacattaatacatccaaagtcttccttttttttttttttttttttttttgagacggagttttcgctgtttcccaggctggggtacagtggcgcgatctcggctgactgcaacctccacattccgggttcaagcgattctctgtctcagcctccggagtagctgggattacgggagcccaacatcacgcccggctcatttttgtatttttagtggagacggggtttcgccttcttggccaggctggtttcaaactcctgacctcaggtgatccgcctacctcggccttccgaagtgctgggattacaggtgtgaaccaccgcgttttcttccttttaaagcgaccaagagggaaaaaggcacagaagattgctcaggtcctactgtggagtcctcggcagagctggggcttatcaggttctcttgcccctagtgtggtacttgttcccactacaccagcctcttccagtcttacctttttacgaagacctgggctgtccatggacagaggtcctcaggagtcacaactctgggcatggcggatccagctggacctgcttaggacaccgcccataaaagactcctccagcctgtagcaaaaagaggtggcaaaaagggtggcaacagtacctacaaggtcaaagacggtgctgggaaaaacagctccagtggcaaattaaactcagtccccagttcaaggacctcacagactggagacgtggaggcgaaggtagcagtgagctgaaattgcgccactgcactccagcctgggtgacagtgagactctgtctcaaaaaaaaagaaaaaagaaagaagaagaagccgggagcggtggcccacgcctgtcatcccagcactttgggaggccagggcgggcagatcacgaggtcaggagttcaagaccagcctggccaacatggtgaaaccctatctctactaaaaatacaaaaaaaaaaaaaaaaaaaaaaaatagccagccatggtcgtgggcgcctgtaatcccagctactcgggaggctgaggcaggggagtcgcttgaacccgggaggcggagattgcagtgagccaagaccgcgccattgccctccagcctgggcgacagagtgagactccgtctcaaaaagaaaaaaaaaaaaagttatccaaaacttagaaataacgtgaaaagaagagtgcatgtcctttcaaaatcaaactacaacaatttcttaaattttggcgtgcataaaaataaccttgagaatttgttaagacacagatcgaatccccattcctagagattccaattcaggaggcctgggatggagactaagattctgcatttctaaaagttcgcaggtgctggtccagggtccacagcttgaacagcaagggaagaaatgtagcattgtataattagcatcatcacacgctagaagaaaactcgacttactgtttattgcagattttttattagagatgggttcttggccggacctggtggctcacgcctgtaatcccagcactttgggaggccaaggcaggaggatctcttgagtccaagagttcaagaccagcttgggcaacatcatgagacacttgtctctaccaaaaaatatgagaatgtttttgttgttgttctttttgtttttgttttttggagagagcagggtctcactccgtcaccccagctggagtgcagtcatgcaatatcagctcactgcaatctccacttcccaggctcaagtgatcctctcacctcagcctcctgagtagatggaactataggcacgtgccaccacactcagctaattttattttattttttgtaggggtggaggttttgcatattgctcaagctagtctcaaactcctgggctcaagccacccacctgccttggcctcccaatgtgctgagattacaggcatgagccatcgtgcctggaaaaattaaaaaattagtgtttgcctgtaatcctagctactcaggaggctgaggcaggagggttgcttgagcctaggaggtcgaggctgcagtgaaccgtgatatcgccaccgcactccagcccaggtgacagagtgagaccctatctcaaaatcccccacaaggaaaatccaaacaaaaaaattgaggtaaaatttacataacataaaattaaccatattaaagtggatccatttttttgttattattctgcaagcaaggaggggagagagggcttcatgtgatttttacgtatcattgttttctgtttcaaatctaaattcttttttctgaatacaaaaattactgcatgtttgtatataaaattcaaatatacacatgaaacagtgacaaaggctctcacaataatctcaccttgactccaaggagatagtcacaggtacgtgagattattcctccaaaatgttctacttataggtcaacataattattaacaaaaattggattatacttggccgggcgcagtggctcacacctgtaatcccagcactttgggaggccgaggcaggtggatcatgaggtcaggagatcgagaccatcctggctaacacggtgaaaccctgtctctactaaaaatacaaaaaaaattagccaggcgtggtggcgggcgcctgtagtcccagctacttgggaggctgagggaggagaatggcatgaacctgggtggcggagcttgcagtgagccaagatcgtgccactgtactccagcctgggcgacagagcgagactccatctcaaaaaaaaaaaaaaaaattggattatactctacatatagttctattacttcctttttctttctgctgtacaatacattgtggacacattttccatgccagcacctaattccccttttcccatatggatgtgacctaccaaggttaaccaatcccccattattggacacgtgagttgtttccagtttttcccataagcaatgctataatgaatacgcttgatgctacgtcatctttccttactcttggggtatttctggggagaaatctctttctttctttctttctttttttttgagacgaagttttgctcttgttgctcaggctggagtacagcggcatgatctcggctgatggcaacctccgccacccgggttcaagcgattctcctgcctcagcctcccgaatagctgggactacaggcacctgccaccacgcctgactaattttgtatctttagtagagacagggtttcaccatattggtcaggctggtctcgatctcctcgcctcaggtaatctgggcgtggggaaaatttctataggtagaattgcctcctcaaaggccatgcttattttgcgttttaagggatatccctatactggcacccctaagactataccaatgtatttgcccaacaaatcacatatgaggacagctggagaaggtttgacatatacatatttttttttttttgagacggagtcttgctctgttgcccaggctggagtgtaatggtgcgatctcagctcactgcaacctctgcctcctgggttcaagcgattctcctgcctcagcctcctgaatagctgggattacaggcatgtgccaccacgcccagctaatttttgtatttttagtagagatggagttttgccacatttgccaggctggtcttgaactcctgacctcgtgatccactagcctcggcctcccaaaatgctgggattgcaggcgtgagccaccgcgcctggcctgatacatacatttgtaagtgttctgcagctttcacggggctgtcacgggtcagggaggggaagaagcgggagggtgaacgtgcatccattttcctgaggcgctgagtgtacaatccagcttcaacctaggtttgtcttccagctgttttccaggtggagagaagggagaaggggctgtgttgggtgagataaaatgtctcggagggaggagaaatctgggctcatccaaaactgaccttctccctatccaccatgtaggtaatatccttggatacattagccaccccacccgccatgaggccaacccccacccaccctcccacccactggctccagaggatggaaaagccctactacaagggctatctcagcagggaaagagcccacagacccctaaacaatctgctcagtgttcaaggcactgcagaatgttagcaagaatcaccagcttctaggttaaaaatatcccatgcccaaggggccctcagtgtctgtctcaaaacagagctggctctaagctctacagtttctccattgctgggaaattaactgaggccaactgatttttttttcccccatgaagctttgaagccagacttgggttcaagaccttgcttcgttattctctacttgcatgacggtaagccactcatctaccctctcatgcttcagtgtccctggctgtaaaaacaaaaagagtcctgattctatctcagagttcggtaggtctccaccctgactgtgtgtgcaagaaaaccacctgaggagctttacaaaaatccctgtgccccggctgcattccagacccattaaatcagaatttctgaggaatgggtcagggcaaaaaaaatgtgtgttaaagcttccaatgttggccgggcgcggtggctcacgcctgtaatcccagccctttgggaggctgagacgggcggatcacgaggtcaggatatcgagaccatcctggctaacatggtgaaaccccgtctctactaaaaatacaaaaaattagccaggcatggtggcgggcgcctgtagtcccagctactcgggaggctgaggcagaagaaccgcttgaacccgggaggcggaggttgcagtgagccgagatcacgcccctgcactccagcgtgggggacagagcgagactccatctccaaaaaaaaaaaaaaaaaaaaaaaaaaaaaaaaagcttccaatgtttctgcaaagatgagacccactaccagagaggttcggtgagtatcttttgtttgtttgtttttgagatggagtctcgctctgctgcccaggctggagtgcagtggcgcgatctcggctcactgtaacctccacctcctgggttcaagtgattctcgtgcctcagcctcccgagtagctgggactacaggcacccaccaccacacccggctaattttttggatttttagtagagacggggtttcaccgtgttagccaggatggtcttgatctgacctcctgatccacctgcctcagcctcccaaagtgctgggattacaggcatgagccaccacgaccggccagagatttggtgagtattaagtgagatatgggaagagtgcttcctttggtgcctgtttcagagttaagtactttagtggggatggggtggtcatgggactgactagctaagcctgggtagttgtcaaggagggcttcctgaagaagggggtagctgagctgtgaactgaaggaggagaggcattaaccgggacaaagagggcaggatggattttagcagtggtaacagcactggcaggggcctggagtcaggaatatgtggcctttctgttgtggttgttgttgttgagatagagtcttgctctgttgcccaggctggagtgcagtggtgcaatctcggctcactgcaacctccacctcccgggttcgggcgattctctggcctcagcctcccgagtagctgggatcacaggtgctcgtcaccacacctggctaattttttatatttttagtagagatgggtttccaccatgttgaccaggctggtctcggattcctgacctcaggtgatccgcctgccttggcctcccaaagtgctgggattacaggcgtgagcccagcctttttttcctttctttctttctttctttcttttttttttttgagctggagtttcagtctgtcacccaggctggagtccaatggcacgatctcggctcactgcaacctccacctctcaggttcaagcaattctcctgcctcagcctcccaagtagctgggattataggcgtgggctaccacgcccagctacttttgtagtttagtagagatggggtttcaccatattggccaggctggcctcgaactcctgacctcaagtgatccacccacctcaacatcccaaagtgctgggattagaggcgtgagccactgtgcccggtgtttttgtttgtttgtttgtttttgtctctttttttgagatagagtctctctctctgttgcccaggctggagtacagtggtgtaatctcgactcactgcagcctccgcctcccgggttcaagtaattcccgtgccttagcctcccaaatacctgagactacaggcatgcatcaccatgcccagctaatttttgtattatttattattattactttttgagacagagtttcactcttgttgtccaggtgaagtgcaatggcacaatctcagctcaccgcaacttccgtctcccaggttcaagcgattctcctgcctcagcttcctgagtagctgggattacaggcatgcgccaccacacctggctaattttgtatttttagtagagatggggtttctccatgttcaggctggtctcgaactcccgatctcaggtcatccacctgctttggcctcccagagtgctgggattacaggcgggagccaccatacctggccatcgtggccaatttttttttttttttaggtggagtcttgctctgtctcccaggctggagtacagtggcacgatctcagcttactgcaacctttgcctcctgggttcaagtgattctcctgcctcagcctcctgagtagctgggattatagtcatgcaccaccacgcctggctgacttttgtatttttagtagagatggggtttcgccatgttggccagcctggtctcgaactcctgtcctcaagtgatccacccgccttggcctcccaaagtgatgagattacaggcatgagccaccacgcccggcccaacaaggcttattgaacaacctgaaaattattcccagtgagtggagctgagaagggaggaagtagagagagttggtgaggaggtacatactgggtcctccaatgagatcatgaaaaaccactgggctttattctggtgtcatgaaggttttatgcagggcagtaacccagactgtgtccttctcccaaattcagaggcaaccagagccttcccaaggcactgtgtccaagtcggctgggaatcctggacttgcccaaaggctgtggcacaaccctgacactccccttcatgagtcagacagtcttgggtttgaatcctgactcttccactttgtagctgtagctgggagcaggtgactttacttaataagcctcagtttcctggcctgtaaataggacataaaacacccattaggttttaaagacttaacgtgatgctttacacgtgttaaacaatgtgtactcaataataataatatttattattaactcacaacaactcgattcagcacttgggtggctggataaatccccaaatctgtccttttccctcttagccctaaagtctcacctcggttcttcaatgatgctaatagctacaatttctcagccctttttgtgcatttttgtttttgttgttaaatccacataacagccatggaaggcatatatatgttttattatccagatttacaaagaaggcaactgaggctcagagtggtcaagtcacttggtctcaaaccacacaactactaagtattaaacctgtagaacctcactcccattttactgaagagaaaagtgaggctcagaaaggtgaaagatgaggtatcatgccaaagactacacagttggcaaatagaactgggatttttttttttttttttagatggggtctcactgtgtcacccaggctggagtgcagtggtggaagctcagctgaccgcaacctccgcctcccgagctcaagcgatcctcccacctcagcctcccgagtagctgggaccacaggcacccaccaccacgcctggctaattttttgtttttttggtacagacagggtttcgccatgttgcccaggctggtctcgacctcctgagctcaagtgatccacccacctcagcctgggaagtactgggattatatgcgtgagccactgcacccagccagaactgagatttaaacccttgcctgttttgggtttcctggacacgaggagcctctcctagagggccgaagggcctggtaggacccaccctctgagccatgaggctcctccttgagataagccaggggaggctggaaactttccgtcttactacccctattctggggccctcggcatacctttccaaataccaacccctccttccagaatgctcttcccacagcctccctttcgcaaaacatcaagctagggttagctcttttccaggaaatgttttcaagtctcagttgaatcactcttgagcggttgaggcccctcttgttattgtctgtactgcctttcttttctttcttttttctttcttttctttctttctttttttttttttttttgagatggagtctcactctatcgcccagcctggagtgcagtggcgcgatctcggctcactgcaacctccgcctcccgggttcaactgattctcctgcttcagcctcccgggtggctgggactacaggcacgtgctaccacgcccggctacttttccgtatttttagtagagacggggtttcactgtattagccacgatggtcttgatgtcctgatcttgtgatccgcccacctcagcctcccaaagtgctgggattacaggcatgagctaccgctcgcggcccgtctgtgtctctttctttctatttaactttccccttccttccttccttccttccttccttccttccttccttccttccttccttccttcctccctccctcccttcctcccctccctccccttctctctttctctcttttttttttccagcttccaaaagctttattggcaaatatgctctataaaagaatgatcaatcctgttgcctctaagtcagtagaatgaagagctgtgtccagggacacaccacaccgtgctgaaggagactgctgctgtgtccacctcttattcatagacccagtcatgagcacaagacttgtagtcaaccagttcttcaggcttaaaccgtaggctgatttctttttcagcactttttactgaatcactgccatgaatgatgttcctgccaacctgaatgcaaaagtccccacgaatggtgcctggcttagaatctgctggattggtctccccaagcatcactcggcctgtcttcacgacgttcagcccctcccagaccatggccacgaccggccctgagttcatgtacttcaccagcccagggaagaacgggcggtccttcaggtcaatgtagtgctgcttcaggtgttcttcagaggccgggaggaacttcatggccacgaggcggaaccccttctgctcgaagcgcttgatgatcttgcccaccaggccgcactgcatgctgtccggcctgatggtgatgaaggtgcgctcgaggttggccgtggtccgggaagctggaggggccaggcggcagtgctgcgctcctctctttcttttttggaacaaggacttgctctgtcacccaggctggagtgtaatggtgtgatcatggctcactgcagcctccaactcctgggctcaagcaatcttccttcctcaacatccccagtacctaggactacaggttggcacctctacaactggataattttttaatgttttgtagagatgggctgttttcctgaactcaagtgatcctcccgcctggcttccctaagtgctgagattataggcactagccaccacacccgtccagtagtgacatttttttaaatgtactttttaaaaattatttatttattttatttttattttttgagacagagtctccctcttgtcacccaggctggactgcaatggtgcgatctcagctcactgcaacctcccactcctgggttcaagtgattctcctgcctcagcctccccagtagctgggattacaggcataccaccatgcccgactaacttttttcgtatttttttagagatggggtttcaccatgttgcccaggttggtctggaactcctgggctcaagcagtccaccttccctgacctcccaaagtgttgggattacatggcgtgagccactgcacccagccttgtataagtaccttttttttttttttttgagacggagtttcactcttgttgcccaggctagagtgcaatggctcaatctctgctcaacacaacactccactgatgaactacttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaaacagttcatcaactatgaaatacaaaaattagctgggcgtgatgctgtgccctgtagtctcagctactcaggaggctggacaggagaattgcttgaacccaggagatgcaggtttcagtgagctgagatcggccactgaactgtggcctgggcaacagagcaagactccgtctcaaaaaaaaaaaatatatatatatatatatgtacatatatatagacagagagagagagagagagcacacacattggcacattgttggcaagtttcctcagcattcctagttgtaaatgacagaaaactcactgatgcaaacaaagcaaagaatcataataattattattatttactgatttacaactggatcaaggagttcaaagattccaattcatgtccttgccatgtcttgactctgctttcttctgtggtttcaatctcagacagacacgctcctccccagggtgacaagaaggctctcaggagctccacccatgctttttcctgttggttaaaaaacagtgcctctctccagcaaaaatctcaagtctcccactgattggctcccattgggtcatatgcctgttcttcaaccaatcctgtggccaggctggatcccagggccaaccctggaggcacaggtgggcagagtaagttccatccaagatacaggaactgatattgggagagggagagttccccagggaaaactggggggctgtttccagaagacacatgttcaccatctggtagttgctgcctctctgttaaccaaatttaatgagaggctgtcatcaggagtaattttcttgtatttttactagagctggggcttcaccatgttgcccaggctggtctccaactcctaagctgaggcaactgcccacctcggcttcctaaagtgctgggattacaggcatggccaccacgcctggccatgtttatttcttatcttcatctcacttcatcaatgggcaaattgacagagaggttaaggaattggcccaagtttatacagagagtaaggagtggagccagggcatcctttccaaattctgtgctttagtttctccaggaactacagttagagctgatctatctctcagaattgccagctccgtgccaatgaggaagccctgagccttctaaaggaccaccttgcaaggttaaccaatgtgggatggcagatatcatccacacactcatgagggtttatcctggagcagtgcctggacactgagaggtgtgacaacaaggcaagtctgatccaaggaccattgtggactcaggagctgagattcctcggtagccctgcttccctacccacaggagtggaggagaaagagtgcaacgcacagagaagtgccaagattgagcccctaacctgccgctaaccagctgttatgtgtcttgaataaactcctttaagatctctgtggccaggcacggtggctcacgcctgtaatcccagcactttgggaggccaaagtgggcggatcacctgaggtcaggagtttgagaccagcctggccaacatggcaaaacctcgtctctactagaaatacaaaaattagccaggtgtggtggtgcttgcctgtaatcccagctacttgggaggctgaggcaagagaatcgcttgaacccaggaggtggaggttgcagtgagccaagattgcgccattgcactccagcctgggcaacaagagcgaaactccatctcaaaaaaacaaacaagatctttgtttctacatccataaaatgggcataataacaccttcctcagaggttagcgaggattctattaaatactgcaggcaaaataatacctgcttggctgggtgcggtggctcatgcctgtaatcccagcacttcgggaggctgaggcaggaggatcgcttgagctcaggagttcaagatcaacctgggcaacatagaaagacctcatctctacaaaaaatatgaaaaattagctgggcgtggtggcgtgcacctgtagtcccaggtactcaggaggccgagatgggaggatctcttgagccagggaagtcaaggctgcattgagccgagatcacgccagcccgggcaacagagcaagatcctgtctgtaatagtaacaataacaataataattcttgcttgtcacccagctggtctccatgaggttagttgtctcctttccatattatcccccttctccatcccccagacttagcaagagcaaggcaagcggagaaaggaaagcatcttttatcttctcctagccggcctggtggggtctcctcccctcctcctctgcccagcatctgtaatagcacaaaatgagcacggaacctcgcatcatgttcctgggtttgactcccagctcagccgtcctcttcctaggcttgtgaccttggataagtccctgtcacccctctcagctgaagaacatgctccctcatcgagtctgatgaaaacgccctccataaacgtgcctggcacatggtttgtttattctctggatctgaaacggtgaaagaggcagagctgagtaggtcgggctgccttgggcatggctttggtcagcagaggggccggcttcacgccacttcccatctcctgaataattcatgacgaacaaaatgactgggccagacctgggccctccctcctcctgtcgtgaaggcagaaaagtttctaattacagatcagccggccaggctccccggggcccctgggcgctgcacacagggggcatttatgggaagagaccatggaggggaggggttcggtcccagctcctttccagaagaaactcaactccttttgaaattgtaaccttggcctgctaaggcccaggaagggactggggaaagaaacttagaagaggaagagaaaaccctgccgaggggtcagagagaagcgcccagaaaaaaatgtcaggtcaaagaaggggctctggggacgtcctggcaagaggaatacacaagctgtcaggggaggagatttgctcgagtcccgtggaaagcatgacaaagccgggcttcaaaaggaagctgtccttcgaaaatacattgagaaagaataagatctagcgttctaccatacagtagggagactagagttaataatttgtcatagagttcaaaattgcttggctgggagcggtggctcacgcctgtaatcccaacactttgggaggccgaggcaggcagatcacctgaggtcaggagttcgagaccagcctgtccaacatggcgaaagaacccgtctctactaaaaaaatacaaaaattagctggatgttgtagcgggtgcctgtaatcccagctacttgggaggctgaggcaggagaatcacatgaacctgggaggcggaggttgccgtaagccgagatcacgccactgcactctggcctgggccacagaatgagattccgtctcaaaaaaaaaaaaaaaaaaaatttgctggaggagaggaacggagatgtttcccaacatgaagaaggggtgaatatttgggttgatggatgtcccagttatcctgatttgatcatcacacattgcatgtatgtatcaaaataccacatgtgcccccaaaatatgtaccattattatgtataactttttttttttttgagatggagtatcgctctgtcgcccagtcctgagtgcagtggcgccatctcagctcactgcaagctccgccccccgggttcacgccattctcctgcctcagcctccccagtagctgggactacaggcgcccgccatcacgcccggctgatgttttgtatttttagtagagacggggtttcaccatgttagccaggatggtctcaatctcctgacctcgtgatccgcctgccttggcctcccaaagtgctgggattgcaggcatgagccaccgcgcccggcccatgtgtcacttttttaaaaaaggaagatttcttgactccaacaccacagcctctcagttacactacaatttactcattcatctgtaaaatggggagatgcccaataatgctaccttacagcattattgaggagttacacaagtaaataaatgtcaagtgcttagaatactgcctcgcacataaactaaaaatatatattagtagttgtagagttgttttttttttatattatgctccctccatagagtggtcagtaaagggtgaaggtgacaagaagagaagatttggggagattgttagagagaacaatgattgtgaggtagtttagtatagtgattaagatgaggaccccatacataataccgtaataataataataaaagaggtcagctgcggtggctcatgaccgtaatcccagcactttgggaggctgaggtgggcagatcgcttgagttcaggagttcaagaccagcctgggcaacatggtgaaaccctgtctctactaaaactacaaaaattagccaggcatggtggagggtgcctgtagtcccagctacttgggaaagtgaggcatgagaattgcttgaacccaggaggtgaaagtttcagtgagccaagatgggcaacagagcgtgactctgtccaaaaaaaataaataaataaaataaaaaagaggccaggtgtggtgtggtggctcacgcctataatccagcactttgggaagctgaggggagtggattgcttgagttcaggagttcaagaccagcctgggcaacatagtgagaccctgtctctacaaaaagtacaaaaattagctgggcgtggtggtgggtacatgtagtcccaactacttgggaggctgaggtgggaggatcacttgagcctgggaggtggaggctgcagtgagccaagatcgtgctgctgctctccagtctgggcgacacagtgagaccctgtttcaaaaaaatttaaaaagtaaggactccagcactagtttgcctgggttcaaatcccagctctgcctcttactagttgtgtgatcttggacaggtttgctgtaggtctccgagctcctattcactgtctgtaataaacggtagccactgcagttagtggagagtggtgaacaaaatgaccaaggtccctgtcctcatggagcttacagtctagcaggaaggttatactaatcaagagcgtttattgcatgccaactgtgtgcaggtcctgtgcacttggcagacattctcttaacgaaatttcacagaatccacccctgtcttacagatgaagagggtgaaactcaaagaggtcacaagcagagagaggatttagaactgaaaggtcactccacagtatggatgaatcaccacattagcatggtgagcgaaaaaagccagatgcaaacgagtacacattgtatgatttcatttatatgaaactctagaaaatgcaaactaacttatagtgacagaaagcagatcaggggttgcgtgggacagggtgggcggggcattcactgcaaagagcctgaggaacctatttgagaagatggaaatgttttacatctgacattgatactagttacatgggtgtatgcatttgtcaatgttcatcgaactggacacttaaaatgggtgtattttcctgcatgtaaattatacctcaatgaagctgatcttttcaagggggtggggaaggtataccagactccagagctctgcaacccttcctatattatttgagtgtctgatttcaagctcatttgtgggcagagactgtaatagattcatctttaggtcctcccctcacttcccagcctgagggcctagcaaaattcttttttttgttttttttttttgagatggactctgactatgttgcccaggttggagtgtggcagcacaatgttggctcactgcaacctctgcctcccgggttcaagagattctcttgcctcagcctcccaagtagctgggattacaggcgactgccaccacatctggctaatttttgtatttttagtaaagacggggtttcaccatgttggccaggctggtcttgaactcctgacctcaggtgatctgcccgccttggcctcccaaagtgttgggatgacaggcgtgagccatcgcgcccaaccaaaattcttaaacccaatagttcagattagcaaatataccctgggcaccttctctgtgctgggtgctgcggtcacagaccaatcagtctagtggggaacacagacggaaaaggccaaatagacacagtacagtgggtaaatgtgctgatggagtaaacagttcattactgggccacagcaatgaatcctgcatagagtctggaacttgggatgtgaagatctcaaactgcaattcatcacctgcattcaaatctccactctaccgcttgctgtatgactttgggtgaccattttagcatgccaaacctcagtttccacctctggaaaatggagatcatagtagctccaatctagaggggtgttatgagaattaaaggagacagcaataaaatgtttagcatggcaggcatagtaagtacttcataattgttagtcatttttatcatgaatgaagagcagggaggtggggagaggcacacggggtgtgtgtatgtgtagtgggggttcactacccaacctgaggtgagagaggactgagaggtgctttcccagagaggtgatgcttggaggaggaattggctagtttaagtggccatgggggcaggagggagtgggaacagcttggaacaaacgctcaataaatatttgctcaataaataaaaaaacagagactgtgcaaaacctgcctgtaaccaaggggacagagagggcctgccagaggagactggggggtcctcaggaggcgggggctgggtggctggcccccacaggcaggctccagaccttcctagcctggtccgaccccaccctgtgccctgcccagttcccctgataggtttggacagccccagacctgaggcctggagcccacgggaggaggaacggtggggagggctggcgggacaggggtcctcacaggccttctccctctaatgagaaagggccaagtccccgcaaggcgcctcccgcgcccccgttgtccgagccacaaaggaccaggatcaatggaaggcgggagcgaccgaggggcctcctctttgtgcggctgtctcaggcctgtttgcgccgccgtctccgcgcccccattgatcaggcatgtggaaagattccgcctcccgggctccctttgtggccgcgttgccaggctgcgcccggagtgactgcaccgcgcagggtgtacccgcctgcggtgggcaccgggctgcgagacggggtgggatcccaggagggcagggtggccagatttagcaaataaaaatacaggacttccagttaaatgtgaatttctgataaataacaaaagcaaacaaaaaacaaagtataagtatgtcccaaatattgcatgggacatacttacactcaaaaagtattggttgattatctgaaatttcaacttaactaggcgtcctgtattttgtctggcaccctttgaaggggaagctgaatacatctgcattgcctagcacttatattacccccaacttcagtggttgaagttttgtttgtttgcttgctttttgttttttatttttattttttggccatatctgcacaccccgaactgctatttagatagaatttttctttaaataaatttatttttttaaaaatcttaacctggccgagctccgtggctcaagcctgtaatcccagcactttgggaggctggagggggaggatcacttgaagccaggagttgaagatcagcttgagcaacaaagtgagatcccatctctacaaaacaaaacaaaaaactcccttaacctattaaccgtgatttattgatgcatagtgcaaatacattaacttgaacaaatatgaaatgtacctgttgatgcatttttgcctacaagaacactcatgtgaccgcacccacatcaagatatagaatattcccggccagcagtggtggctgacgcctgtaatctcagcactttgggaggccgaggtgggcgaatcacttgaagtcaggagttcgagaccagcctggccaacaaggtgaaatcccctctctactaaaaatacaaaaattagccaggggtggtggtgcacgcctgtaattccagctactcaggaggctgaggcaggagaattacttgaacccgagaagcggaggttgcagtgaaccgaagtggtgccactgcactctggcctgggcgacagagcgagactccatctcaaaaaaaaaaaaaaaagatatagaatattcccatcaccccagaaggttccctggcgtccctgagcagttgagcagtatccacctccccattggcagccatagatttgctttagctattcttgaacttcgtatcagtggaatcgtatagtataatgtgtacactcaagtctagcttctttcgctcaatattatgtttgtgaggatgggcatggtggctcacgcctgtaatcccagcactttgagaggcccaggtgggtggatcagtatcacctgaggtcaggagttcgagaccagctggccaacacagcgaaaccccatctctacaaaaatgcaaaaattagctgggcatggtggcaggtgactgtaatcccagctacttgggaggctgagataggagaatcacttgaatccgggaggcggaggttgcagtgagccaaaattgcaccactgcactccagcctgggctacagagtgagatttcatttcaaaaaaacaaaaaacaaaacaaacaaacaaaaaaagtctgtgacatttgtccccattgtagattgaccagttgtttgttccctttcgctgctggctgagtattccattatatggctgttccacggtttgttcctctattttcttgttgatgggtgtcttgattgtttccagtttttgctattatgaataaagccgctatgaccatacttgcactggtcactgtatgaacttaaatatatttaacctaagcaatactatttgtgaactcacaggcttaaaatgctactttaattttttttctcctgcacattaaatatataacgatgacacatgtttctgggaacatctttgtattgaccaagctcactgtgaatggtcacatatcaaactgcagaatagacgttaagagaacagactggcttggggtaggtctcgagcaagtgcgtcagtccctctgggcctcggtttcttcatctgtgcaatggggggtgataatgttaattatctcacagagtggttgaaaaggcaaaatgggccgggcacggtggctcacacctgtaatcccagcacttttggaggctgaggtgggtggatcatgaggtcaggagttcaagactagcctggccaagatgacaaaaccctgtctctgctcaaaccacaaaaattagccaggcacggtggcaggcaccttaatcccagctacttgggaggctgaggcaggagaattgcttgaacccgggcagcagaggttgcagtgagccgagatggtgccactgcactccagcctgggcaagaaagtgagactgtctcaaaaaagaaagaaaggaaagaaggaggaaggaagaaaggaaggaaggcaggcaggcaggcgggcaggcaaggcaaaatggggtaacaccttataaaagggccagccatggtggcacacaggagagttgcttgagcccaggagttcaagatcagcctgggcaacatagtgagaccccgtctcaaaaaaaaaaaaaaaaaaggatacagcatagggctgacacatagtgggtgctctacacagggagctattatccagtgctggatgggcagtagcaattgaactggctatgttagatgcctgttctcattctattctcatttcaaccctttgaggtagctactgttattatcaacctattttacagattaggaaactgaggctctgagaggcagtcacttgcccaaaatggtatagttagtaagcggcaaaggcaccacctagtgtgttttccagagcccaagggggcaggagggaccaatgaggctctcatgcctggagatgagaatgggttatacaggaggaggagctgggtaccttctccttcctgcctctgcatccccaattagcgcccagcttgaaggcaagcaggtttctctttggagggtgggaggagctggcctggacatttctaggagacgccaagccttccagccaacgggcaggtgggaggacaggcagggcaagtctgacggggtaaggaggggaacagaggaagccggaagctggaggaaaagcctggcctcctgtagccacagccgctgggcagagcccggcctcgctacctgccatctgaagggcacgggaactgctgatctcaggcgattagcataacaatccccgatccggcgtcctcgggtcccaaagctgggtctgcacaatcccatttcaagccagctctttctttagctggttaattagggagggcacagactacttaaagggccctgtacacacggccttggctgcagctgggagcaggagagggcccgacaataccttcagtcctggcaggtgtgggtgctgccatagtgcttcacggcaggccacggcgaaaaggctgctctcaccggggatttcaccgggcctcctgttgccaccctccaaagccccattagtgcacatctaggatagatatggcctgttcacagctcatgccagggctcggcacagaataggtgctcaaatataacttctaaaataagtaactgggccaggcgcagtggctcatgcctgtaatcctagcactttgggaggccaaggcaggaggatcacttgagtttcagaccagcctggccaacatggcaaaaccttgtctctactaacaatacaaaaatgagctgggcgtggtggcacacgcctgtaatcccagcaactcaggaggctgaggcatgagaatcgcttgaactcgggaggtggaggttgcagtgagccaagattgccccaccgcattccatcccgggcaacagagcaagactctgtctcaaaacataaaaataaaataaaataaattatccaggtgtggtggtgcgtgcctgtggtcccagctacttgggaggttgaggtgggaagatcgcttgagcctgggaggctgaggcttcagtaagctgcgatcctgccaccgcattccaccctgggtgacagagcaaaaacttgtcacgaaaataaataaaataagataactcactgaagcatggagcccatagtccagaactcaggactctacctactcatataatgagggcccaggctgaatgctaatggagggtacaggggcagccccagccttgcaggtccctcagggtcctaagcccttccttccccttcccacagcctccttgcactggaagtccaagagggcacttggatcagagtaggcagaacatagtctttgggatgagatagagggtagagctgggttcgaatcctggctctgctgcttactagctgtgtgatccagaggaagtctcttaacctctctgaggctgttttctcttctgtaaatggggatgatcaaaacctgcttcaaaagttgtttacaggtatttcttaaaatatcatatgagagcgtctgccacagagttggggctcagggaatgggagtccttcctcttctgtagaaatacccactgcctttctacccgcgtggctaatgttccccaggtccccatcatgcacccgctcagtgcttgttctctctgccatcctgtcaatgcccttgtgaggtaagttctgtgctttctttttttttttttgagatggagtctcactctgtcgcccaggctggagtgcagcggtgcgatctcggctcactgcaagctccacctcccgggttcatgccattctcctgcctcagcctcccaagtagctgggactacaggcacctgccatcacacacagctaattttttgtatttttttagtagagacagcatttcactgtgttagccaggatggtcttgatctcctgacctcgtgatccacccgcctcggcttcccaaagtgctgggattacggggtgagccaccgctccctgccagttctgtgctttttaaagaaaaggggcccggtggtgcagtggctcatgcctataatcccagcacttttttgtttgtttgtttgtttgtttgtttgaggcagagtcttgttctgtcgcccaggctggagtgcagtggcacgatctcggctcactgcaacctctgcctcccgggttcaagtgattctcctatctcagcctcccaagtagctgggattacaggcacctgccaccacgcccagctaatttttgtaattttgtagagatggggtttcgccacgttggccagactggtcttgaactcctgacctcaggtcatctgcccacctcggcctcccaaagtgctgggattacaggtgtgagtcactgcgcctggccaataatcctagcactttggaagacctaggcaggaggatcacttgaggccaggagtttgagatcagcctgagcaatgtagcaagaccctgtttcttcaacaaaattatatattcaaaatgttaaggctgagcgtggtggcttgcgcctctaataccaacactttgggaggctgaggtgggaggatggcttaagcccaggagtgcaagatcagcctgggcaacatggtgagacatcatctctacaaacaaaattttttaaaataaaaaataatgatttttaggccagatttggtggctcatgactgtaatcacagaactttgggagggcaaggcaagctgatctcttgaggtcaggagttcaagaccagcctggccaacatggtgaaaccccatctctactaaaaatattaaaaaattagagccaggcacagtggctcacacctgtaaccccagaactttgggaggccgaggcgggccgatcacaaggtcaggagatcgagaccatcctggtcaacatggtgaaaccccgtctctactaaaaatacaaaaattagctgggcgtggtggcacatgcctgtaatcctagctactcgggaggctgaggcaggagaatcgcttgaaccgggaagtcagaagttgcagtgagccaagatcgtgccactgcactccagcctggcgacagagcgagactctgtttaaaaaaaaaaaaggccgggcgcagtgactcacacctgcctgtaatcccagcactttgggaggctgaggcaggcagatcacctgaggtaaggagttcgagaccagcctgaccaacatggagaaaccccatctctactaaacatacaaaaaaaaaaattagccaagcgtggtggtgcatgcctgtaatcccagctgctcaggaggctgaggcaggagcatcactggaacccaggaggcagaggttgccgtgagccaagatcacaccattgccctctagctggggcaacaatagcgaaatgccatctcaaaaaaaaaaaaattagttaggtgtgatgacacacgcctgtaatcccagctagttgggaggctgaggcaggagaatctcttgaacctgggaagcccactgcactcagagtgaatgagactgggccacagagtgaatgagactctgtctcaaaataaataaataaataaatataataataattttttaaaaaggaaaatgaagtcagagacaaagtgacttgcccaaggccacacggctagaaagtttcaaagggaggcttgagctcagctaaccctaagaacaatggctctggagccaggaaaggatgggcattattgcagccactgctccctttccactcagccagccagatagtctcaggtatcttttgatcttctgctgtgtgttaagcattgtgctgagggcaggggatagagctgagcacaatcgccattttccatcaatgtctgtgagtgttaagggcttgaggacagtaaaacagggtgataggctagaggcctgggggtctaggaagacttcttctgtataggtgatacttgaactgcaggattgccatgggaagaggggggcaggtaagtgggaagcattccaggtaggcgggagagcaggtgcaaaggtcctgaggtaggacttagtttggggtatctcaggaactgaaaggcagccagtgtggctggagcactgggagggagagtgagagtgggatgggccaggctggagagggaggaagggccttaagggacatcctaagaactccttccttcccttcctccctcttccttcctttcttctctccctcccttccttccttcccttcctcctcctccttcctttcttccctccctcccttcctgccttccttctcttttttcttcccttccttcctttccttctccttccctcccatcctttttttcttacttcctccctcaatctctctctctcttcctactttccttccctccttccttccttctcttgttccttcctcccccctctcctttccttccttccctccttcttccctcttccctccctttccttctctccttcctctgtccttttttttttttttttttttgagacagagtctcagccaggcatagtggctcacgcctgtactcccagtacttggggaggccgaggcaagtggatcacctgagatgaggtcaggagagtttgagaccaacctggccaacatggtgaaaccctgtctctagtaaaaatacaaaaattagctgggtgtggtggtgggtgcctgtaatcccacctacttgggagactgaagcaggagaatcacttgaacctgggaggcagcagttgcagtgagccaagatcatgccactgcactccagcctgggcgacagagcgagactccgcctcaaaaaaaaaaaaaaaaaaaaaaaaagagacagagtcttgttctggcaccatctcagctcactctaacctctgcctcccgggttcaagcaattctcctgcctcagtctcctaagtagctgggattacaagcacctaccaccacatctggctaatttttgtgtttttagtagagacggggtttcaccatgttggccaggctggtctcgaactcctgacctcaagtgatctgcccacctcagcctcccaaagtgctgggattacaggtgtgagccaccgcgccaggctccttccttccttccttctttccttcctctttttcttcctcccttccctccctccgttcctcccttccttcttttctctctctccttcctttcttccttccccccttcctcccctttttccctgccttcctaccttccttccttctttctctccttccttcctcccctcctccctctcttccttccttcctcctctccttccctccctccctccttactctctcccttcaatcctcgtgtctttccctccctctctccagtctttctcacttcctatcttggttctttctgtcctcttcttccttcttcccctccgtcctctcgtacttcaatacatccgtgcctgctttactaccttgtgtgcatgactacttgtttgaaagcattggcgtagggggctgcagggcgcggtgactctctgggcttcgcggcctgtgcccgttctccttgccctagctgagaggacgtctattaacagtagaacaatcgcattgggacgagttgtaatattcgattgtagagtaattattgcgtggatgagatcggtggttgtggaatagttgggaggactttgttgtgtttgtagtgaatttttttgtgtattaaaggattagcgttataggtagataatttcattttatatttagttatctaatagtgtttgattgttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcctgcgctttatcggaacgtacagtagttcttacatgaggtaagtagttcgagaccagcctggccaatatggtgaaaccctgactctactaaaaatacaaaaattagctaggtgcggtggcgtgagcctgtagtcccagctactcaggaggctgaggcaagagaatcgcttgaacccggaaggtggaggttgcagtgagccaagatcacgccaccgcactccagcctgagtgacatagtgagactccgtatctacgaaacaaaacaaacaatatatgtatatttgttttgttttgttttgtagagacagggtctcgctatgttgcccaggctgatcttcaacacctgacctcaagcgatcctcccacctcggcctcccaaagtacagatgtgagccactgtgcccagccacacatctttctctctctccatatatatatatggtggtgcacacctgtaatttcagcactttgggaggctgagggaggaggatcacttgagcccaggagtttgaggccagcttgggcaacatagtgagagcccatctctatttattgaaaataaaacaagaaataaaacaaaatggggccaggtgtggtggctcatgtctgttatatatatatacacacacacacacacacacacacacacacacacatatatatagtgtatatatatgtatatgtgtatatagagtataaatatatatactctatatacatatatacatatatacacatatacgtatatatagataaatatatatacatatatatttataatatatatgtatatagaggatatatactatagatcctctatatacatatatacacacacatatatagtgtgtgtgtatatctatctttgattaaaataacagtatatgctgaagagtcacttctaattattacttttgttttacaaacttaggtcaagagagaatgtggagtaaggccttaagattcataacaacgcctaggtgcaaatgaagggcctttactcactggacttatgctgtcatggagtcatagacttagagtcatggattggctttaactatggttttcctttctgctttcaggaaaacatttaatttccaccctgggcgtagtctatgcccagcttccttgtggtgcgctgtttctgtctgccttttgtctgtgtgctggtggtgtcagagccagtaactatctgtttacagtttcagacagtagcattaattgccttttgaacctcccattttcctccaagaactccctgcctaactgtctcaactgtctccctggagtttcttttctgtgtggaaatgtctattttttttcccataaaatctgaccacctgcaaatccctacatattctcttgtgagtaggcaacatgagagaaagacatgtaggtggcagataatctgcgcaaatcagagcttacaggatgaagcttctaggccaaacaacaaggcagctgttgggtggcagaaagagccctggaattggaggcagaccagcaagtgaaatctggttttgttacttacttgctctgtgacctgggacaagttactgcatactgctgagcctcagtctcctcatccataaaatgggcacagactgggtgcagtggtgcacacctgtaattccagcactttgggaggctgaggcaggaggatcacttgagcccaggactttgagactagcctgggcaacatagcgagatcccatctctatttctttaaaacaaaacaaaaaataaaataaaatggggccaagcgtggtggcttatgcctgtaatcccagcactttgggaggctgaggtgggtggattgcctgaggtcaggagttcgagaccagtgaaactccgtctctactaaacatacaaacatgtctacaacatggtgaatctccgtctctattaaaaatacaaaaattaactgggcatggtggcacacacctgtaatcccagctacttgggaggctgaggcaggagactcgcttgaacctgggaggcgtaggttgcagtgaggcaagatcatgccattgcactccagcctgtgcgacaagagtgaaactctgtctcaaaaaaaagaaaagaaaataatacctgtttcacaaggttggataatttacccgtatgacaaaggcactgtcttctggaaaagcacatttctctgccctttacttgtctagtatgggttcaaaatagtaataaaactaacatttattgaacactgagtttgagctcagcattatttcagccttacgacaaatccttcagggggccagccactgtggctcacacctgtaatcccaatactttgggaggccgaggtggcaggatcacttgagcccaggggctcgagaccagcctaggcaacatagggagaccctgtctctattaaaaaaataaataaaataaaaaataaaaataaatttaaaataccaaacccttcaaagttgttgctattataatactcccacttcacagggatggaagtagaggatccgagagtaagttgctgaaatcacacagctaagtggcaaagctgggatttgaacccaacagtttcactttacagcttactcttaaccaggaccatatggcctccactgtggtagtagatatcagccacccacagtggaggccagatagggctaaaagctgtgggtgctgcctcctggggaaaaccacattgttctccgacttccctggcccatatgccaactctacttcataaagagctgatttttttttttttttgagatggaatctcgctctgtcacccagactggagtgcaatggcgtgatcttggcctactgcaacctctgtctgctgggttcaagcaattctcctgcctcagcctcctgagtaactgggatcacaggtgtgccaccatgcccggctaattttttgtaattttagtagagacggggtttcaccatgctggcaatgctggtctccaaatcctgaccttgtgatccgcctgcctcagcctcccaaagtgctgggattacaggcgtgagccaccgcgccctgcaagagctaatgttttattttgttattttttatagagacaaggtcttgctctgtcaccccggctagagtgtagtggtgtgatcatagctcactgcagcctcaaacttttgggcttaagtgatcctcctgcctcagcctctcaaagtgctgggattacaagtgtaagccattgtgcctggccagcttgatgaggtttttttgtttgtttgagacagaatctggctctgttgcccatactagagtgcaatggcatgatgtcagctcactgcaacctccgcctccggggttcaagcaattctcctgcctcagcctcccaagtagctgggaccacaggcgtgtgccaccatgcccagctaatttttgtatttttagtagagatggagttttgccttgttggccaggttggtcccgaactcctgaccttaagtgatccacccacctcggcctcccaaagtgctgggattaagggtgtgagccaccgcctcccacccagcttgatgttttaagagtccagaccctaactactcttgggagacatggtgggaataaggaagtggcagctgggctttggaatccaaaccctggcccctcctggacactcatgcctcctgtgtaccaaggggaaggtggagaaaccaaggagataggtcctgtgggagcctggacaggggaatccatgggcacatatatctctacgtgcttgggcaccatgatgtcagcagagcactggttaacacatgcatgcacccacgccgtcagactcacggtgaacacgtgagtacacatgtgcatatctgtggctccacaagtacgcacatccctcactcacacactcacaggtccgcccaccctgcactgaattcctggattttgtcagaaccccattagggccgggcgcggtggctcacgcctggtaatcccagcactttgggaggccaaggcaggcagatcacttgaggtcaggagtttgagaccagcctggccaacatggtgaaaccccatctctactaaaaatacaaaaattagccgggtgtggtggtgcacacctgtaatcccagctactcaagaggctgaggcaggagaattgcttgaactcaggagctggaggttgcagtgagccgagatcgcaccactgcattccagcctgggcaacagagtgagactctgtctcaaaaaataaaaaaaaatttaaaaaaaagaaaagaaaagaaaaaagaacctcattaggcagaatagcagaatagctaggtcaagtgtacaactctgctcttgcctgttgggtttgaatcctggttctgccaaataccagccaagtctttgggcaaatcctctcatctttctgtgcctctacttacccatctgcaaatgggagtaataataatatctgttcctttgagttgttgggagtttaaagaattgtagggtgtcgccgggcacggtgtctcacgcctgtaatcccagcactttgggaggccgaggcgggtggatcacgaggtcaggagatcgagaccatcctggctaacatggtgaaacccctgtctctactaaaaatataaaaattagctgggcatggtggtgtgtgcctatagtcccagctacttgggaggctgaggcaagagaattgcttgaacccgggaggaagaggttgtggtgagccaagatcatgccactgcactccagcctgggtgacagagcaagactttgtctcaaaaaaaaaaaaaaaaaaaaaaaggtcctggtgcggtggctgacgcccgtaatcccagcactttgagaggccaaggtgggtggatcatgagatcaggagttcaagaccagcctacccaatatagtgaaactccgtctctactaaaaacacaaaacttagttgggcatggtggcgtgtgcctgtagtcccagctgctccagaggctgaggtaagagaatcacttgaacccaggaggcagaggttgcagtgagctaagactgcaccactgcactccagcctgggcaacagagcaaaactctgtctcaaaaaaaaatttgtaaaatattaaaaatgtataaatatatatagagagaaaactagaaggaaataaattaaaatgttaatatggttgccttgaataatatgggggattatattttatttaatcaacactatttctttaagaaactgtgtttatttaatggacattttttgtttttttggtttttttttgagatggagtcttgctctgttgccaaactggagtgcagtggcgagatctctgctcactgcaacctccgcctccaaagttcaagcgattctcctgcctcagcctcctgagtagctgggactacaggtgcgcctcaccatgcccagctaatttttatatttttagtagagacagggtttcaccatgttggattacaggtgtgagcctccgtgcccggcctgtattttctttaataaatatatattagaattatatatagcaaaaccacatttcttttgttttgttttgtttttgagacagagtcttgctctgtcacccaggctggtatgcagtggcatgatctctgctcactgcaacctctgccttccgggttcaaacaattctcctgcctcagcctcccaagcagctgggatgacaggcgcctgccaccacccccggctaatttttgtatttttagtagagatagagtttcaccatgttggccaggcttgtcctgaactcctgaccttaggtgatccacccacctcagcctcccaatgtgtagggattacaggcatgagccactgcatccagccctaaaccacatttctattagctagtttttaaaaattacaaatgtaacatgtgctcacattaaaagaaaaaaatgcgtcagtacacaaaggtataagatgaaaaagtaaaagttctttaccccttagactccttccctaaatgtaactgttaccaatttcatgtatatccttccaaaaatgttccatgtctatatacttagatatgattattatattttaaaaaatagatataggctacttgggaggctgagacgggaggatcacttgagcccaagaggtcgaggctgcagtgaggtataatcacgccattgcactctagtctgggcaacagagtgagaccgtctcaaacaaaacaaaacaaaaatagatatagaatcacacaatccaaatgattttggaacttgcttagttatttactatagtacagatttttggatatctttgcatgtatgatatactcttttttttttttttttttgagacggagtctcactgtcacccaggctggaatgcagtgacgtgatcttggctcactgcaacctctgcctcccagattcaagcaattctcatgcctcagcctcccgagtaactgggattatgggtgagggccaccatgcccggctaatttttgtatttttagtagagacagggtttcactatgttggccaggctggtctccaactcctggcctcaagtgatacacccgcctcagcctcccaaatggctgggattacaggcgtgagtcgctgcacctggcctgatatactctttttttctttttctttctttcttttttttttttttttttttttttgagatggagccttgctctgtcacccaggctggagtgcagtggcacgatcttggctcactgcaacctctgcctcccgggttcgagtgattctcctgcctcagcctccctagtagctgggattacaggtgcgcaccaccacgcctggctaatttttgtatttttagtagaggcagggtttcaccatattggctaggctgatcctgaactcctgacctcgtgatccacccgcctcggcttcccaaagtgctgggattacaggcctgagccaccacgcccagccgatatactcttataatgactacaaaacatttcactgtaaagttacatgatgatttacttacttaatttcctactgatgaccatcaagtttgttgctagcctttgcttttataaacaccttcaaaatgaacaaatttgtttctactatttacctactcctactcacgtgaatagaattttagatgtggaattgctggaccccaagggcttgtgtatttcatatttcaaaataatgccatccagtaacatacatatatataggtggtcctctgtatttattcattccacatccctggactccaccaaccttgatggaaaatatttgggaaaaaaccctgcatctgtattgaacatagacagacttttttccttatcattattccctaaaaaacacagtataacaatgatttaccgggcattgacattgtattagggatcataagtaatctagaaatgacttagagtatacaggagggtatgcatagataatatgcaaatactatgccattttatatcagggacttgaacatctgtggattttggtatctgagggaggtgccagaactaatcccccagggacactgaatgacgactgtatataaagctcaagaagagaaaagatgaatggaagaaaaaaacctcagtgtgaggccagatgccatggctcacgcctgtgatcccagcactttgggaggctgaggcgggtggatcaccaggtcaggagttcgagaccaacgtggccaacatggtgaaacccggtctctactaaaaatacaaaaattagccaggtgtggtggcgcgtgcttgtaatcccagctactcaggaggttgaggcaggagaatcgcttgaacccaggaggcagaggaggcagtgagccaaggtcacaccactgcactccgactcaaaataaataaataaataaaaagaataaaagaaaaaaaaagaaaacctcagtgtgttaagttgtacccaaagtgtttgtgcagtataagtatgcaaaatgaacataaaataaaaatgaactacttagccaagaaataaatcatctatggccatatacttaaatattaaaagtgtttttctttgatttcctttaatgcagaatcaaggaagaaaaaaatgatattctttcatggagccacagatagtttttatactttattttctcaatgtcttatatcaaatattaatttcttttctgtaatcagaaaacagtaccatggatactatgaaaaataacgttgtgctttttaattaaaaagcaatacatagtcattgtaataagtttaaaaataaaaaatgtataaaaatgttaataatgtccctttctttacctctaaatttacccgctggccaggcacagtagctcacacctgtaatcccagcacttgggaggccgaggtgggcggaacacctgaggtgagaccagcctggccaacagggtgaaaccccctctctactaaaaatacaaaaattagccaggcatggtggcgcgcacctgttatcccacctactcgggaggctgaggacacgagaatcacttgaacccgggaggcagaggttgcaggaagctgaaattgccccactgcactccagcctggatgacagagtgagactccgtctcaaaaataaataaacaaacaaacttacccctcgaaataaacaatgttaacggcctggataggaatcttttcaaacatttttctataatagagtgtgtgatttttacatcagaaatgaattttaaaaccttaaaaattttgtttaattacccctgcctggcacttcagcagatcacccttgctatctccaaccctgtcaagctgtgtgccctctttctgtgtccaaacaacttgccctcaaagaaacctacttggggccctgctccctggaggcacctgcgcctctgccttggctcaggttcagcagaaatcaaggccagacccaggaagtgttggccccagctctagcctgatcccggccctggagagccagcgctccccagcctggggagcgaggggcccggcgccaggagaggccctgggctcccagagaggcctccttcccgcccgctttctctaggagtaattaagagtgaaatcctcctcctggtgaccccgtgctccaggcccgggctgatttacacatgaaaggtctacggagggcctgggctttctccttttcacattcacaatgaggcacagcctataaataaaacctctctgggaaacaagaggcttcaaaatgtgtgtgtgtgtgtgtctgtcccccagagggagtgtgtgtgtgtgtgtgtccctgtgtgtgtcccagagtgtgtgtgtgtgtcccagagggagtgtgtttgtgtgtgtgtctgtgagagggagagacagacccagaaggagagagaccagagggagagggggagtttgaaagggctagaaaagggaaggagtgtgaataaaagctggtgttaattgagcgcttactgtgtgccaggcaaccatcctcacagcaatcctgtaagggtggttttatggttcccattttaaagatgaagaaactgaggttcaaagagggcaagagttgcccaagataacacagtgaattaaggggaaggcttggactcaggaagtgggatgaacataagattcaaatgatgggccgggcgcggtggcttacacctataatcccagcactttgggaggctgaggtgggtggatcacctgaggtcaggagttcaagaccagtctgtccaacatggtgaaaccctgtctccactaaaaatacaaaaattagctgagcgtggtggtgcgtgcctgtggtccctgctactccggaggctgaggcaggataattgcttgaacctgggaagcagaggttgcagtgagccaagatcacgccatgcactccagcctcggttgatgaactaactactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatttgagttcgactgcaagtagttcattactcaaacacagccaaagggtatatgaggccccacactggggccatacaaagggtctaagctagccgggcttgcttgtagtcctagctacttgagaggctgaggccagaggatccgttaagcccaggagttcaagtccagcttgggcaacatagcaagacaccatctctaaaaaaaaaagaaaaagaaagtgttcaagacagggatcaggaactcctgggttcaaatctctggtttgccaccagctatgcttcctcttctctacaataggaatgtaataatgtaatatgcatttattcattcctttgtataacaaattttttttttgagatggagtcttgctctgtcacccaagctggagtgtggtggcacaatcttggctcactgcaacctccacctcctgggttcaagcaattctcctgcctcagcctcccgagtagctgggattacaggcgtgcgccaccacacgcggctaatttgtgaattttttagtagagatggggcttcaccacgttggccaggctggtctcaaactcctgacctcaagtgattcacctgcctcggcctcccaaagtgctgggattacaagcatgagccgctgcacctaacaagcatcctgagtagttaggactacaagtgcacaccacctcatccagctaatttttttttttttagagacggggtcttactatgttgctcaggctgatctcaaactcctgagtttaagcgatcctcccacctcagcctctcaaagttctggaattacaggtgtcggccactgttcctgacccagagccagaatttaaatctagaagtctggccccaaagcctccatgtttaaccactctgagatactgcactcttagcacagtgcctggcacaaaatgagtgctcaataattgttaactgttagaattgtcttgatctagtccaggtgcgatggctcatgcctgtaatcccagcactttgggaggccgaggcaggtggatcacctgaggtcaggagttcgagaccagcctggccaatatggtgaaaccctgtctctactaaaaatacaaaaattagccgggcgtgatggtgggcacctgtaatcccagctacttggaaggctgaggcaggagaatcgcttgaacctgggaggtggaggttgcagtgagcagagatcgtgccattgcactccagcctgggtgacaagagtgaaactctgtctcaaaaaaaaaaaaaacaaggaattatcttgatctgttgaaacaaaactacttcaagttggaactagtcttaaattttttgaccataaaagaaaaaaaaacaaagaattgtcttgatcgaggtggtacagggtcaatagaagaggatcaaaatggcatttggctttggaggggcagtcagtctgccctcctgtaggatattacatctaagtcacctaccctcaaataaatgagtgagtcagagacaagtttgggctgggatggaaagagttttccagaaagatatctttccaaaagataccaccagagaggctgggtgcagtggctcatgactgtaatcccagcacttcgggaggccaaggcaggcggatcacctgaggtcaggagtttcagaccagcctggccaacatgacaaaaccccgtctctactaaaaatacaaaaattagctgggtgtgctgacacacacctgtaatcccagctacttgggaagctgaggcatgagaatcgcttgaacccaggaggcagagcttgcagtgagacatgattgcactactgcactccagcctgggcaacagaggagactctgtcaaaaaaaaaaaaaaaaaaaaaaggccaggcgctgtgactcacacctgtaatcccagcactttgggaggctgaggcgggtggatcacctgaggtcaggagttctagaccagcctggccaacatggtaaaaccccgtctctactaaaaatacaaaaaaaaaaaaaaattagccaggcgtggtggcagacatctgtaatcccaactgcttgggaggctgaggcaggagaatctcttgacctgggaggcagaggttgcagtgagccaagatcacgccattgcactccagcctggacgacaagagtgaaacaccgtcttaaaaaaaaattagccaggtgtggtggcgggcacctataatcccagctacctgggaggctgaagcacaagaatcacttgaacctgggaggtggaggttgcagtgagccaagatccagcctgggcgacagagccagactccgtctcaaaaaaaaaaaaaaagatttctgactgaagtgcacctagaggtttgcatagaaggcatagaaggctgggtgtcagggttggtttccttgcagtgggagggggcggtccagctggggtaggctgaatagcgtagctgtgcaggttagaacactggatttagaccttgagccacccaggtttgagccttggccctagcccttcctgctaggaagacctagagcaatctgctttactctgagcctttctttcctcattcataaatggggctaataactggatcttccagagatgttgtgagcttaaatgtgtcaatgtaggtagaaagcctgacacgtgggggcgggtgtgcacagtgatagctattacttatttctgtgttcctacccccacctctcaaccttctgccgagctagattgtcagctttagagggcagacccccagtatcatctatctctgtgaccccatagaatttggtgctcagttatttttccttactggtccctgttgatgctcatacactcgtctacacccgaggttctgcttaggccagccccacgtggttccccacctctgtctgcacacatcacactcggttctcacctcttccaggaagcctttcctggttacatcctgaccctggcctctggtcccccagtgatgttcagcccactgtacctcttatgatgactattccacttcctcattccacttcaggccccaggagaccccctaaccttttttttttttttttaagacagagtcttgctctgtcacccaggctgtagtgtagtgacacgatctcgactcactacaacctccgcctcctgggttcaagcaattctcctgcctcagccttctgagtagctggaattacaggcatctgccaccacacccggctaatttttgtatttttagtagagatggggtttcaccacgttggccaggctggtctcgaactcctgacctcaggtgatctgcccacctcggcctcccaaagtgctgggattacaggcgtgagccactgcgcccggccaggagacccctttttttttcggattcctctaaattctctcaatgcctggcacaggccaggcataacaaaatggttaagaactcaggttctcagacaaagctggatttaagtccacctctggctgggtgaggtggctcacacctatagtctcagcactttgggaggctgagataggaggatcacttgaaccctggagttcaagaccaacctaggcaacatggcgaacccctatctctacaaaaaatacagaaattagctgggcatggtgatgcctgcctgtaatctcagctacttgcgaggctgaggtggaggattgcttgagtccaggaagtagaggttgcagtgagccaaggtcatgccactgcactccatcctgggcaacagagtgagaccctatctttttttttttttttgagacggagtctcactctgtcacccaggctggagtgcagtggcacaatctcagctcactgcaacctctgcctccctggttcacgcgattctcctgcctcagcctcccgagtggctgggattacaggcacccgccaacttgcctggctaatttttgtatttttagtagagacggggtttcaccatcttggccaggctggtctcgaactcctgacctcgtgatccacctgcctcggcctcccaaaatgctgggattacaggcgtgagccaccacacccagccaaaaccctatcttaaaatataaaaataaatccaggttctgctgctattgctggacaagtaattttatgcttcagtttcttcatctgcagaatgaggaaaataatagtacctactgttagggtttttgggagaactgaacatgatgatgtgtgtaaagcacttagcactttcctcaacctatagcagtgatttgtgttatattattattaataaaccactattacattaagtttaaaacaaagcagatatattgtatgtgaaaaggtggtatattggaatgtattgatatcggtccctcttacattatatctcaataaagctgttaaaaacaagaaagcaggctacaaaatattaaatgtatacttctatttttgtaaaacacacgacaattccgtaagggctacactcacatgttgacagaagttatgtctgggctttaaattttctttttaaattttctaccatgaacgtatagtacttgtattataagaacaaaagctttcatcaaaaagcagattataaagttgctataggctaggcgtggtggctcatgcctgtaatcagaacattttgggaggctgaggcaggaggattgcttgattccaggactttaagaccagcctgggcaacatagggagatcccatctctattaaaaaaaaaaaaaagttttttcttgcattgctgtaaagaaattttaaaaaggtcaggcatggtgactcacacctggaatcccagcactttaggaggccgaggtgggtggatcacctgaggtcaggagctcgataccagcctgtgactaatatgatgaaaccctgtctctactaaaaacacaaaaattggcctggcgccgtggttcacgcctctcatcccagcactttgggaggccgagtcgggtggatcacgaggtcaggagatgagaccatcctggctaacacggtgaaaccccgtctctactaaaaatagaaaagttatccaggcatgtggtgcgcacctgtattcccagctacttgggaggctgaagcagaagaattgcttgaatccagggtacggaggttgcagtgagccgagatcgcgccactgcactccagcctgggcgacagagggagactccgtcaaaaaaaaaaaaaaagaaaaaagaaagtaagaaacgaaacaaaacaaaacaaaacgaaaagaaggaaggaaagagaagggaaggaaggaaagaagaaggagaaggggaaggggaaggggaaggggaaggggagggagggaaggagggaaggaaggaaggaaggaagggcgggccccatggaggtcctactcttccgtaatggagggggggtagtgctggggccctggtgtctgcagtgctaaattggaaaccatggacttcacttttaggctgtgcaacgtgagcaagtcatttagcctctctaagcctcagttttctcatctgcaaaatggagatgataataaccatggctgcgtcacagggctgtaaagagattacatgagataaagcttttagcacagtgcctgacccagagccaatatcccaaaacttctggatcctattattattactattatcattattacaactattaacaccagggctggaagggatctcagatcctcaaattcaggggctccctacatagggttcagtggatcaccccctcccaagggatccacagtaggggttcaggagggtggtctgtgtgcatctggaaatagagtacaatattgtgtctgctcattttcctaaggatgagaaacttagctgtcaacaagtaaaaaatggggaaactgagtccagagagggcgaaggggtcttgctccaagtttctccctttattcattcatttattcattcactttttgttttttttttggttgttgttggttttttttttttttttttttttttgagacagagtctcgctctgtctcccaggctggagtgcagtcgcgcgatctcgcctcactgcaagctccacctcctgggttcatgccattctcctgcctcaacctcgcgagtagctgggactacaggcacccgccacaatacctggctaacttttttttgtatttttagtagagacggggtttcaccatgttaaccaggatggtcttgatctcctgacctcgcgatctgcccacctcagcctcctaaagtgctaggattacaggcgtgagccaccgtgttgttgttgagatggagtttcgctcttgttgcccaggctggagtgcaatggtgacatctcagctcactgcaacctctgcctcctggattcaagcgattgtcctgccttagcctcccgagtagctgggattacaggcatgcaccatcacgccctgctaattttgtgtttttagtagagacggggtttcactatcttggccaggctggtcttgaactcctgacttcgtgatccacccgccttggcctcccaaagtgctgagattacaggcgtgagccactgtgcctggcctccttcacttcttatttcttcaacccagcaccaaatctttccccagggcctacattggcccaggatcacagatgaaccagacatggtcaacttcttagtctctactccttacctccttcccccgccccaggggatcttcctccacaaagggtagagtttagtgttttcattatagttcctttgtcaacaccatgccctggggctaattaggcacttcatcaagtaactctaaattcttgccccagttgaatgccttacttacctctacttggaaccttcatttctcctctctgagcctcagtttcccaacctatagaaagggggtaataaaagccttctgcctggggttgcaagaattaaataaaatagaattgaaagtgctttataagctgcaaagtgtggtgccgatattagtattatggtctggagagagaagaaatcaaaattgataaataattgagaactgcacaatctcttctctctctctctctctcttttttttttttttttctggacggagtcccgctctgttgcccaggctggagtgcagtggcacgatcttggctcactgctacctccgcctcctgggttcaagcaattctcctgtcttagcctctcaagtagctgggattacaggtgcccgccaccatacccggctaatttttgtattttttagtaaagacggagtttcaccatgttggacaggctggtcttgaactcctgactttaggtgatccgcccgcctcagcctcccaaagtgctgggattacaggcatgagtcacggctcccagtagtttattttttgagacagagtctcactgtgttgcccaggctggagagcagtggcagatcttggctcactgcaacttccgcctcccaggttcaagcaattctcctgtctcagcatcccgagtagctgggattacaggcacccgccaccatgcccggccaagttttgtatttttagtagagatgaggtttcactatgttggccaggctggtctcaaactcctgacctcaggtgatgcacccacctcagcctcccaaagtgcttggggattacaggcaggaaccaccgcacctggcttcttttctttttaattaagctttattggccaggcacggtggctcatgcctgtaatcccagcactttgggaggccaagatgggtggattacctcaggtcaggagtttgagaccagcctgaccaacatggtgaaaccccatctctactaaatatacaaaattagctaggtgtggtggcacatgcctgtaatcccagctacttgggaggctgagtcaggagaatcgcttgaacccgggaggcggaagttgcagtgggccaagatccagcctggcttacaagagcagaactccatctcaaaaaataaaaaataaaaaaatatatggccgggcacggcggctcatgcctgtaatcccagcactttaggaggccgaggtgagcaaacaacctgaggtcaggagttcaagaccagcctggctaacagcctggtctactaaaaacacaaaaattagccgggcatggtggtgggcacctataatctcagctactccagaggctgaggcaggagaatcgcttgaacctgggaggtggagtttgcagtgagccaagatcacaccactgcactccagcctgggggacagagtgagactccatctcaaaataaataaataaaatagataaaattaatgttaataatatattttatttaattcaatatatcctcagtgttggctgggcatggtggctcacacctgtaatcccagcactttgggaggccaaggcgggaggatcacaaggtcaggagatcaagaccatcctggccatggtgaaaccccatctctactaaaaatacaaaaattagctggtggcacgtgcctgtaatcccagctactcgggaggctgaggcaggagactcacttgaaccagggagtcagaggttgcagtgagctgagatcccaccactgcactctagcctggcgacagagcaagattctgtctcaaaaaaaaaaaaaaaatcctaaatgttatcatttcaacttgtaatcaatataacaaaatatcagtgagatatcttactcttttttgtatgaagtcttcaagatccaatgtgtattttacacttacagcacatctcaatccaaatagccacatttcttttcttttcttttttttttttttgagacagggtctcactctgttgtccatgccggagtagagtggtgagactgaggctcactgcagcctcaatctcccaggcttaagtgatcctcccatctctgtctcctgggtaactgggactacaggcacatgtcaccgcacctggctaatattttttatttttagtagagatgagattttgccatgttgcccaggctggtcttgaactcctgggctcaagccatctgcccacctctacctcccaaagtgttgggattacagtcatgagccactgcatccggcccagctagccacattttaagtactcagtagtcacatgtggctagcggctactgcattgaacagtacagttttaaatgtcagctgtcatcattattttggtttttgtttttttttttgagatggagnctngctctgtcacccacgctgncntgcangggcgcagtctcggcccactgcaacctctgcctccagggttcaagcagtgctcctgcctcaacctcccgagtagctgggattactggcgcgcgccactacccctggctagtttttgcatttctatggtagacggcgcattaccatgttggcgatgcaggccttccgctgccctgcccacgctatccgccccccgtcggcctctttaactggttgggatcaccggtgtggtgcctgtttcccccgcctgtgtgggtggattttgacgttccgccggcgcccggcgccctctctttcgttgtcccccgcggagttccctactgcgtgtttcttctggtcgttgtcggatgggtgggggtgaccgggagatgcgtttgtctgttccgcggcggagctgtgccttcgcttcctcccccttgtgctcgaggtattaaaccttgttatttgtgtatcctttgtgtccctttttatttctttgtgcgcctcctttcctcgtcgggcgcgcccgccataggcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctagtaagttcatcactgagattatgccactgcactccagccttgggcgacacagcaagacttcatctcaaaaaaaaaaaagaagatttgagctagaattccagttttcctcagttcccatttggggatcctgggagagtctctcagcctcagttttctcatctgtgagatggggatattgagaattcttctccatatggcatgcctgcctggaagggcttataaacaaagaattgtgtctgggcatggtggttcatgcctataatcccaatacttagggaagccgaggtgggcagatcacttgaggtcaggagttcgagaccagcctggccatcatggtgaaaccccgtccctactaaaaacacaaaaattaactgggtgtggtggcgtgcacctgtaattccagctacttgggaggctgaggcaggtagaatcacttgaactcaggagacagaggttgcagtaagctgagactgggccactgcactccagcctgggcaacagagtgagactcccatctcaaaaaaaaaaaaaaaaaaaaaaagttaaagaaaacaaagaattataaggtcaaaaaggatctcaagagattctccaaccttttctcaggtgaagggggctggatttccaccttcatcctcctctctatcacctaaggaccccatatgttgaccgggtgtccacctggaagtcatcctctgttcctccccgtcctcgctttccacacccagttctgcctgtccatctgcaaagtgtagcccaattcccacccccaccccctcattttcacctctgcaattatatctctaggtgcagccacgcactaccctctcttgcctgggattactgcatgaacctccaaactggacctctattgtcaattttctacccagaagccaataagccaatgttatctttttaaaaaaatttttttgagatggagtcttgctgtatcacccaggctggaatgcaatggcgcaatcttgactcactgcaaccatcgcctcccaggttcaagccattctcctgcttcagcctcccaagtagctgggactacaggcacgctatcacgcccggctaatttttcttatttttagtagagacagggttttgccatgttgcccaggctggttctgaactcctaaccttgggtgatccacccccctcggcctcccaaagtgctgggattacaggcgtgagccacggcaccagcctaatgttattttattttattttatttatttatttatttcgagacggagtctcactctgtcgtccaggctggagtgcagtggtatgatctcggctcactgcaacctccgcctcccaggttcaagtgattctcctgcctcagcctactgggtagctgtgattacagtcacacgacacaacacctggataattttttgtatttttagtagagacagtgtctcaccatgttggccagtctggtcttgaactcctgacctctggagatccgcccccctcggcctcccaaagtgctgggattacaggcgtgagtacccggcaatgttatggtttttttgttttttttttttagtatttattgatcattcttgggtgtttcccagagagggggaagtggcagggtcataggataatagtggagagaaggtcagcagataaacacgtgaacaaaggtctctggttttcctaggcagaggtccctgcggccttcggccttcagcagtgtttgtgtccctgggtacttgagattagggagtggtgatgactcttaaggagcatgctgccttcaagcatctgtttaacaaagcacatcttgcaccgcccttaatgcatttaaccctgagttgacacagcacatgtttcagagagtacggggttgggggtaaggttatagattaacagcatcccaaggcagaagaatttttcttagtacagaacaaaatggtgtctcctatgtctacttctttctacacagacacagtaacaatctgatctctctttcttttccccacatttcccccttttcttttcgacaaaaccgccatcgtcatcatggccctttctcgatggtcgctgtctcttcggagctgttgggtacacttcccaggcggggcggcctggcagaggcgctcctcacctcccagaaggggtggtggctgggcagaggcgcccctcacatcccagacgatgggcagccgggcagaggcaccctccacctccctgatggggcagccgggcagaaacgccccccacctcccagacggggtgtccgggcagaggcgccccccacctcccagatgaagggcggccaggcagaggtgctccccacctcccagacgggggagccgggcagagacgcccctcacctcccagacggggtggctgggcagaggcgcccacttcacagacggggcggccgggtagaggcactcctcccagatggggtggcggccgggcagaggtgcccctcacatcccagacagggtggcggccaggcagaggcgctcctcacctcccagacggggtggtggccgggcagaagcgctcctcacctcccagacggggtggcggcagggcagaggcgctcctcgcctcccagacagggtggcagccgggcagaggggctcctcgcttcccagacggggcggccaggcagaggtgctcctcgcttcccagacggggcggccaggcagaggctgtaatcttagcactttgggaggccaaggcaggcggctggaaggtggaggttgcagcgagccgagatcacgccactgcattccagcctgggcaacactgagcactgagtgaccgagactccgtctgcaatcccagtaccccaggaggccgaggcgggcagaccactcgaggtcaggagccagagaccagcccagtcaacagggcgaaaccgtgtctcctccaaatatacaaaaaccagtcaggcgtggcggcgcgtgcccgcaatcccaggcactcggcaggccaaggcaggagaaccaggggagcccggggcagggaggctgcagcgagccgagaccacggcagtacagtccagccttggcaacagaaggagaccgaagaaagaaagagggagcgggtgagggggagggggagggggatgggggagggggagggagctgttatgttttttttttaaaaatcaactttattgggctaagtgcagtggctcatgcctgtaatcctagcactttgggatcttgacatagctgatctcagatcttggcatagctgttcacgtgccacctctgtgggtcctgaacattttatctaaagtctccccgtaccccaccaaatcagactccttaccctggtatttgttgaggttcaccttctgccattatattctgcgtttatttgtgtacttgtttattatttgtctctgcctcccccattaaaatgtcagggctatgagaacagggactatgtctgtcttgtttgctgcttgttcaccagcatctggaatggtaggtttgagtaactatttttgaacgaatgaaagactggcaacatggagatgccaggagatgagtgagctgggctgcataattagttgtagcatcaggatgaaaaccccaatctcctggcccccagcccaaacctctctcctccttctcaggccattcacagatcttcccaggactgacacacaagacagtacaggggtcttaactgcagtggtttttttttttttttttttttttttttgagacggactctcctctgtcgcccaggctagagtgcagtagcgcgatctcagctcactgcaagctccacccctcgagttcacaccattctcctgtctcagcctcccgagtagctgggactacaggcgcccaccaccattcccggctaattttttttttgtatttttagtagagacggggtttcaccgtgttagccaggatggtctcaatcttctgacctcgtgatctgcccgtctcagcctcccaaagtgctgggattacaggcatgagccaccatgcccggcccgtttttttgtttgtttgtttgttttccccaagatggagtcttgctctgttgcccagagctggagtgcaatggcacaatctcggctcactgcaacctccgcctcctaggttcaagcaattctcctgcctcagcatcccgagtagctgggattacaggcgtgagccaccacacccgggtaatttttgtatttttagtagagatggggtttcaccaagttggccaggctggtatcgaactcctgacctcgtgatccacctgcctcggactcccaaaatgttgagattacaggcgtgagccaccatgcccagccgcagtgctgtttttaagagcaagagactggaaacaactcaaatgtccatcaatagggggctgtttaattaaatcacatacagttctacaacggaaaattatgtagccacagaaaagatcaaatgtactgaaacgaaacagcttccaagatctgaaaacataacactgaacgatgtaggtaacgtgtgtatcatttgtgggaaaaagtgggatacaatatgattataagatacttatacaggccggcgcggtggctcacgtctgtaatcccagcactttgggaggccaaggcaggcggatcacaaggtcagcaggtcgagaccagcctggccaatttggtgaaaccccatctctactaaaaatacaaaaattagccaggcgtggtggcttacgcctgtaatcccagctactcgggaggctgaggcaggagaatcacttgaacccggagggggaggttgtgttgagcagagattgagccattgcactctagcctgggcaacaagagtgaaactccgtctcaaaaaaaaaaaaaaaaggtacttatacaaggctgggtgcagtggctcacgcctgtaatcccaacactttgggaggtcagggaaggtggactgcttgagcccaggagttccagaccaacctgggcaacatggtgaaaccccatctctaaaaaaatacgaaaaaagttagtcgggcatggtggtgggcgcctgtagtcccagctgctcaggagactgaggtaggaggatcacttgagcccaggaggtgaagaatgcagtgtgccactatactccagactggaggacagagtgaggctgtgtctaaaaaaaaaaaaaaaaaaaaaagataaaaaagatacttatacaaattaaattgaaacaactctggaagaatgcacactaccaatgttaactggctagggttggggctggaggaatggggtggctgggaatcaagagtagaaaggagatttcactaagtactcttttgcatagtttgaatttttttttttaggggcggagtcttgctctatttccaggctgcagtccaatggcacgatctcggctcactacaacctccgcctgctgggttcaagcgattctcctgcctcagcctcctgagtagctgggattacagatgcatgccaccgtgcccagctaattttttgtatctttagtagagatggggtctcaccatgttggccaggctggtcttgaactcctgacctcgtgtaatctgcctgccttggccacccaaagtgctgggattacaggtgtgagccattgagctcggcccacatatgtaacttaatctattgctaaaacaaattaatattttacaaaaataggccaggcacagtggctcacacctgtaatcccagcattttgggaggccgaggcgggcggatcacgaggtcaagagttctagaccagcctggccaacatggtgaaaccccgtctctactaagaatacaaaaattagccaggcatggtggtatgcctgtaatcccagctactggggaggctgaggcaggagaatcacttgaacccaggagtgggaggttgcagtgagctgagatcgcaccattgcagtccagcctgggtgacaagagggagactctgtctcaaaaaataaaaataaaataaataaataatttttaaaaagtacatttaaaaaaatgtcactactggacgggtgtggtggctagtgcctataatctcagcacttagggaagccaggcgggaggatcacttgagttcaggaataatgaactacttgcagtcgaactcaagtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctgtgtttgaggacgtgtttgacagatttgatgatcttgattgcaccctgaagtataaaaaacttaggctactcgagaaagatttcatgctaaatcaggtagtaaagctctagtaatatgatcctaaggttttgtcttcatgaaactgcatgaccttaaggcatcggtttcagctaacctgcccaaggccacacaggctgtaagggaacaagatgtgagcccagccttctcacactagagtccctgtttgttctcctacccggacttttttgttgctgttgttgttttgagaccagagtctcgctgtgtcgcccaggctggagtgcagtggcatgatctcagttcactgcaaactccacctcctaggttcaagagattctcttgcttcagcctcccatgtagctgggactacaggcttgcgccacgacgccgaataatttttgtatttttagtggagacggcgtttcaccatgttggccaggctggtctcgaactcctgacctcaagtgacccacctgtctccgcctcccaaagtgctgggattacaggcgtgagccacagtgccggccttttttttgttttgttttgagatgggagttcaactcttgttgcccagattggagtgcaatggtgcaatctcagctcactgcaacctctgcctcctgggttcaagcgattctcctgcctcagcctcccaagtagctgggattacaggcatgtaccaccatgcccggctcattttgtatttttagtagagatggggtttcactatgttggtcaggctggtctcgaactcctgaactcaggtgatccactcacctcggactcccaaagtgctaggattacaggcatgagccactacatgcagcccccaggagctcttgatctgaggcataaagatgcttagagggtttccaaatatattttatggtcacctattctcccaacaatgtgtgctatactgtgtgtttacacataggtgtgtctttagaggaaagggttcaaagctttcattagattctttttttttctaataaagaaaaaagctttgttgcccaggctggtctcaaactctcaagctcaagcaatctgtccgcctcggcctctcaaagtgttgggattacagccatgagccaccacgctggtcctcattacattctcaaaggggcctattgaaaaaaaaaaaaaaaaaaaaaaaaaaaggccgggcacagtggctcacgcctgtaatcccagcactttgggaggccgaggaaggcggatcacaaggtcaggagatggagaccatcctggccaatatggtgaaaccctgtctctaccaaagtacaaaaaaaaaaattagccaggcatggtggtgcgtgcctgtaatcccagctattcaggaggctgaggcaggggaatcgcttgaacccgggaggcggagattgcagtgagctgagatcgcgccactgcactcctccagcctggcaacagagcaagattccgtttcaaaaaaaaaaaaaaaaaagtttactgtcattttatgttatatactttttttttaaagttttatttttaaagctgcttttagacaagtcgaaggaagaaagaaggggataaggaggaaagaattttgtagacaaaatttaacagaggtcaatttttttttttttttttttgtctcccaggctggagtgcagtggcatgatctcagctcactgcaacttgccctcccaggttcaagcgattcctgtgcctcagccacccgggtagctgggattacaggngngcnccaccatgcccaggtaatttttgtatttttagtagagttggggtttcaccatgttggccaggcgggtctcgaacttctgacgtcaagtgatcagccagtctcggcatcccaaagtgctgggattacaggcgtgaaccaccactcccggccagatgtcaatttttgtttccacaatttcaaggaagagaaagccagtgtgaccagaggtcaaaagatgagaatgttggccgggtacggtggctcatgcctgtcatcccactattttgggaggccgaggcagacagatcacctgaggtcaagagtttgagaccagcctggctaacatggtgaaacaccgtctctactaaaaatacaaaagaatttgctgggcgtggtggtgcgtgcctgtaatcccagctactcaggaggctgaggcagtagaactgcttgaacctgggatgcagaggttgcagtgagccaagattgcaccgctgcactccagcctaagcaacaagagtcaaactccgtctcaaaaaaaaaaaaaaaaaaaaaaaaaaaaaagatgagactgttgagtcaggattaggatccaggtctgctggcaccaatttcagtgctctttatactttctgttgctattcattcattcatccattcattcagcaaatttatatcaagtatctggtatgtgccaggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttaacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggagggtgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaagattggtccttgacgggcctgagatatcaaagacattgaatggctagcagaatgcctgcaatttacacctgaaagaggtatctgtatttctcaagaggaagtgcttgatctgggtctcatctttttcctgtcccattccactagcatttactgcagaatcttccctgtagtcataattttcttgaacatgtcaagttcttttttttttttttttttgagacggagtctctctctgttgcccaggctagagtgcagtggcacgatctccactcactgcaagctctgcctcccaggttcaagccattctcctgcctcagcctcccgagtagctgggactataggcacccgccaccacacccagctaattttttgtattttcagtagacacagggtttcaccatgttagccaggatggtctcgatctcctgacctcgtgatccacccgcctcagcctcccaaagtgctgggattacaggcgtgagccaccgtgcctggcctcgaatgtgtcaagttcttactttgaggtaatctccttcagggctggtagggtcagaaatcttaagagaaacaaagggagcgtgacacatttctgcttattggcttttctgtggaattaaaactatcctgctttaatggatagtaaatggtagtagtagtagttacaaaaccactctgagagggcaattattattattattattatttttttttttttttgagacggagtctcgctctgtcgcccaggctggagtgcagtggcgggacctcggctcactgcaagctccgcctcccgggttcacgccattctcctgcctcagcctcccaagtagctgggactacaggcgcccgccactacgcccggctacttttttgtatttttagtagagacggggtttcaccgttttagccgggatggtctcgatctcctgacctcgtgatccgcccgcctcggcctcccaaagtgctgggattacaggcgtgagccaccgcgcccggccgagagggcaattatttgcaatcaaaatttaaaacctttattttggccgggtgtggtgactcacacctgtgattccagcacctttgggaggccaagggggcagatgagaactacggcatcgaaccgaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtagaatagttcatcatttagtattttttagtagagatggggtttgcatattgggcaggctggtctcaatctcctgacctcaggtgattcacctgcctcggcctcccagagtactgggattacaggtgtgagccaccgtgcccggccaatcctgacttttaaaaaggtaaaataaaataggccaggtgtggtggctcacgtctgtaatcccagcactttggaagccgaggtgggaggagctcttgatctcaggagttcaagaccagcctgggcaacatggcaagatcctatctctaccaaaaaaaaaaaaaaaattaactgggcacagtggcacatgcctgtagtccttgctagtggggaggctgagatgggaggattgcttgaggctagggaattgaggctgcagtgagttatatttccaccactgcactccagcctggacaacggagtgagaccatgtctcaaaatttacaaaataataataataaaataaaatacatacaaaaaaacagaggccaatgggcagtgattggtgaggtatcctggatacttgaggcctctctataccattccctctagcaggcctgttaaccttattcacctctgtatccccaggctcagggctcaataatggggaatgtagatattagggaaatgtttgctcaattgattgaatacatgggctaagtcattctctctggactcattttgccatctataaaatgagaaaatgatgaaacactatggcaaacacctcctaatcagcctcagaggtcaccacctgcaggaagtcttcatggattcccttccacccgcagattgatcaagggcctcttctggcctcttacagagccaggttgtgttcccatccctgcactgactatagtgtacaatatttgtctggttctgctctgtggaggcacctgtgcctctgccttggcccgggttcagcaaaaatcaaggctaggcctagaaagtgatgggaaatactccacgtgaatattcaggttctttgcagtagggccaatgtccattttgctcctctctgtaccccaagtacctatcccatagcatgtagaatgtttgagaaattaatgaattaatgcatttatgagctctggtctcaggttcaaatgtgaatcatggctgggcgcggtggctcacacctgtaatcccagcactttgggagaccgaggagggtgcatcacctgaggtcaggagttggagaccagcctggacaacatggcgaaaccctgtctctactaaaagtaccaaaattagccaggtgtggtggtgcactcctgtagtcccagctatttgggaggctgaggtaggagaattgcttgaatctgggaggcagaggttgcagtgagccgagattacgtcactgcactccagcctgggcaacgagagggaaactccatctcaaaaaaacagaaagtgaatcatgctggtgttggctggggctgggcaagggtctcaggcagcagaaaccggccaatggagaaatccctgtgcagtaaagatgagctgaaaggcctgacttctagagccccaagaaaacaatcagaggggcagatggtttggggaaggggggaggctctggtgagtgggcaatctgcctgcatctgtttgaggctgagagtgaggtggggcacatggatatggttaggtcccagctctgctacttcttagctatcattcagccccaccaaccctcagtctccatatctgtgaaatgggcagggaatataatgatacctgcttctactttaacatgtttattcggagggtgaaggtacataataaggtcaaagtgcctagtcagaaatagtttgtaatttatttatttagagactgagtctcattctgttgcccaggctggagtgcagtggtgcgatctctgctcactgcagactccacctcctgggttcaagtgattctcctgtctcagcctcccgagtagctgggattacaggtgcccaccaccacacccgggtaatttttatatttttagtagagacggggtttcacaatgttggccaggctggacctgaactcctgacctcaagtgattcgcccacctcagcctcccaaagtactgggattataggtacttatttatttttatagagatggggtcctactatgttgcccaggctggtcttgaactcctggactcaagcaatcctcctgcctcaggcctcccagagtgctgtgattacaggcatgagccactgttccccaccagaaatattttaaactccataacatcttttcctcttttctcccaaatgtttttctttcttccttttttttttcctttgagacaaagtctcactcagttgcccaagctggagtacagtggcacaatcacggctcactacggcttcaatctcctgagctcaagccatcctcccagctcagcctcctgagtagctggaactacaggcacatactaccacatgcagctaatttaaaattttttgtggagacaggagtttcactatattccccagactggtctccaactcctggactcaagtgatgctcccacctcagtctcccaaagtgctgggattacaggtgtgagctaccacaccctactcccatgtttttcaccctaattagagctgccactcatgaattcctaagaataatattagctttcctaacatttagtgagtgtcttctgtgtgtcaggcactgtgcctacacatattatttaatttaaccttcagaatcattctgtaaggtaggtctgctattattcttatcagagaagaaataggttcagagaggtgcagtgacttgtctgagatcacacagcctctgagtggtaaacctgtgaggtgagccatctgttaatttgagggaacaccagaatcctttggagggcttgttcaaacacagatttctgaaccccatcccaaagtatctgatgcagcagttctggggcggctcccaagaatttacatttctagcaagttcccaggcgatgttgctgctgccagtcctggggcacactttgagaaacacggcctaataccaagatttttccactgtcattatcccaattaggcatgttatgtcaagtccagccttttacaatatgctcgattcaaggaatttgaagtctagtatagttcattcagccctaggcatatatgaccctatagtcttaattaagtcttcaaaacacacacacacacacacacatcccaactttcatccacattaaaggtacaaaaagctggaaaatataaatgagtaaaaaggacagaatcaaccctggtcacttcaattactccagtgagatcactttttgttatactttttgtttatggttgtatagggaaagctttctggataaaccaactcactggattaaaaattcatgggaggccagacgtggtggctcattcctgtaatcccagcgacttgagaggccaaggtaggaggattgcttgaggccaagagttcagaagcagcctgggcaacttggcaagaccccgtctctaccaaaaaaaaaaaaaaaaaaatccctggaattggctcactagcttaacaaatgctcgctttgcctgctataaaatctagaacaatgtgaggcccacagcagctggtgggttcatttctagtgtgacaagccactaactcctgttgagtgaagatgtgaccatgtggttatcaagagtcaggggggttggttctcccatcagttactcctttttttgagacggagtctcactccgttgcccagggtggagtacagtggcataatctcggctcactgcaaccttcacctcccagcttcaagcgattcttgtgcctcagcctccggagtagctgggattacgggcacataccaccatgcctggctaatttttgtatttttagtagagacaatgtttcaccatgttggccaggctggtctcgaactcctgacttcaagtaatctgcctgcctcggcctcccaaagcgctgggattacaggcatgagccgctgcgcccggccatcagttactcttgtaattaaatcttataattatataggacaaactgataaaatatgagtcggaaaagaagacggatgtttctatgaatgcagttgaatgctttggaaagactccaaaaagttagttggtacatatcattatacatctgtccaaacccacagaatgtgcagcatcaagagtgagccatagctgggcgcggtggctcacgcctgtaatcccaacattttgagaggccgaggcgggcgcatcatgacatcagaagatagagaccatcctggccaaaatggtgaaactctgtctctactaaaaatacaggctgggcgcggtggctcatgcgtataatcccagcactttaggaggtcgaggcaggtggatcacctgaggtcagaagttcaagtgcctgtaatcccagctactcgggaggctgaggcaggagaattgcttgaacctgggaggcagaggtttcagggagctgagatcgcaccgttgcactctagcctgggagacaagagcgaaactctgtctcaaaaaacaaaaaaagaaaaaatataaaaattagctgagtgtggtggcacgtgcctgtagtcccagctacttgtgaggctgaggcaggagaagcgcttaaacccgggagtcggaggttgcggtgagccgagatcacgccactgcactccagcctgggcaacaggagcagaactctgcctcaaaaacaaacaaacaaacaaaacaccactcatgtagggtacgttgataatgggggaagctgtgcctgtgtctggagaggagagagatatataggaaatctctgtaccttctgcttaatattgctgtgaacctaaaactgctccaaaaaataaagtttttgtttgcttgtttgtttattaagacagggtctcggctgggcatggtggctcacgcctgtaatcccagtactttgggagactgaggtgggcggatcccaaggtcaggagatggagaccatcctggctaacacggtgaaaccccatctctactaaaaatacaaaaacaaaattagtcaggcgtggtggcgggcgcctgtagtcccagctactcgggaggctgaggcaggagaatggtgtgaacccggaaggcggagcttgcagtgagccgagatcgcgccactgcactcaagcctcggcaacagagcgagactccgtctcaaaaaaaaaaaaaaaaaaaaaaaaagacagggtctcactctgttgtccaggctggagtgcagtgacgcaatcatggcttattcagcattgacctcctgagctcctgtgatcctcctgcctccaccttccgagtagctgagactacaggtgtgcaccaccatgcctggctaacttttgtattttttgtagagacgtgggtctcactatgttgcccaggctgatcttgacctaccgggctcaagcaatcctcctgcctggctncccaaagttgataaactactgcatcgaaccgatccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctgagcataggaacatactcatcattattattattcctattattttgagacggagtcctactctgtcaccaggctggagtgcagcggcgcgatctcagctcactgcaacctctgcctcccgggttcaaatgattctcctgcctcagcctcccgagtagctgggactacaggtgcacaccactgcgtccagctaatttttgtatttttagtagagacggggtttcaccatgttggccaggatggtcttgatttcttgacctcatgatctgcccgcctcagcctcccaaagtgctgggattacaggcgtgaaccactgcacctggctctctattggaattgtcctgtgtttttctcataattagattacagttatgggtttgggggaggaagaccacagaggcaaagtgccatttcatcacatggctgctttatgtttaatcatctcttttctgggccgggcgtggtggctcatgcctgcagtcccagcacttcgggaggccgaagcgggtggatcacctgaggtcaggagatcgagaccatggtgaaaccccatctctactaaaaatacaaaaaattagccgggcgtggtggcgggtgcctgttgtcccaggtactcccgaggctgaggcaggagaatggcgtgaacccgggaggcggagcttgcagtgagccgagtgccactgcactccagcccgggtgacagagtgagactctgcctcaaaataaataaaataaaaataaaaataaaaatgaaataccattaaaagttcagtttctcagtcacaatggccacatttcaaggctcatagacacatgtggcgagtggctgccagattggcagccacagaatgtttccatgatcacagaaggttctgttggacagggctgctgtggattgtcacagagcctgtctcagggctgccccatgggaggtgggggctatgaggactaatggagggggacttggttaggtcagaatcccacatcagcttgactgaatggtcctgcctctgcagccccagaatgagtggagtctgcccaagcaaagggaagccttgcccagcaaaatgttcagtccctcttatgtgggttccttggggtcataacaagacagaggaccaggcactgctcctagatttaggcctgaaggatgctaagtgggtgattgggggtggctcaaagaaggagaagcagctatggttgcaagtaaagttattaattaccctttttttccaggctggagtgcagtggtgcaatcttggctcactgcaacctccacctcccaggttcaagtgattcttctgccccagcctcctgtgtagctgggactataggcaagtgccaccacacctggctaatttttgtatttttattagagatagtgttttgccatgttggccaggctggtctcaaactcctgctctcaagtgatccacccaactcggtctcccaaagtgctgggaatacagacatgagccaccgcacctggctaatgagttactattaactgagcgctaactccatcccaggtcccatatgctaagaacctggcacaaaggtcgaggtaggtccagtacaaacttcattttacagagaagacagctgaggctgagagaggttaagtgactgccccagagtcacacatcaggaccaagatatgagttcgatctggttctcatgctaccatctcaggctagggagtactgaaagtcccttgaggaaggaagagattcagtccaacctacgacttccctccttccccagcccatgaaagccttcctaagaacaatctggacaaactccacgtgctggagtttaggcaaagcacctggtggggagggggtccggccgctgccacaaccctctccccctggaaagagacatgctcactgtgacagcccagacctctgtggctcctgccacaaaggtgacagtataagggacctggaagggcactaggtagctccccaagcccctacactctttgtaccttgaccttccaccaccccagatccctgcacaggtgtgcgaagcacagcctctcccagcctgggaaaaacacactcttcagtggaaagaacagctaagcatagctgcttggccccttcaggtgagggcgtacccacgcttcagcaaggccacatctacttggcttctttttttttttttttttttttttgagatggagtttcgctcttgttgcccaggctggagtacaatggcgtgatctcagctcaccgcaacctccgcctcccaggttcaagcaattctcctgcctcagcctcctgagtagctgggattacaggaaggcaccaccacacccagcaaattttgtatttttagtagagatggggtttctccatgttgaggctggtctcgaactcctgacctcaggtgatccgcccgcctcggcctcccaaagtgctgggattacaggcgtgagccaccgcacccggccaggtctatttggcttctaaaggatagggctcctgtttctaggaagtgcttaacagcagctaccagctaccatctgctgagtgtttctatacgcttggcactgtgctagcactgtgctttacatatgttgtctttcagcctaacaacactcttctgatatagttattattactgtgatggttgtcatcatcttccccatcttatagatagatgatgaagcagtttcagagagtgtaagtaacttgctcaaagtcacatggctagaaagtggagaaaaaatttgaacctgtgtctacctgcctctgattcctgctctctccaatgataacaacagcagcaattaacatgctgtgaggctgtgctaggaaggatactaagagccttgtataggctagcccaccatcaggtgccaatgagcaaaatgaggcagtataccggtgtaactaaaccttttccactcccaaagccaccatcttcagtgtcaggatcttcctgacagcctcctaactgctataatggcactgtctacctccatctctccggagaagggatagtgtagccagtggctcccaaacttgactgatccctggactcccctggaaaacttaaagagtgatatagtccaggcatgatggctcaagcttataatcccagctattctggaagctgaggcaggaggattgcttgagtcaggaattcaaggccacattgtgctatgattgtatcactctactccagcctgggcaacagagggagaccctgtttcaaaaaaaaaaaaaaaaaaaaaaaaaaggtaatacagattattggaatgtaagatgtgcaggttgggtataaggatctgaaatctgtggtctctctctcttttttttttttgagacgatgtctggttctgcacccagcttggaagggannggncnnnnnnnggnnnntgggacngttgggtccaatgtnaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagtgctgggattaccggaatgagccactacgcctggcctattttgggggttttaacctaaaaatcatttcctcagaaaactgttccctgacctgctgaactatgtcagccctgttattaaaatctttttttgggacaggcgtggtggctcacacctgcaatcagcactttgggaggccaaggcagatgaatcacctgaggtcaggagatcaagaccagcctggccaatatggtgaaactcccccgtctctactaaaaatacaaaaattagccaggtgtggtggcacacacctgtaatcccagctactcgggaggctgagggaggagaatcactcaaacccaggaggtggaggttgcagtgagctgagatcgcaccattgcactccagcctgggcaacagaacaagactccgtctcaaaaaataaaaataaaaataaataaaatcttttttttagcattctagaagcactcatcatgattataattaaataatttctggccgggcacggtggctcatgcctgtaatcccagcactttgggaggctgaggcgggtggatcacgaggtcaggagatcgagaccatcctggctaacatggtgaaaccccatctctactaaaaatatataaaaaaaaaaaattagccaggtgtggtggcgggcgtctgtagtcccagctactcaggaggctgaggcaggagaatggcatgaacccaggaggcagagcttgcagtgagccgagatcatgccactgcactccagcctgggtgacagagtgagactcctctcaaaaaaataaaaaataaaataataataataataataataattccggccaggcacagtggctcatgcctgtaatcccagcattttgggaggctgaggtgggcagatcacgaggtcaagagttagagaccatcctggacaacatggtgaaaccccgtttctactaaaaatacaaaaattagctgggcgtggtggcgcatgcctgcagtcccagctactcgggaggctgaggcaggagaatggcgtgaacccgggaagtggagcttgcagtgagccgagattgcgccactgcactccagcctggtgacagagcgagactctgtctcaaaaatagtaataataatcattcctattaacttgttatttgtgtttgtctcctactagactgtaggcttcagaaaggtggagaccatttgctcattgttctatcccagtgctggcatacaacaggtgctcaataaagatgtgttgggtgaataacatttattaagcacacacttaatgaattagccttagcactgcattaactaaagttgggaagaaagaggttaagagaaaaaaagcagccgggcatggtggctcacacatgtaattccagcactttgggaggccaaggtgggtggatcacctgaggtcaggagttcaacaccagcctggccaacatggcgaaaccccgtctctactaaaaatacaaaaattaccggccaggcgcggtggctcacgcggctcctagcactttgggaggctgaggcaggtggatcacctgaggtccgcagttcgagaccagcctgaccaacatggagaaaccccatctctactaaaaatacaaaattagccgggcgtggtggcgcatgcctgtaatcccagctactcgggaggctgaggcaggagaatggcttgaacccgggaggcggaggttgctatgagccgagattgcgccattgcactccagcctgggcaaaaagagcgaaactctgtctcaaaaaaaaagaaaaaaaaaattacctgggcatggtggcacatgcctgtcatcccagctactaggggagctgaggcaggaggatcgtttgaacctgggaggcttgcagtgagccaagatcgtgccactgcactccagcctgggcaacagagtgagactctgtctcaaaaaaaaaaaaaaaaagagagagagagagagaataaaagcagatctagaagagtcagttccagagcttataatatacgtgtggacattttctttacaaaaccaatagttggtcattgtgggaaaacgtctcaaaaactcgaataaatggacaagcacagtggctcacacctgtaatcctagcacttgggaggctgaggcaggaggatcacttgagctcaggagttccagaccagcctgggcaacatagtaagacctcttctttatttttattttattttttattggatttcctttcagattcagacctacagatatcttttaaaataaaaaacttattttaaaatgaataaactaagatgaaaattaaaattatccataatccaaaactaaaagaatgaccagttgtagattttccagagcgttcttttacacacaaaaaacatacacatatatgtttttagatataaaacattaaatatatatttgaatatttttgcacactgttttgaaacttggttttctcatttacccatttatcactactttgttttttgtttggggttttttttttttttttttgggatagggtctccctctgtcacccagagctggagtacagtggtgcaaacacggcttactgcagcctcgacctcccaggctcaagtgaccctcccacctcagcctcctgagtagctgggactacaggtgtgcaccaccacatctagttattttttttaattttttgtagagctgggggcctccctatgttgtccagcctgttcttgaactcctaggctcaatcagtcctccagtcttggcctcccaaagaggtagaattacaagcatgagccactgtggccagtccagtgtgatcatcttttcatggcatttaacattcttctgaaacatcaattccttgggtaaaacagcattgcatcatataattgtaccaggatttacttagccaatctcctgataaaatttagttagatacaaattttcactataatcagcaatgctaggacaacatccttatagttaaatctcggaacacttccttaatgatttcctgcagatcagttcttaaggagtggaagtgtgaggttaagtgtcgcgttagtccgtttactatgtgttgacaaagtgtggtctataactgctgtatctagataaatatatcatgtatatttcatgagtactgagttgacatgcaacactgtagggtggtcccaggcataattctcccaaatgtagtgtgactaactgccactggtggaatgagaggttgtagctagtacaaagatttattattttatttgtattttttgcagacacagagaggtctcactttgttgcccaactggtctcaaactcctgggctcaaggaatcctcccacctcgacctcccaaagtgctgggattacacacatgagccaccatgcccagctcagttttttttttttcttcttttcaagacagagtctcgctctgtcgcccaggctagagtgcagtggcgcgatctcggctcaccgcaagctccaccccccgggttcacgccattctcctgtctcagcctcccgagtagctgggactacaggcgcctgccaccacgcctggctaattttttgtattttcagtagagacggggtttcaccgtgttagccagtatggtctcgatctcctgacctcgtgatctgcccacctcggcctcccaaagtgctaggattacaggcgtgagccaccgcgcccggccagattccttattttaatagttacatatttatgtgttagaaaattatctaattagcacataaaacctgtgatggctccaatattatttatttatttattttatttattttaatttttgagacggaatctcgctttgtcaccaggctggagtgcggtggcacaatcttggcttactgcaacctccgcctcccgggttcaagtgattctcctgcctcagcctcccgagtagctgcgactacaggcacccaccaccatgcctggctagcttttgtatttttagtagagatggggtttcaccatgttggccaggatggtctcgatctcttgacttcataatccacctccctcggcttcccaatgtgctgggattacaggcatgagccaccgcgcctggcccagctccaatattattgtttaggataaagataaggtttttttgtttgtttgtttgttttaaagtgggtccacttaaagaaaactatgtagggacgggcacagtggctcacgcccataatcccagcattgtgagagtctgagggctgaggagggtggatcacctgcggtcaggagttcaagaccagcctagccaacatggcaaaacgccatctctattaaaaatacaaaaattacccagtgtggtggtgcaggcncccgtagtcaaagctacttaggaggctgacgggggggtttcactgagtgatncacgacggttttattgtcacgaggccg

SEQ ID NO: 715 - DNA, 186449 bp, Homo sapiens
  misc_feature (1)...(186449): n = A,T,C or G
gcgcgacaattcaccaccgtcgtcaaagcttgaacacctggagtaaactcaccaggagctcggagacttagatgaggaaattcaaacctttcaccagatgacgaaagaggaaccggaatcagccttgagagctgtgtggtgtttcagatccacatcgattctcccccaaaattcacttataaatccagtgctatcccaacataaaggtcacagctaaaaaatttaacacaatttgacaagctaattgtcgagttcatggggtgagaaatcaggaactttatgctgcatgttttcttccccgatgcctcttcccttagcatgaggttcctgtgtctcgtgaggacagatatggttgcccaggctggagtgcagtggtgcaatcccggctcgctgcagcctccgcttcctgggctcaaggggtcctcccgcctcagcctctcaagtagttgggaccacaggcacgtatctccatgcccagctaatttatttatttgtagagatggggtcttgctatgttgcccagactggtctcaaactcctggcctcaaacgaacctcccatcctggcctcccaaagggattacaggcgtaagccgctgcagccagcccagactccacctctaactgctgcgaggcggtcatctggagcttctctttgctgtccttccagttgggttctttttgttggtgtgcactcttattttacttaaatgtttcctctggtagcttccaaagaaaatatgcagggaataaatgtgtgcctgaacccttgcctgcctgagactgcctgagagcatcttcatccttgatagctctttgcctgggaattcttttttttttttttttttttgagatggagtctcactctgtcgcccaggctggagtgcagtggcgggatttcggctcactgcaacctttgcttcctgggttcaagtgattctcctgcctcagcctcccaagtagctgggattacaggcgcccgccaccatgcccagctaatttttgtatttttagtagagacggggtttcaccatgttggccaggctggtctagaactcctgacctcaggtgatccacctgcctcggcctctcgaagtgctgggattacaggcgtgagccaccgtgtccagctgcaattttttaaaattttaatatatatttgtttttattttattttatttgagacaaggtctcgctctgttgcccaggctggagtgcagtggcacgatctcggctcactgcaacctctgtttcccaggttcaagtgattctcctgcctcagcctcccaagtagctgggattacaggcgcccaccaccatgcccagctactttttgtatttttcgtagagatagggtttcgccatgttggccaggctggactcgaactcctgacctcaagtcatctgcccgcctcagcttcccaaagtgttgggattacaggcgtgagccaccgtgctcggcccctgaagttactttgatattgacatagtcactgcaggttttaaaaatttttgtttgcatggcatagcttttcctgtccttttgacttattggtgtccatatctaaagtgcatttctcatgagcagtttagcgttgggttttgctgtcctaccctccctggcaatctctgctcttaactggggctgtctgaccacttgctccggtgtggctgtggctgcgtggaggccacgcctgctgtcctgctctgttcccattggtctcagtgtgcagttgccacgcccaccttcctgttctctgctccctttggtctcactatgcagaggccacgcctgccatcctgttctctgctcccattggtctcactgtgtagaggccacgcccgccgtcctgctctctgctcccgctgctgtcaccggctctccctttcccatttcctcttccttccttggattctgtttgatgatcctgtttgattgcagttgttggcttatgagccagaattttgttttgttgttttagtggttgcttcagggttcacagtaaacatctttaactcacacggtgaacctttttgagtggggctgcacctccaccagggcagatgctccgcagcgcacgtcacccaccctctccccgccggggccatcgccgcagggcggttccctggtgactgcactccgcgcgggtgccattggtatggtctgggttgaacactctgatatttcacctgaaaggcaggtgccccagccccgggaggccctcctcaagcccttgcctgctctgggacccctggctgcgggctgaccctgaaggggcatcttgaggccaggactggacctggcaaggccccggccgaggtcacggctcgagtgtgactgtgaacttggacatctgaccccaaagctcactcctgggacaaacccaagagaatcggaaacaggcgtcacacaaattgttgtccacagatgttcaaagcagactcttcatagctgctcaggtgtccacaaacgatcgacagataagcccagcgtggccctccacaccagggaacaggattccaccaggaaaagaatgaggcccgcacggctgcagggggtgagcctggagaatggcgatgggggacagaagccagacacacagccccgactgtgagcttccgtttctatgcaggcccagaacaggcgggtccggaggcgggaggaggcccgggttgccagggcggcggtgggagagatgctcacggggagggagttctcttccaggtggagagcgtttggaaccagacgggagtgagggtcactcaacatcgcaaatggactaaatgctaccgaattgtacgctttaaaacggttcattttatgtgatgtgaatttcagctcaataaagaaaaaagatttaaaatgtgtcttgaggagccacgagcatctgtaccagggaggtggaattgtgtcaggaaggctgaggcctggagatgagcaagggttggggcaaatcctggagataaatgtgttatttctgcaacttaaataggggcaggcttgtgctatgaactctaaatactcgctgcagctgcaggacggctgctgtgctccagaaatctcagccgcatccaagacaggaaggggccgggagggctgcgtggtcggctgagcgacggcacggagacgcatccccgccgtggaacctgggagtgctgccacatgtggtaacaggagcttcgcaggtgtaagtaagttaagggtcttgagatggagaggcgagtctgcacttccaggaggccctaagtgcagtcaggcgccggtaggatgcaggcagtgggggcaggaagctcgaatcggggacctgagggcgcacatggagaggcgagaagaggccgcacagcttgtctgcccgcccccttcctcccgctcgccttcccttcctggacaatttcgtcctgagacctttgcatgaggctgagcatcctcacgggccgtggggagccaggggttgggagtacagcatggaccctgcgccggcttggggtggacgggggcgagcagagggcaggcgctgtgccgggtgggcggcccgggtgggtgctgggctcaggtgaggagtgggggcatctgcaaggggggcaggcgggctccccgcgtgggggaagccagtggatgccaggagcacgggatgagccctgtgcggtcggactggaattccagggttttcttttttttctttttttgagatggagtctcgctctgtcgcccaggctggagtgcagtggcgcgatctcggctcactgcaagttccaccttttttgttcaagccattctcctgcctcggcctccccagtagctgggaccacaggcgcccgccaccacgcccagataatttttttttttttttgtatttttagtggagacgggatttcaccatgttggccaggatggtcttgatctcctgacctcgtgatctgcccgtctcggcctcccaaagtgctgggattacaggcgtgagctgccgcgcctggcctggaattccagggttttcaacacaccttggtggttttggaagtaaataaatatagatgtgaagaaacacaggtaactttcccaagagcacgaggcacacacgacacccaggctgagcctccagggctccgggagatggggccgggcagggagcgcctggtgcgtgggggccccggaggtcaggggctgtgagtggggacgggcacgcgcaggaagccactggcctcgcccctggacatcacgctcaggggaaggcccagctgcgctgatgtaattgatgcgtgcagggaacgtttgaggggaaagaggtttcatatgggttcaggcatcttcccctcaatgctcaattacaaaaccgggggcaggtggctgagtgcaggtcgggaccaacgcctgatgggacaagctggcatcgggcgctgccggcggcttcgaggatccccagcaattctacgtatttccactccaatgcccacgctccggagaaagccagtgagggcgtccccgaattgcggtccagaaccttctgcgcaccaaggttgtgagagtccctgagaggcggggcgggctctcccaggaggaagcagcgtgaatgctgaggccctgcaccaggcagggagctgtgctgctcgttgatgctggggggctgcggtgtggactgggacggacagcctgcctgccggaacggacagaaggtgccgagagcgaaggtggagggttaccagctcgctctgaggtcaggaaagagttatgtgaacggcgcttgcaacttttcaagctgaaatttttaaaataacaaatacaagttacagataagcaccgtttctgaacccacagttccacgttggagaatcaaatcccacaaaaaatgtttgtcccagaaggtgccgtttgatagacaagacttaatccacgaaccggacacagccacaggggctggcatcatggagcacccgcggttcttcctggagcatgaggagtccagctccctcggacggttccagagcacaggtagtgtccccagagggagtggctgctttcctgatcactcatggattcttttgcttgtgacaaggaacatgcatcagtcctataatttctttttctaaaatctaggctggcgcagtggctcacgcctgcctgtactcccaggactttgggaggccagggtgggtggatcacctgaggtcagaagtttgagaccagcctggccaacatggcaaaaccctgtctctattaaaaaatacaaaattaggccgggtgcggtggctcacgcctgtaatcccagcactttgagaggccgaggctggcggatcacgaggtcaggaggtggagaccatcctggccaacatggtgaaaccccgtctctaataaaatacaaaaaattagccaggcgtggtggtgggcacctgtaatctcagctactgcctgtaatctcagctacttgggaggctgaggcaggagaatcgcttgaatgtgggaggcggaggttgcagtgagccgagattgcgccactgcactccagccggggtgacagggcgagattctgtctccaaaaaaaaaattttagaacaaaaatgtaaaggagggaaatcccaacagttgagttgctgtttccatttacacgttgaacttgatgagcaggggtgccagatctgcttctctggggcagaaacaggagccgtgcgtgtcaggcccagggaccatgcagcctctgggccgcccaggtgcagacacctggcccctgcttggtcaactcagccctcgagcctcttcctgactaggaggcagccgtgtcctggtggcctccctagtggcagggtggggggacaggcggtcacaatcctcagccgcaagccgctgcaggattacgagatgtggttctgaccctccctgcccccagaaccctccggcctggcggctggatgctgagcctctcgtggggctggggtgaggtttccagggggccacacgggctcagctgtttccatgaggcctcttttcctgtttgctgctgtgttcagcaaggccacatccatccccccgaaccctgtcgaaggggaccctgttcagctccgagcagccccgagaccacccaggaaggaaggaattggggtcagtgtgaggcagtcggtctgaagccttcatggtaaatattttatgatgctttcttttctatctagaaatgaaattcagttcttaaaagcttcacatataattttagggaaaaaatatctaaggcccccaaatatataagccccaaactgtggtataacagaaaaataaaaataatttatagtaaaatgttgtggatttgaagtccatgaaggtctcaggtgtgcggatgccagatgtaaaatgaccttcaggtttcccaaaggcccctgggttagtccagctcctaccaagaacctgggcccttagccagcaggccaggtgcggcccacctcccctgccctgttgacgaggggtgcaggccccccagtgtcagccgatgacacctcagcagagaccctctggtggtgagggggaaccctggggaggccctgtctttccagacaaggttggcactcaccatctcccctttactgatctctctccttggcaggtggatgtaatgcctggagctacagcagctatttcataactatgaggcaatgagcaaggaaaggccaagagaatcacagaaatgccaggcctgactcaagctcctgcagcacctcctgaacctctgcctccagaacacgtgtcctgtgggaaaaccctgtgtgttgacagggtcgtggtcacagatcctgtacttgcaggcacactcctttctctctgggccttccccagcgtgtagagcctgttggacacaggagcactggccactggcctctcccagcagcgccatgtgcccttgggctgtggataggatcccagccgatgctgcagagaactcagcgttgtcagccgtgaatacttacagcctgcgtcaagattcttgaattccaggttcccgtcagtggtaggaagatctccatggcacgatctctggaacctgcgagtacatcacctagaaggccacgtctgagcaaatgtgattaaagtaaggatgtggaggctgtgcagctttcctggattacccagatagagtgtaaacgcagactagtcctcacgagagagcaggggaagccccgacacagaggtggccacctgaggacaaggcacggagaacaggctagtttggacacccagggcattccagggtccatgcctgtcctgggactccactcccttgctggtgaggggtccaggcattgccaggaggagcccagcagggcgtctgggaggcttcgtccttcttcggtgcctttgcccgtccaggacacacctggcccctgctgcgtgccaggccctgagtctcgtagtaacagaatggactttgatgctgttcctctctctcctgggctggccaggagtcactgcagctgcttgacaaatgtcacccaggttgagtgtttttaaagccctgtatctattctatgaaggatagaatgttaaaacatatattaaaacctttatttttctgtcaacatcagatgtacttccatttgcctgactgcatctttcaggtcttgttgaaataaagtagaatttcaactcctgatttttacagcagggtcagtcttacccaagttctaagttacccaggttccaagttttacaggagggtaacttagcccaagttctaagttaccaggtgagatggaaatagcctgaccaaaatcctccagggccagggggtgggttgcttggactgctgaccttctgagctatgtgccccctcacagtgtttccaggagcgtgtaccctcacagaatgctcccgggaaggggctcctcctcacagagtgctcccaggagggtgctccctcacagagtgctcccaggaaggtgcccctcctcacagagtgctcccaggagggtgctccctcacagagtgctcccaggagtgtaccccctcacagagtgctcctgggaagaagtctaccttggattctgcaccatcagagattactcccctcaaggatgatgcctggggagggatggctgcctcagtgccagggctggccctacattggaaggcagcccagagggactctgcctggatggggtcccctccccgcttctctgtgcctcaatgcaggctgtgtgctttgacttaaaggcggacatttcaccatttcactccttcacatggcatccctgggctcgcaggtagttctggccagcagatggccctggagtgctgcccaccctccagctgtcctccctccagccgcactgccgtcctccctccagccgcactgccgtcctccctccagccgcactgccgtcctccctccagctgcactgccaccctccctccagctgcactgctgtccaccctccagctgctgccctccctccagtcacactgctgtcctccctccagccacactgctctctaccctccagccgcactgccgccctccctccagccgcactgccgtcctccctccagccgcactgccgtcctccagccgcactgcagtcctccctccagccgcactgccgtccaccctccagctgcactgccatcctccctccagccgcactgctgccctccctccagccgcactgctgtccaccctccagctgccatcctccctccagccgcactgccgtccatcctccagctgctgccctccctccagccgcactgccgtcctccctccagccgcactgctgaccaccttccagctgcgctttacaggtatgttcccagatctctggggccacagggctgggccctggccctgcctcctcctcgccgctgggccctggccctgcctcctcctcgccgctgggccctggccctgcctcctcctcgcctctgggccctggccctgcctcctcctcgccgctgggccctggccttgcctcctactcgctgctgggctgccctgcaggggccttggggctttgggtcagaccagccccagggcagagcaggcctgtgtgggtgactaacacaatcagctcactcagggcagaatatgcgttcctggggtcttcctgaagattagatgcataggttggaataaccaagacaaggggacgtgaagcatagccatgtgccgtccagccgcgctgtgggaaagggcaggctgcataggcaggggcggccctagaagattagaatgctggattcttttctttctttcttttttttgagacagagtctccctctgtctcccaggctggagtacagtggtgccatctcagctcaccgcaacctctgcctcctgggttaaagcgattctcttgcctcagctgggattacaggcgaacgccaccacgcccagctaattttttgtatttttagtagagatggggtttcaccatgttggtcaggctagtctcaaactcctgatctcaggtgatctgcccacctcagcctcccaaagtgctgggattataggcgtgagccatcacgtctggccagaatgctgcattcttactgtaccttttcatgcgccgggttacagctgccgatgggattcaggagtcacatggggtgcagcccaggagcaataggctgccccatccaggtgtgtgccacgcgctgtgatattcacacagtggcaaaatcgcatgacacatttcccagtgtctccccatcgctaagtggcagctcactgtaaaggctgaagcccaagttggggcacagaggcctgcagggacacacaggcctgcagggtggtggggctgactccacaggaagcaaacccttatatagaagccccacatggcagatggtccaggccccagacaatgacctggtggggcgtggattgggacctgcccctcctgccagcctggaagggtcttgtgggacgcagggcactccttgctgggcgcgcagtgtgggcccacgactccttgctgggcgcgcggtgggcccacgactccttgctgggcgcgcggtgggcccacgactccttgctgggcgtgcggtgggcccacgaggcctccttcttaggttgcagccctggggccccttagtgaggagtgaattggcagggacagggtgggggtgacactcaggtcaaggccaggtgtgcacctggagctttcctgaccatcactcaaggcaggtgggcctggcgctcactgcactggagggtgggggctgccacctctgcacctggctcctgccctctgagctcctgttccttcgggcacagccagggcaaagccaatcccacaagtccctgcggggccagaactctctggcacaaaggcgggaactaagagcaccttctatgcagaaaaccccgtggatgtgagggaaggcggccagtggggtcgctgggggtgggacgacgggaggccgcgtgacacccccaagaacgaaggagcacaatggggcatccggcagagccaggagctggggtttccaccgggagaggtggcactgggggagggggctgggcagagccggggtggcagcagggctgggaagctgggacctgctgtgcttcacttccggggcgatggcaccggacagcgtggggccgccgaggcgcccagcatcccaaggtgctgcaggagggacgcacggctgtaggggtcagcctgggtgagcctggccccccaacaccacagaacacgcgaccacagtttcatccaaatcaaggctgtatttatcgtcactgattgacatgggaacagaatatttaaaacaaacagggtccaccgtggaaatgtggctgaaacacagaactgagcaaagcaagtggctcgacggctgaccccgaaggctgggaatcccggcagggacacagcccagacatcggggaacacaaaaggccgcaaggggggcagggcatgggggggctcatgtgggtgagggcaaaacccaaactgagaggaggccaggccaagggcctgggaggcgacgaccacaccgaggtgacgctgatgcctcaggcggaagaaaacacacagcagtgattttgtgtgtgtgtgtgtgtgtgtgtgtgtgtgtgtgtgtgtaaaatcagcctttagactcttgcacttctatacctccaccgatctggtctacagattccgagaacactgcaccatccacacaaacgtccacagcatcgcccttgcggctggagccggccagtcctgaagcccacaggagccgcccaggagtgctgttctgctggcccaggggctctgctggggggacccaacccctccacggacccaggggctgggaggtcgctggcggaaccttcctcccccaaccagcagagccgccgggaagcgcttgcatagttgaaggaaagttgctgccattaaacttctgataatgtttacagccagcagcgcctgggtttttgtgaccatgttagacaaacaaccagaggggtttctggaaacggtttttataaagtctatctagattaagaatttagtaacgtcatatatttatatcaacagactatttacacgtttcgtttgcttttaaaaaaacaaaccaaaaaagaaattacacttctgcataataaggcaaaaaaacaaagttttgtacattattattttaatataatctgtaacttcggttccaagtaccaagggggggccagggctggcctgagtgggggcctcacagtgcgctggacaaagtgaccggtttttctccataaataagacaaagaaaccctggggatctggagaaggatctgaggccattaaactgcaaatcccaaccgaaaacgaagaagcaaaagtttcttttttggttcttttaaacgtctaaagagcataaaattaagaaaaatacaaatccattacaaacacttctcatctgtggggggaaaaggtacaaacgcgatttttttttcccaacagccgaatcccaaactcggaaaacaaaagatcaccctcagaaaagccgacacccaagtccccgcctccgcaggctgcgggtggagaggcggcgccgccccaggatcggcgggagctgtgcttgagttctaggaactgatggagagacggacagcggtgcgctccgctcggagaggcgtctgcggccccggggctaccgcgcctccacctccgggggatttcgggacggggagtagtcgcgcgcctcgcccggcccgaggccccccagcggagtagtccggctccgcggcggcccggggggcgtggggggcccggccgcggtcaccagggggggcggtgcgccgagggcggcggcggcgggcggggtccgcgccaggagcccattgtgcagcgcggcgggcgagaggcgcgggaagtgcagggctcccagcgagggcagcagcgcgccgtccaaggcgggggcggcgggcggcaggtgcggggcccgcgcgcgctccagctccccgcgcaggcgctcggggctgtagccgtggggctcgcggtcgcggtaggggcgctccgggggctccaagagggcggcggagcccggggcgggggcggcagcggggaaggcgcgacgtggcagctccaggccgcggaaaggctcccacgcgaagcccggcgcgcccaggcgctcgcggcccaggccgagctgcaggggcgcggggtgcaggccgcccgccgggggctcggaggcctcgtcctccccgcgctcctccttgaccttcacgtctccaggggccgccttgctgtggggcggggatgcgcgcgcgggcatcttggcggcctcctccttggccggggagcggctctccttgacccgaggttcggcctcgcgctccgcgggggccccggatcggcccagctcgctctgggcccggagcaggaggccgctgacggggtggccagcgggggtggcgggcgaggcccggctcagcaggcgcgtcttctccaggaggtccctgggggcggcagggcggacccgtcactcccgagacctccgtcctgccgcgcggcgcagccccgggatgttcccgttgcttgtcggggcctccagtttctgggtggccggtgacccctcagcacccacagctcccgcacccccacaggctcccaaaacctacgcgtcctctccccgctgggcggcctggaaaccttggccgggagacggaagcgggatgagccgcctgcagcgacttcggctccccacgggcccctccctgttaggacaggggggcctcccggcagccgcacccccgaactcctccctcaaactccgtgggtcagggcgcggccacctggaggtctcccggatggcaggtgtgggtgcctgtggtggggtcttcaccctcctcatccttcccagccccagggcccaggcttcactccccaccgcagggaggagtcgccggggagcagagctttggcccccgtaccccggggctcagcagagctggacagactgtgagtgcgcagcagtggggcgaggagggtgagagggaatgggggagggggaacggggaaggggaacagggggagggggaacggtgagggagaggaaacggggagaagagggaacgggggagggggaaccggggatgacgggaggggggaaagaacggggtaggggtgtgtggtggggatacggaacaagagggccactcaccgttcctgctcctccttgccattgtccggctctcggtcatggttggtcagggctgacacccgctccgcgtccacggacttgggccacgggggcggagccgggaaggagggcggtgcccggtgcagtcggttccaggcctcatgggggctgggcaggccgtgcacggaggagccctccttgggggcaaagatgctgccaccgggagctgggggcagaggccggggagcatgaggttgggtctgtctgctccccagccactccccaggagaacccggtaggggttttagaaggttcccaggctgacactgagaagggggtgccccaaggaggcccagcccagagaggagggaggtcagccaggcatcggggttcctgcagaggacacaggcatgggggaggggcgcgggcatcgggggaggggggcacaggctgggtcactcacccagtgcatggctgcccaggcccccaaaggcgtggctgctcaggctgcccaggcccccaaaggtgctcggtctgctgaaagggtctgtgggggcaaccgcgggacccagaggtctgtgaggcgtgggctgaggctcccacctggcccagtgggggctgctgtagaggctttgggcctggtgggtactgcctgcatgacccaaggggctccctggggctcggggccaccttcccgcccacctaattcccccgccacaaggctgctgaggaaccagccaggctgcgtgggctgaattcagagacacccacctgtcagggggccagtgggcaggaagctgccaggatgggctgagggtccaaatgggttggaggcaggatgggcggcacctggggggggcagccaggtttgacagaagccaggagagagcaccagggcctcccatctgcagctctgttcacagggagcaccccaatttcctctgtgaaccttcacctcccattctctcgcatgccctgaggggtgaagcgtgtccagtcagagtaagaggtggaatctaccctacaattcggaggtttgacttggagccgcagtggcagccatcctgggaccccaaggggggcagggagggaggtgcctgctgagtgcgatgcaaccctcggagcaaaggggctgcaacttgggcagagacaaagtccaagtaacatgcaccttgatcggaccactcctgaagcctttatctcagagctttcacctgggagctgatagatggtcgtcacttcttaatgtggtgctgggcctcaggcctggatggacacggttctgtcttggaggctgcacatggcagccccttgtggcattcctgggcacaggcccagcccacagcaccacgtcaacatcagccctggccccccaacaacccttggagagcaaccgtgtggggcccgggcccgggccctgggaggggctgctgcaggggattcagtgctgttggtcaggggccgtcctccacatgggtccagagagcaggtttctggtaaagaccagcagggcgtcatctttaggttactccgactccctcccagccctaatcttagggacctcaaagatggggtgctcatgcctcccatgtaggacgcggcaagttgtattcagagcttctggtctccactgagctgtggcatgaaagctgatgccactcttctaaactagagaggaagacagcctgccccatgctacgaaaacacagcttgtcaaagcgtgtgcaggaggagatggagagtacactgcctcaaatgcccgcactgggagaggctgaggaattaatattctcaaccaccagatcaagctagacagggccagaaaagtgagcgacacacagggaaacacacacagagaaggcagcgaggtcagagctgctcctttaaaaatactggtgaaattggccgggcgcagtggctcacgcctgtaatcccagcactttgggaggccgaggcaggaggatcatctgaggtcaggagtttgagaccagcctggccaacatggtgaaaccatgtctctactaaaaatacaaaaattagccaggtgtagtggcgcctgcctgtagtcccagccacttgggaggctgaggcaggagaatcgcttgaacccgggaggtggaggtcgcagtgagccaagatcgcaccactgcactccagcctggcgacacagcaagacttcctctcaaaataaataaattaaaataaaatactggtgaaatggacaaacttctggtgagattaatgaaggaaaaaagacgacacagccaagcaacattaagaattgccagggcctgcggagttcaggcgtgacggatggacaccgacagctacggagcctgccccaaatcaacttactggaaacactcgcgttactgaaaccgatgccagaagaaacagcttgaggaataccacacccagtggagaagaaaaatcagtacttggaacctgaactgtgagcctccaagccttgaaggcagtgaggatcagacctcacaagagctcttccagagagcagaaaaaaggaaagcgccttaactcactgaagacggcaaagagccctcgtgacaaaacctgccaggtgcagcacaggaaagtaaaggccaggcttactcaggaaactcatctggaacaaagcgctggaacagtggctccagaaacgtaccgacagtttacacaagggggcaaaccatccactcctagatatgactttctacacagaaaaggtaaaggaattgacagacaaatgtctttgcattcgtaagaatttagcaggattgctagttacagcatcaagagatggcatacaaatcttcaaaacagatacgcacttctgttttctagcaacagcttaagaatgtaacttacaaattccaatcataatattagtaaaatataaagcatctatgagtaattctactaatacctaaataaatgagatacaccatgatcagggataggaaaatgataccggagatgacgtacgaatccctcttaggtcgatgtacccctttaacccaactccagtgaaagctggaacctaacaggcagattgaaagtttatatggaagagagaaaagagcaacaaggaatcatcctgccccctgccagcaagatatcaagacctgccaaggagatggaggaggcagcactggccccgggactgagggggcccagcctcgcaggacaaatggcagagcaccgagggacagccaccaggtatccagaggagggaaggggaggcgggggaggagcagggtcggtggggcgggcagtgtggagggcccagaactgggcgccacactgagcacgtgtccggggggcttgagccaggatgcggacagccagaaactgcagcctggacttctgctttctgagaaagccagactactgggatgctccatggcccagaggccaccatgcttgtgaagccagcctcatgtggctgctgggcatgcccatcacccttatgtggacagggctctgccttcacacgtccacatgcaacgtgccatcaaatgctcatgaacatggaagagaccaaacacggtgaggggagagtgagggcggctgcagcgggggttgggagctctgaggaagggacaggcctcaaggacctggtggctgggaaaggttccatcagcaggacaactgggcaacgcagtgcccatgtgtgtgcctgtgcctgtgtgtacgtgtgcctgtacacgtgggtatgtacgtgtgcatgcagctgacccttgaacaacatgggtttgaactgtgcgggccacttagacacagatttcctcccatccctgccacctgagacagcgagaccggcccctcctcctcctcagcccactccgtgtgaggacgaggatgaagacctttaggatgattcacttccacacagtgaatggcaaatatcttttctctatgattttgtgtgtgtgtgtgtgtgtgtgtgtgtgtgtgtgtgtgtgtgtgagacagggtcttgctctgttgcccaggctggagagcagtggtgcaatcacggctcactgcaaccttgacctcctgggctcaagcgaccctcctgcctcagcctcctgaggagctgggaccacgggcgtgcgccaccacgcctggtcatggtctgcctcataaggttttcttttctctagtggacttcattgtaagaatacagtccatcatacatgtaacacacaaaacaggtgttcagcaactgtttatgctatcgtaaggattcctgtcaacagtaggctaagtttcgggggagtcaaaagttatacctggattttcaactgtgtggtggggagtgtcccagcctctgtgtggttcaagggtcagctgtatgtggatgctcatgcttcacgtgtgcgtacacgcgtggatgtggatgtgtaactgtgtgtaactgtgtatgtgtagaaaggcgtgcaccgtgcaggctgagacaccatctttggaaaggtctgtgcacacagctggccctcagccagcctctaggcacccagactgtgtccatcccacactgtgggttgaacttcgagcccactttcctcctgggggcctgtgccaggcagtggtgcctacagatcagcaccccagagtcttcgtgcctctgcgtgcctggaggatgacactcgggtgtggtcacgttgtgttgctgggggaggggtgacccgggggagggggtgactcgggggagtgggtgactgagggcacggaggccctcgctgctcccggcagatcccaccctgggccgtgctactgaggacagtacaggccaagtcctggaacccttcctaggaaaccaccgcagctgggcccgtcctgggaccccgggagcaaccatgcatgtgaggaaggggcactggggtgtgggcccagcctggcctcaggagcagcttcctactgttcagcgagaggccaaactcctcctgggaaagcgggggctgggagacagaaaggggcagcctcgcgtgggcctgggtccctgccattcctttgcctctggtggggccagaacagggagccccagggaggaggggtggccaggaccagccgcctcagagccgtgtggcgtgggctgaaggccccccaggacacactgggcaggacttggtggggaggagcagcagccccaggcccaggtccaccctggggaggctggtggggaggacaggagaggagaggtgaggagaagagaggtgaggggtggggtgaggtgagggagttgccaggctttgacctgaataagtggtgagcatcaagaagcaaaggctggtgctgcggtccagagagcgctctcactcctggcacaggaaggcaggctcagctgggcacgagcgggaggtttctgtgccccccacctggcccgactccagtctcacctgtgctggggaagaggggccgggccaggtcctgtgggtagtggaagcctgcaaacacgcccggggcagggggtctgccgaacaggtccagctttgcacccacctccagcttgtgggggtccagctgcatctcctgggaggatagaacgggtgagggccgcctgcccggggactggccctgaacacagggagcccaggcctgaggggccacagggactgggtgtgagccagtccagaaaggggagcaggtgggatggatttcaagggtgtattctctactcaggatgacggaaatgttacacatgatcagcaaaaaagctgaacgggagagctcacgtcctctgaactgtggtacgtacttggcacatggcagctgggatgctacgctgtcatggaaaataacttactttttttgtatttagattcttttaaaagttaaggccaggcacggtggctcacgcctgtaatcccagcactttgggaggctgatacgggcggatcacctgaggtcaggagttcgagaccagcctggccaacatggcgaaaccccgtctttactaaaaatacaaaaattagctgggcgcagtggcgggcgcctgtaatcccagctgctcaggaggctgagacaggagaatcacttgaagccgggaggtggaggttacagtgagccgagatcacgccactgcactctagcctgggtgacagagcgagactctatctcaagaaaaaaaaaaagaaactgaaaaagcatgctcacgtgcccaagttgttccaaatatgctgaaaagtttctcagtgactgaatttggtatcagttttcaaagttaaatgtgttaaaaattatatgaaactacaacatgtgcccctcacctgcactggccacacttcaggtgcccacgctgccaggcggctgtgggaggcagggccaggcttgggtggagactggggatgcccatgccctcccatgggagcagaggggcccagagccaggaggggtgtagccaaacaagaccccactgtcctggtgactgcgctgcctctgcctgtcctgcctctgacccgcactcaggctggcctgggccggcccctcctggtccctgcagtgtgctctggcactggggtggtttcactggccatgatgatgctggggtactctggcactacgtgggggcaggcgtgagggctgggcagaccctgtgtgcgccctctccctggaccgccggcctcttgcaggatctgccctcctctgtggagcaaccatgccccgagttccaaggacaaaaccaggagtgatgaggtctcccgactctgccgtggacggcccctcaccaggagcacctgatccctctgctgtgtgtccagaagttccacccagacatgcaagtataaagacatgcagcattctggccgggcacagtggctcacgcctgtaatcccagcactttgggaggccgaggtgggtggatcatgaggccaagagattgagaccatcctggccaacatggtgaaaccccgtctctacaaaaaatacaaaaaattagccgggtgtggtgacggtcgcctgtagtcccagctactcgggaggccgaggtaggagaatggcgtgaacccgggaggcggagcttgcagtgagccgagatcgcgccactgcactccagcctgggcgacagagcgagactccgtctcaaaaaaaaagaaagacatacagcattctgctctgagtcccgtcccaaagggcatttaggacaatgatttttcagagttgtgtgcggaggtgacgtgcgtcatcaggacagcgcagggacagcagaggtgcagggtcccacggggctgaggcaacagtccccctgtcctggcctcccaggaccctctcccgctcccgcagctcctagcctggtgggacctgcaccgagctgcccgcggggctcccgccttcctcagccttcccaggtgcacatcagttgtgagcactcacggtccccctgggtcactgctgaagaccgaagaacacagcagacactcaatcactgtggggagtgggggcggcagaggaccccagaggcaccccagtgacgtggggagctggtgcggcaccccgtgcccctgctctgctccccgtggcccagccggcacaccttgccgaggagagggccttgcggcacccgggcacccagcactgccctgtggcctcgctgacctgcttacggtaaaagcccagtacccagaggaaggggcaggcggctcacgcgtgaggatcacacccgtgcacacgcgtgtgaacacacacagcctcatgcctggccttcagggcccgaccaggctggagtcgggttcacaagcgccctgccccagcccaggtggtctcacctttatcttctgctggtgacggtagatctgccaggcgatctgcacgtgcacggcacaccacctccccggcttctgcgacaggatggaagcgctcagtggggctggtgccacccccacccatgttttctgcagactcctgctgtcacgggccccccgaggccgccccgggggcaccagagtcctcccttgccacgggccttcccaacacgtgctcaccttgaccaccgcccggtacgggtcagacacctgtggagacaggaaaggagtgtgaggtccgggcccctcaggaggctgagtcctgggggtgcaggggacacagcccgtctgctgtggccaccagcccgcacagggcccggccggggcaggccatcccccggggtggggacgggcgcccactaacacctaccccaggcgctttctgcaggagtgtgtgaaccgcaccagcccggcgggccacctcaatggggcttgaagtctgaggggagaaagagacagcttgtgtgcgcctggggccgcccaggcaggaggacgcctcgggcttcctggttctggcgtgggcctgtgccctgctttgccttgccgtggggccccgcacgctgtctcccagggacagcctgccctccctcgcaggaccaccacactttcggcccgccagtttctgcaaaggtgggaagcaggtgctcttgccagggaaggtgggcgaccctccccggggagccacttgccaccagggccgagacagccccacccagagggggagtggtgcacacctagtctccagcccaggaggagctgctgtgagcctggatgggccaaggggagatggtcgtttcccaccaggggcgccagggaaaggggggtcccacagcaaagaccggccatcacaccacagccccctcctccccagactggctctaccgccccttccctctgggctaccgccctgcccagaagcagctgtgctcggggtgcggccgggacagattccttccctcccagactcagggcctcagcgtcctggctgtctgggctcagggcagtacccccgagtcccagtctgggggtccctgctcgacacctgcaggtgggccacatacatcccttctccattcctctgaattcctcaaccacggggtctgggggtccaagaccctctagtgcccaggggtgcctggtcctcggaagcactatctgcccgtccacgatgtgggcggtgccccaggggagcccaggggtgcgtgctgggcccttcagggcagctgtgggcaatgagtgggcgctgcaggatcctgggaggtcaagggcttggcagctaccggggatggtccaggccccgtcttcagaacctgaggcccacaggtgaggaggcttcaggactgagagctgtgtgcccctccgcagagggtggggttacagcacaaggccaggaacagtgaggagggtcacggggttccctctcccctggctgagatggcacacaacctcctgctacccaggtcccctgcgggtgtggacggccccgtaaggcccgggtcccccacggtgtggacggccccgtaagaacctcctcgcagtgtggatggccccgtaagaacctccttgcggtaaggacggcctgtgaggctgctgtccacaccagggcctcctgccaaggactggaatgttctccttcgaggcttccacagtgtgctctccacacggtcccaccacctcccagggctgctcccaggctggaccccctgtccctcccacggtggccacacacagaccgcagggccccccatcctggcaggggctgctcacgccagcacccagatgacgacaggtacaagggagggaaaggggggtggttgtgggcagagagtttggcgaggttgtcatgcactccccccaaaatccacccacccgctgtgcccgccccacctgccaggggcagcggtaccttaggctgaaaagcgccctgcagggacccgaaggggccggggtgtgggagcagggtgggcagtcccgggatggcaggagggaaggacgggaagaactgtaagagaaggagagcggatggagggggggcccaagtcctcaccccaccctctgcctgtaaccagaaggtggcaccaatgcagcaggggcgaggccaggcgaggggcagccccacccaccgccccgtggccaggacctgcgtgcacagcgacacgcgccgggcccctcggggacactcacactcacgctggaatgtcggaagtaggggctgtccagcttgggcgcatacttgtcaaactggaagggaaggagaggagggtgaggccccgcacacacgacaccgttgctgggccccgggccccgcccacctggccgggctgggcagtgacaggacggcgttgtgcttcctgaggctggcggcttcggccagccgtcccaggctcctctagagcgccagccccacggctctgaactcagtctcagaccagggcggccctgccattctaagggtccccttgcatggggtgggaactcggcccccccaggcagtctgtgtgcctggctgaggcctggggcgtgaagccctggctgctgggtcgcgctggggacacaccgggttactgacaaactggccagtttccgaataaaactcgagagagtggaggggactccagcccccagcaactccctcctcagaccgggcctccggggcggggaacacgggaggcaccctgagtcatggtccctgtgccctcaggcctgtctgggctccagccctggcactggggatctagtgcaggcgtgagggtgtcccatgcacgtgggcacggggtgctgcctaagtccaggaccactgccgagggtgggggcctcatggcacagcttggggtggggacaccagagggcacgttggggaccggacagacgacagagaggtgccgccggccccccacctcctcctgggctggtgtgtgtgcgagcgtgtgtctgtgtgtgcctgctgcgtgtccccgccccacgcccgcccccgccccctgccagcacgcgggcctacgcaccggcgggggtgcggcgggcggcgtcgggggcagccctgcggggaagggggcgaatgtgtgttggtgctggtgtgtgtgttggtgcgtgtgctggtgtgtgtgctggtgctgatggaactccgcccgcagcagagcccccgggcccagggaggcgccaggccgctcggcgctctgcaccagaaaccgcgtgttcagctcttgcctgagcagctcgtgatctacaagagaaaaagagagagagacagagaggcacgttggccgcgggctcccggcggggcgaggcggatagtcacctggcactcccggggtcggcaggccaagccggggtggccgctcgccacgtgcgggcccaggggtgcaggtaagagaggagcctgtgaccaagtaccaatcagaattcccgaatgaggctggcaatacatgattggctggctgaatgagaccgccaggctggcatctagaggcaagagagaacacggtgagcccctccccgggagccagggtccagccacccgcaggccagcatcctggtcccatcccgggacacggggccgtccccagcctgggccgggctgactcggagcctcaggaagcgcctgggggccgagggaggaagccttcgcggtcggggttccactgggatggcgcctgcttgatgtgcggccccctcctcccagggctcaggacccagcaggctgcgggggaggcctggccccaggaggggaggcccgtgcgcccgtctcagtgtgaacacgcgtctgtacgtgcatgggcacgtgtcctgcctgtccccgcacacagatggcccgtggcccagcagagactcctggggaaaggcacacctgggggaaccactcagagaggcgcgcagggtccgcagagaccacagcaggtggagggccaggctgtgcgcccctccccggtggccgtgtccccgcaccccccaacccctgccctgggcgagattgtggccgagacacctaccggccgggtgtcctgggaggaccaggctgctggccggcagcgccgggggcgggggcagtgtcgggggtgcggcaaacatggccgcgtggagctggtgctgcgcctgggaccggagcgccaggtgtgaggtagacaggtgggggcccggcccgtgtggcgacagcgacacgtgcttccccaggcccaggggggcgctgctgctcctgctgcgggacacggggctcagtgcctgccagcccgacccctgcagagcccccatcctgagaccacacaggccccgtcccccgcggggaccccacctgaggccgtgcaggccgttggctgccgcctggctgtggcccgcgaaggcgcccagggatgcaggcacgtgtgtcgggagcaggccgcggggctgcgggggtggcggctgcggggtgtggcggtgcggggcggggggttccttcttcaccaagggattggcgcgggagccgggcgggggccccgggcagggcgcggcatggggcgcggggctggcagtgggcaggaagctctcggcgctgagctcgcggctgcgctccaggcctgacaccttgggcaccggcccggccttggcctccgacttctcaagcgctgggcctgcagagagagggtggctgcgttcagaccagcagggcctcgtccctgcccctcctgtggcccagggagccctggtacgtgcccggtgcccaggctatgtctgggctccggctatgcccccatttcagatgaggaggcaggcacggaggccacacagctagctggatctcacccgaggctccaggccccgcccggcggagggagctggcttgggagcctgggccgtggccaggggtgggggtgggtagcccacctgcccgaagacgcatcactggcagggacaggacaggccctgcaagagtcagtccctggacaggggctgctatgacctcatttaacagacaaaaccaagatacatcaaggacttggcccaagaggggagctggatttgaacacgggagctagggcctgtgtacctaggcctcatgttcacggcccctggatgtgccctcagcccagggcatgggtctgccccaccccaacagcagcgcccacagctgtaaccaccttttctttctggaaccccctggtggaaggcttgaccacttcctggaaacttgggcagggactgggtgggaggctgccccctactgtgactgcccgtcacccgccaccctcagccctgctccctggccacccttctgcccacctaggcacgtcccccgcaggtcctgtgggcccctctgagcccctggggcctgccccccccacccccgcacaccccaaaccctccttttcaggccccttcgggcaggtctcagatcaagtccccaggagtcaggagagggcagcgtccatgtggtggagctcctgttgcctggggtcaggagctgccacggtcagggggccagtttcgcaggagaaacaaaacaacgttccacgtgccgcatgcctcctgttcacgtccccggcagaccctgcttccttcctgaggccttgggacagtgagccatggcccatggggacagctgcggccgtccctgccccatgtgaccatggggcctggtcttctggggcctcaaggagttcctcccaggtgaaaacaggcagcaggaagcagccccatcttcactcttcacctggggccaggccttccacagcagccaccacccagcgaccacagagaggctgcgcggaggacacaggagagagggagcccacgggcactatctccaccggctttcccagctccctgggtcagccccacgggacctctcctcctctctcccacatctccaagccagccttgcatatagtaagagctgtgatcaggatggaaagaggcttgggccgcacagacctggactagaccccacgtgcggggcctcctgtgcccttctagcacctccagccctcactgggacattgtccgtccagatgcggcagcagccgcggcagtgagctgagtattcagcagccccgcgtgacaccgtctgcgaagccagctgcctctcctaccggggcccgtcccatgcacgccccttctgacaccaccccatctgcgcctgctttgctgtgatgctctgatgtgaacaggcttccaacttgaaggcaggtgaaggccatgcctgctgaagggcagtagggcccatccttgccggcattggcagggcctgtcctgtccaatcacatccggatgaagccgtcccagcaaaagggtggttccagctgaaacccagggaggcaggagccgagaccccgtggccctgccggagatgctgcccgcctaggccttggtgtgggaatcccaggatcccagcgccagggaggccctaagaagacgctggggctatcccctctggagagggttgctggcccgtggacaccccgccccacagctcacagccacaggttacgaaggcccctaagacgccggggctaccccctctggagagggttgctggcctgtagacaccctgtcccatagctcacagccacaggtttcgaaggcctggcctggaacagcaatccaggcccctccactgcaccacagaggcgcgcaggcagcagagccagggaagtgagtctcagtcccgtttctctttaactcagcagccacaggtgattgtggtgctcgtggcaggtggcccttcagtaccgagcatctgaccccacgaacctggggagggcctgagagcacacattcctaacggttccactctgggagccgctgctacgagcggagcccaggccctgcctagggctcagtggcttcgtctactctcccctgctcctgggggcttcccagcaatcccagcaccctggtcccacccagctctgcaccccaggtgccaagaccatctctcccctgacttcagggggatgtcctgccgccaagacgcagggcgcattgtgtctcttcagaggcccaggagctgggccgaggggacccacttacctttatcggttcccggcgcaaagagcttctcagagcccacggatgcctggagagagagaaggggggtcaggggcagtcagggtggtcctcatcctcgtggaccttgcgcccaatgcccacacacaagtctgggtggttttccagcagggccaggcgggatgtgcccttgtggatgcccccgtgtacgaggtgaacacgcttagtcctgagctccacgcatgtgtatacatgtgctcacgctggggacacacaggcccctctctgctcagagcagcaggcttcctagagggggtctgagtgaagacggggtttgtggggggatcgggaaccaaggctgctgctggcgtggactgggggagcgccggcatttggcaaatctgcacccctcccaggagaaccagcaccagtagctgtgggccctgctgggcccccacccatcaggccagaggcggatgatggagagccccgggacacacctcctgctcccaaccactgcccagcacaggcgccctggcgaaagtgagagaaccaggataccgaccaggctggacatgtgggtccgcaaggctgcagggcacctcgctatgctcccgggccggctgagctccaggcctggtgcccagcgcccacaggacaccgcgctatgtgcctggggtcggccgagctcccagcacccacaggacactgcattatgtgctggggactggccaagctctaggcctggtgcccagagcccacaggacaccgcgctatgtgcctgcggccggccaagctcccagcagccacagaatgctgcgctatgctcccaggccggccaagctctaggcctggtgcccagtgttgctgagaggcagctgagtgtcccaggctatgtgggggagctctcagagggtcaatcgcagaaattgctcagccccactcctccatctcttccagagaaactcgctcaaccacctgccacaagcaggtggcgagaatgtggccgctgatggggaggggtggacggagggccccatgctctgggggacttcacggcagtttccaggaatgagcttcataagaatgaccttaaatagatatttccctcctagtttcttcttcttcttttttttttttttttgattaaacagcttcattgagttgtggattcaacgtttctgtctatcaagaattcacatgtttaaatcctcacccccaggtgatgggatcaggaggtggaaggtgatgaggtcatgaggtcttgagtgtggagcctcacgagcggcatcagtgccttataaagggccccagagccacctagccccttccaccatgtgaggacgcagcggagaggcaccctctatggaccaggaagccctcacagggactctgccatgccttgacctgcttgcggcctccagcactgtgagctgtgaatgtctgctgcagaactgggccagagcagcccgcacggactaagacttgagatgtaaatcacataccatccaactcaccgtctaacgcttacaattcactagcgtttagtatgttcacagtgatgcacctgtcaccacgatccattacagaacattatcatcaccccaaaaagaaaccctgactcctaaccgtcacccccaaccctgggaaaccacaaatctgtctgtctctacagagccgtcttttccgaacttccatgtgaacactgtcaggcggcacggacctgctgtgattggcttctctcactgcacggcttttgacgttcacccacactgcagtgtgtaccctggagagatgggggacactctgtgtgtggaggaagcaactgcaaagaaggagtgttatgtggatctggacaatgtgcctgtgcttgggcacgtacacacactcaggcacgtacacacactcgggtacacgtacatgggcacaaactcaagtacgtacacacaggcacatacacacactcgggtacgtacacacacggatacatgaacatgggcacactcgggtacgtgtacatgagcacactcgggtacgtgtacatgaggacagttgggtacgtgtacgtgggcacactcgggttcacgtacagggacacacacattctcgggtgtgtgtacctgggtggcagtgtgtgcatggatgtttgtttacatgagcatcacatgtgtgtttacgtaggtgcccgcgtgtcggcgtctatgttggtgaaattgtagaatgtgtccaccaggagagagcagtcccctctgggaatggcgggggtggagggcacaagagactaggcttaaactcatacttttaagtttgtataaaggagactgcattctggtaacacttgtgtaactgaaatgcaacaacgacaaacataatcaacagcttcactgctaccagggaggggccggccaggcttgcctagtgagcacagctgtgagagaccagggcggggggcatctgactcggaggctgggtgctgggagatgggggttctgtgcttgtctgtccccctgatctgtaacacgacctgtgactcttagggttaaaacgataaaaagggacttaggaatttggctggtgaagcgtgcgagacccacagctctccaacctactaaaacctaggagggcggccggccgcggctcacgcctgaaatcccagcactgcgggaggccgaggcgggcggatcacgaggtcagcagatcgagaccatcctggccaacacggtgaaaccccatctctactaaaaatacaaaaaattagccgggcgtggtggcgggcgcctgtagtcccagctactcgggaggccgaggagggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatcgtaccactggactccagcctgggcgacagagcgagactccgtctcaaaaaaaaaaaccttggagggcgagggcaggggccctcccagagccaggaggctcaccaggcgtagccagcccagaggggcactggtgctgggaagagacctgctgtccccatgccacagcacacgtttcctatcaccccaaccaaaatcccaagcagggatctggaacacgtggattactaggtcctcactgtgggagctgcttcccctgaatcccacgtggcccagccaagggagctgggctgctgttcagggcagaagggaggcggctcagggtccaccggggcctggtgtggggctggggtgaagccaggcccagctgcccagagggacacccgtgtccagcaactggcagacggatcaacagtgagcgcgtctgcctcagccacatatggaattgctgtcggcacgcgctctgtgagcctcagaaacatcacaggagccaaagccagaccacaaagagcacgcagccgtgtgaccgtgagcgcggccccagccacagcagccgaggggtgcagggggtgcacaggagctcaggggttcggggcgacgggggtgggtgtacagacgtaggtatgtgtcagctggaggggtgcagggggtgcacaggtgctcgggggttcaggggcgacgggagtgagtgtacagtcgtaggtatgtgtcagccggaggggtgcagggggtgcacacaagctcgggggttcaggggcgacgggggtgagtgtacagccgtaggtatgtgtcagctggaggggtgcagggggtgcacaggagctcgggggttcaggggcgacgggggtgggtatacagtcgtaggtatgtgtcaaaaagcaaaccacacacttaaaatagctgcatttactgcaaaaataaataggtgaattttactgccagtaaatgacagcattggaaaccaacaaaaagatgtgacacgatgctgggacagacggacaggcaaacggacagacggaaggagatccaagagcgcaatgagaagccccagagttcccacagatgccgcgacggacagagatccacagaaccgaatgagaaaccccagacatggtgcaggctgtgggggccaggtgtggggtgcaggctgtggggaccagatgtggggtgcaggctgtgggggccaggcgtggggtacgggctggggggccagatgtgaggtgcaggctgtgggggccaggcatggggtacgggctggggggccagacgtgggggccagacatgggatgcaggctgtgggggtcaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggtgtggggtgcaggctgtgggggccaggtgtggcgtaggtccttcagagcaagctcctgtttcacctcttatctgaaaataattccagacagatcgcaaacatagaagtgaaaaaccatcaacgtatcagagaagaccaggtgtggattcaccttcttgctgggatgggaagccttcctagtcacgtcgcaagggcctggaacacagagaagagcagcaggtccatgcctgtaagatggcaagagccgaggcgggccttgccacacccacacgcgccggaagggccccgtgcactggaggaaggtgggcccctcggaaaggagcagcggttgggccccgcacgttcgtgtgtaaagggctgcggtgcagctggtgggaagggatgctgagctcctggcactgacgctacttggtctgctcaccctgtgcggtccccggggtcggggtcctgcagcccaggcttctgcagggtgaaacaccaactctatgtccagcgcccccagccaccaacccccaggcagtgacgtaggacatccttctgaggaggttgtttctgctcagacccagctcaaccacacaggggccgggtcggatggaagctaggagaccccggcaccccagaaagggaccctcccagccccagtccagggccccgatgaccctctccctcccccagcctgcggccaccacccctagaatcctggcttgttacaaagaaagaaggacaggaacctctcacccctgggaagccagggggcctggaggttggggcatgtggctttctcctctctgctcgcctcaacatcatcccccagaagtgtggctcccatggggtccgcctccacctccctgccccgtccagccactgccggtgacccaggctacgcagtgaccatcccagcatcggaaacaggaaggactccgagagaaacaggaggaatagtgaaggggcctgtgcaggtgggcagggaggagtccagaccagcctttgggcctccagggggcactgcggctccccagaaaggcctcggcacctcctcggccgtgcccatcccccagcagtgccagcaccaagtgctcccttgggccaggctcccaaatctgggcccctcacacagcaaggatggggatccagtgctgctccatgccagccatgaaccaggcactgaacacccaggcctgccacagacccctggggtctctcctgggcctgcaccatcctcctgggaggacttctggacccctcatctgaggggctgcactgtctctggcacgcacgcgggccctcttcttggctggcgtcccgggtttgagtggcctcttcgccaggtggcccacctgttaactgccccctctgtggttggggcagcaggccccaccacgccgccaggactctccaggggccaggaaggaggcgggtgctgaggcctcccaggtgggcagagggaggagaagccagcttagcccgcagtttgacggccaacccaaaaggcagaccccaaagcacagcccccaaagccggccctcgtctctagggtaaccacaggttggagcccttctggggctctgctgccctccccttcactgggacccaaacactctagtgggttccgctccacgtcccaggttcgaacacaagctccccagggccacaagggggcgccccagacaccagcgaagccaagagggctgcaaggaaggggagggtcttccgcacgggccgcgcggctggggccatccagcacccattctggtcacgccacagtgggccctacacttagcagacgagtttgctcagggaggctgagaatgggtgctccaggggtcctcggccctagcagaggccccggaggcaggtggcctccacctcacagtgagaacctgaacacctggccaggtgcagccacgcccatccgggagggctgagagcagaacaggggccggccctctgggggcctggcccaggctccaaccccttcctagaccacacacagcagctgcaccttctggggctcgttcctccacgcggtccctcagctctttcccttctaggacagggcttctggcagtggccagatgacccaaatggggtggcagccccaggggccaccagacccgcttaacttctcggccatggtctgcagggacgtgacccaggcacgagcagccgcctctgcctcctagcccgcgtggggtagaggatcactcaagcccagggtacaggtgggaggactccgggtccgcaggctcagggtccctgcgaagaggcagcgggggcgcccgggcaagcctcagcccccgcgaggtgcacaatcccggcggcgggcggaggtcagggcgcgctttgtctgcgaggacccgacccgcggagcagcctcggccagacacgcggcgcagcctgggccagccgcgccccgccccagacaaagaactccaactcggggcaggtgagcgcggcgccgggaacccgggtggccgattccgcacctgggcgcagacaaaggcgcgcgccacccacaacgctcggccccgcctccacccccggaccccgggtgccctgacccgggcctgggaccctcggccgcgccgcacccccgcccgcccgccgccacgtgcgcccccgggaggacgcggtctccgcgcttggctccgggagaggcggtgtgggcagaaggcccggagatctcgggcgtcccgctcttctgggggggcggtcgctccccctcccctgtccccgcaaagtcccaattctctctctggagtccgcagcgcgcactcacctcgccggcgccccaggcagtcgccactagtcccggggccggagccgggctgcatggacgcgggcgtggagcgcgagccccgggtggccctggcccgtccaggcgacccctctccccgcgtgccctgctcagccggagctcgggccggggacgcgcatgtccgccgcgccggctctgcgcgctctgggcggcgctcggtgcgctctgggctcccgggcggacgtcgggcgcggcgcgggccccgaggcggcgggcgcggagctgggcgcgcgggaggcgggagcgcgggcggggcgggggcggggcgcgggcagacccgactaatccagccccgaggcgccgatccacccgcgcccgccgccggcccggggtccgaacgcgctgcctccgatcacggccacccggggaaaggcgcgcagcgccggcctcactgagcgctgtgtgggcgctgctcctctggtcctcacaacaagaagttacggacacctgccaccccgctcccagaaggggaaactgagtcagaaagggcgacagccgggcgcggtggccggcgcctgaaacagcactttgggaggccgaggtgggcggatcacttgagcccaggagttcgagaccagcctggccaacataggaagaccccccacccccgcccgtctctacaaaataaaaaaattagccggaggtggcggcacgcgcctgtggccccagctactggggaggctgaggtgggaggatcaattgagcccgggaggtggaggctgcagtgagccgagattgcaccactgcacttcagcgtaggtgacagagcgagacaaggtctcaaaaaaaggaaaaaagagcgacctcattgccactgtggagagttgggacctgaaaggaggagcccttcctccacccgtccgctgcaagccccgccctccctgggcctcggtttctccctctgtgaaacgggggtgcaaagtcggagacagctccgagcagctgctgtagctgcaaacggctgtgcagcgcagcccccaagaccaccgccctgaaccccgtgattttacacttgaggtggccgggagggacaggaagcacctggctctcccttacggtggggcgctagaactcggatcgaggcccagccacggcttcctgcaaaggctgcttatgtgcgcctgaccgcaccagacgcctgggcgggacccttccatcccagcgcccactcaggtggaaaaccaggacaccaactgcgaactcaaacgcgatgagtaagggagggagggcgcagctctggacccggcagtcgggaagtgtttaaggacgggtcctctccaagctgctgcgtggctggcagcacacagggaggccggctctggtgcggccagggacagagggcttcggctccagtttcgggactgaggtgggagctgtggccacgtttctatttctgggcttggaaggcctggccccgggcagggcctatccatggcggagcccgcagccattcaaaccgcgggagcagctcccacacgggttcgatggagccctctgcaagctggaccagcactttctgctcccaaaggcgccaacgttcgcaggatgcctccaacggtatagaaggaatcaccaaggtcggcctcagccagggagttccagccctcaggttctatttgaactacttaccaaatacacgtactccctttaccaacaagtcgcccccaaagccctgctgtttcctgccatgaaaacggcacgcgcttgcgtccatgcacacacactgtgtccacataggcacttccgggcgcactgcatgccgcaagccacagggccctgaagcctgtactctgaggacttggataagccaccactcgtctcaccgacgagaaaacagacgtgctgctggcgtggctgctctgtggcagagctgggctgggctgagccggcaggctggccgcagggctcatggctcagcagggacactcccctgggaaggtggtgggccactcctgagatggggatggggccgctccatttgaaatgcgtggagccctcagggataagtcagggttaaggtcaggcccagggtgctggcctgggcaaagccagccaggaggggccgtgaggacaaaggccgtgaaggggccctgtgacgaggtcatttctgtccatggggggtccagatggtgaggcccacagagagggaacgggcggggggaggggaggagagaagacagactcaggcagaaccctagctcagccccttcctgcgtgcctggccctgggaggatgccatccccagtcccctcttctgggccctgctctggggactcggcacagatggatccagtgcatcctcagccccctgagaagctgtgctgccatcagctccttctctgggtacagggcacgggaagcggctgcccagcaggcctcggtcccgccaagctgtgcccactctccctgctgactggagaccccagggggctggggagttgggggagcaggaagaaggaattgaggggcagcaactggccagctccaattgggctacggccagtctcaatgtggccggctcctctcttagggacctcaccactggaatcacaggagaagccatcttcctgccacaaacgaggcttccaaccccactttctaacctcagtcctgaggccgccttcagcactgaccatcctggaacaggcagagatcctggcctgggtcaacggggccgaaaacccagccccgagccccgagccccgccccacagccctgcgccccagtttgggggtgaaactagactcagaaccaggggcaggtctgtgttttgtttagaaaggagagtagctctgatatgaaagatgtagtgaggttagaagtctagaaggaagcggagtgggaatagattatccgggggaagaaaggcattcaccggagagcaggctgatattaagtatcaggcttccaggccaaatatacataatccagttagggacttgacggtggtgttcagaggcacatttatccggagcttacggttcagaaaccaacactgtaactgcgtctgccatcgttacgcagcgggtggccagggggtgccatcatgggaaggcatgggaaggtgctggaggccccaaccattaaccaggagtgcagagcacacagggtcctctcagccatgctgccccagccaccccaggacaccggatcgccctggaaaccaccctggggggcacccaacctccattcggccatggttagccgagcgctggggccaggagaccacaagactgcttcctcaatggctgccactccgcggggcacgtgtccttgaattggccgtgtcctctcacgcctggagaggaacctcccacgggacggtggttcgggccaccacaaggccctaaagaagagcgtcccacagtacagtgtatctgaagggtgtacacaccgaagccctggagaggagcgtcccaaaggaacaggggttggaggcagcatgaagccctggagaggagcgtcccacaggacaggggttggaggcagcatgaaggcctggagaggagcgtcccacaggacaggggttggggtgcagcacgaaggcctggagaggagcgtcccaacaggaggggggtgcgtggagggcggtgcagcacgaaggcctggagaggagcgtcccacaggacaggggttggaggcagcatgaaggcctggagaggagcgtcccacaggacgggggtgggtggaggggggtgcagcacgaaggcctggagaggagcgtcccacaggacagcggttggaggcagcatgaaggcctggagaggagcgtcccacaggaggggggtgggtggcgggggcagcaggaaggcctggagaggagcgtcccacaggacaggggttggggtgcagcacgaaggcctggagaggagcgtcccacaggacaggggttggggtgcagcacgaaggcctggagaggagcgtcccacaggacaggggttggggtgcagcacgaaggcctggagaggagcgtcccacaggacgaacactcagacgcacccagcaggcttgggccttgagtcgtggcgtggggggtagggcctgcacctgctgttgcccggcctgtgtaggccacagccacgctggcagtgtggctttgccatggaacgactctgaggttctgtctgtcgcagaggtgtgcactctctgagcaaggctgtggtgcataggtgaggggtaggccagacccccaaggcctgagggcagcatcagggggagcccggagaagcgtgtgttcaccatctccacccggaatgtcgggagaaaagcaaaagccagaaccacctatagggatgttcagatgctgctcagcatccctggaggctgccggcctggaaatgcaaatcctagcgaatttcagctcccagggaaagtgcagaaggcaccggaacttcgcggaaacacagaaacccagggaaagcctctgagaagagaggaccccaggggctgggggaagagcccagggatgctgtgcccgaggccctggatggcagcgcctcctgaaccccgaggccacaaccggccctgaaggctggtacacaggcacgagtgcctgcggggagaaaggtggggccgcctgcaggccccaagcccacacccatcctgaccctcagatggggccctcccaggttatccaggtggacctaaatccgaggactggcgtcattttgaggagaagagacacaaagacacacacagaggaggggccatgtgaggacggacaggggcagagataggagcaatgcaaccaccagccagggatgccggagtcagcaggagtgggaagaggcaggaaggatcctcctctggggcctctggagggagcatgaacccaacaccatgatgccagacttgtgggtgtggcccccacgctcacgctcgggtgaggcggctaccgtggcccccacgctcacgctcgggtggggcggctaccgtggaggccacgctcacgctcgggtggggcggctaccgtggaggccacgctcacgctcgggtggggcggctaccgtggaggccacgctcacgctcgggtggcgcggctaccgtggaggccacgctcacgctcgggtggggcggctaccgtggaggccacgctcacgctcgggtggggcggctaccgtggaggccacgctcacgctcgggtggggcggctaccgtggaggccacgggacaccagggccccatgctgcctgccagagaaagccgtgacccccctccagagataaccacagctacactcccacccgagggagagctgtgcccagcacaggtttaacgttcgtganatattaaatcacaggaaacacgtacctcccccaaatgcattgaattcagccatccncacagccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcagtcccagtttccccacgtacctttcggctcaaaatactccctgatctgctcatcccaacaggtcccagaagggagcagagccaacagccagcctgggaaggcgccaactcagacagaaactgatccaagccctcgtctctgttctcgcagacggcctgggaaaggaaacctgtccgaaacctgcctgcgagtcccatctgacagctgccaacggcagccaccctcctccctccctgaccacacggcctcttcccgacggtgacgctcaagctcctaccccacgccctgtgacttgccgacttgcccacctccccacctcccgcccacttccccattttcacacatgagggttctcccatcctcaggcctcagctcagatgtcctttccatggggcctgtgggaagcagccacctgcggccactctccctctcccagggcactggtcacttcctgaaacccgctcctggccctcgcccgtctccctccccaggctggaagttcccaggtcccaggccttgaatttccccaacagcccctgtggccctgcccacaacaggaaaccgcgggaaggcagcagagcccagggtgctcctgtgggatgcctgcctgacatcggggctcaggcagggaccctgataggctgcagcccctcagcagcctgcgtcctctgggcctgggggagccacgggtgtcaggagcctgcgggtggactctggacaggaacctggaattccctagttcctgggaggcagccaccagatgacagcgtaggcacgtccttgcccggcccctccagcacagcccccaaccccgagaggactgggcagatggccaagaaggggaaggtgccctcccccatcctgagcaggcggccatgaggccttggcagacctcccaccctggaactgggccgctggagcctggggtaagacatgtggaagggcctcggctcctcgtgcctggcactcaacacacctgagcacacctgcagacacctaggcacatcggcacacacctgggcacacctgcacacacctgggaacctctgcgcacacctgagcacacctgcacacactggagcacacctgcacacacctgggcatacctgcacacactggaacacacctatgcacacctgcacacacctgcaacgctcatcgtccctatgtgacctggagcaagttatctaacctcttggtgcctgagcttccttatctgtaaggtgatagtgatgatggccccccccccccagagagctgtcatgagaatgaaatgaggtgacgcccttacaggtgtgtaagggcgatacctggcacactgtggggccatctgagggttgctcatcatcccccatcccgggagcttgccaccgtgcccgggtgtgcagcccacagacagctgcagctgccatggtcacatgagatcacagagaggcaggtctgggaaggggctgccagccctggtctggtgagcggcaggtggagcgccagctgcaacgcggtggggagcagtggggggcgtggcacagcaggcaggagcccgcggggcgaggcggcggcccgcagacagctgcagctacttcctgactcgcagggtgtggactcagccttgctccaccttctgttcttttaaagaaaagctggggccgggcgcgatggctcacgcctataatcccagcactttgggaggccgaggagggcggatcacgaggtcaggagatcaagaccatcctggctaacacggtgaaacccccgtctctactaaaaatacaaataattagccgggcgtagtggcgggcgcctgtagtcccagctactcaggaggttgaggcaggagaatggcgtgaacctgggaggtggagcttacagtgagctgagatcgcgccactgcactccagcctgggcgacagagcgacactccgtctcaaaaaaaaaaaaaatagaaaaaagaaaagccggaagtctggatttgggggcaaaggtcccacatttagaaacaccatgctgttcagatttgcaacatacctgccgttggccacggcccaagagcccgggggtgacgtcgacctcagcactgaggtgggctctagagtgcacacctgcgctgcacgttctgtgagtgtgcacccgcctcccggcaggcctgggctcctcccacaggtcagaggctgcaaacgacaggatctgcctgagatggggctgccgtgagaaagatgtcttctctcttggatttagggtccaccgagagaggtggagaggaaatatcattccccggcctaaccatatgaggactgcagtgacggcccccgccagcacctgcccctcctgcgggcttggctccccggcaggcgctccccagatgcggcttggtccgtgctgaggatccagagacctaggtccagaggctcaagtttccaggtttggaactggcgtctactaatatggtagattgtgccaaaaatgcacacatggccgaaacaatattttcagtcctgcgtgttcttccagacctttgccttccccctcaacccccccgtggagaggagccccgctccccgctgcctgaatgcacggccttcatggcgggctggggaggagcacagggcagaaggctgcagccggcccacttggcctgctccgggctctgggctctgggctgggggctctgggctcttactcatggaaccagctgccaggctgtgtgggagcccagaccacacagaggagcccctgcaggtgtctggtcacagcctggccagggctcagccgacagccaccacgacccaccaggtgcctgagcgttgggcgaactcggcccccagcgtgtgggcagccccagctcctgccaagtgtagcagaaacaagccgtccgcagcaaacctgcccgagctgtggattcaggataaaaatcatccctggtgttgctgcaggtcacaaagtgtgggggtggtttctgggcagcagctggcgacgggggcaagtgcccagcacccagtgaccctgtgcagctcagcctcctcctggaactttcacgcctgtaaactggggaccatcaggggcccctctcttaggagcgttggagggttccgtgagtatgtacatacgtggtactgggtagaatggtgtccacccagaacctcaggctgcggcctcatctggaaacagggcctttgcaggtggagttggttaagatgaggcccagctgatgagggtagaccctaaatccaaacacaggcatccttataagaagagaaaacagagacaaggaggagacgcaagggaaggaggcagagactgcagcgctgcagccacagccagcacctgggtgccagcagaggccagaccgggtggcaggatcctcccctggagcctcggccccacgatgcctgactccagactcctggccccaggctgggagcacgcgttccgctgcgtttcgtcactagcgtgcagcagaggcctgtgagcattggccgctgcctgtcccgttccctcaagaacttgctactctagattctcagagggatggaaaagttaatttttaaattacaccgaaagaaaatcctcctgctgcaggcccgctacctcctaacgagactcctgggttggaatcttctagaaagcacgttctgtgctcagtagagatggtagtttctcatgggttttcctaaaattaggggcaccagagggggtgggacgtggggcccctgaccagccctgagcacacacagccacagctggtttctccaagatgcccagcacagaggcccaaagacagaaggccaaccacagggcacagctgtcctggaggcccccggcggctccgcagccctccctgcctgctgctggaggcccctagcagctccctggccctcccagagctgtcctggaagcccctggcagctccgtagccctcctggcctgctgctgggctgctgagggacctcagcattggctgcatttccaaaaccagcagctcagaggccctgcaggagacgctgccaagtggggccccgagagggactgggctgcagctgtttggagcctttcttccagtgcaccacctccgcatcttccctccacccccgcccctgccgtggggagccctgccgacggcgtttaactgactgtgtaaggctgggcctcttgccctcccactcctgtccagaacagtgaggacctgttccatccatcagaaaggcctccgcagaagccgcgagccgtgccttcgcgtgtgcacacctgagagctcacgcgtgtctgtgggtactcagggtgcgatgtgtacacagatctgaatgcagacgcacgtgcccatgagcacgcacgtccagagagacgcacgtctgcttatccacaaggtgcacgcgtgtctggatccgcacaggtgcgcgtctgctcgtggacacgcagaggcgggtggggctgtgcacgtatgcctgtctgcacaggaggctggaaacataaccgcatgtgacttgagggcctgtgtgtgatggtgtcggggtctgcggcgtgcctggtaggcatgtgtgtgtgtttgccaaggttacatgtgcctgtatgttcatgcttatcttggcgtgtctgcatgtttggtgtacagagtagatgtctgtgtgcatgtgtgcatatggtgggtgcagggaaagaatgtaagatcggggagctggaaaggacacgccctcgcctggccagccgaggatgcctgtccttggttgccatggcaagccctggcatctgcacgtggcctcggcacagcccctccccccgggtctgctcccagggccccaggcaggcgctgcttaccagggcaggtgcttcccccgcgggtgtggcaggctggggtgggagctcatgggcccctgcacctgcagagggtctccccatcaccctggtcaggtgctggagggacccctgagctgcccccgttgtcctggcctgggcagaggcagtggcaggcagacagccctgggcagggacacacctggaatcagaccaaggctgcggcacagcccagcaagcagggcgtcggcctgtggtttctgacttgagagtcactgggcgacagtatctccgaggccagagcagtccctggagatggaacgggcattctcccagggtgcccagagcccagggaaagacggggacggcagaaggaactgcaggtggcgcccacaggtgcgcagctgagaccccatcaccacatcccggggccgtcaggcatgagttgaccctgaggtgacgtcggcgccatgcctggggtgacatcggcaccatgcctggggtcaccagggccgtgctgagccaaagcgccctggcagctggctgcgaagctcgtgcacccacgggtgcagccacggggctggttctgacccaggccacgcccgcccactctgcagcctccgtcctcattggtacaacaggggcaacggggctcagtttgcgtgtcctgttccagaaagttctagagatggcctgtgccctgttgctgctgtcactgttgctgctgtttcatctacactgaagatctgctgtgagtgtagccgccttcatccgtgatctcagctggatcttccatcggggagctggacgtgctgcctcacctgcacttctgtgtgatggaggtggcttctgtccctaaacctcaggaagccacctctgccagctgccagcttttcttctggagcttcctcacctctctcagcctccacagaattgaggagagttacagccttggtctggatccggctgtggcttgaggagacgtcgtggctggtttgatcttctatccgaccgccaccacgttttccacattggcaacagccttttcgcttccttcccaatcgtgtgtccactggagtagcacttacactttccttcaaggacttttcctttatactcaaaacttggctaactcttttgcacaagaggcctggctttccgtctgtccagattttggcatgcccttctcaccaggcttagccattcctaacttctgatttgaaggagagacctgcaacccttcctaccatttgaacatccgaggccactggagggtatcacgtggcctgacttcagtgctctgtgtctcagggactagacaggcctgaggagagggagagggatggggaagctgctggtcggtggagcagtcggaacacacaacatggatggattaagcttcctgtcttatatggggacagtttgtggtgccccaaaacaatgatcatactaatatcaaaactcactgatcacagatcaccgaacagatataataaagatggaaatgttctggccgggcgcagtgcctcacgcctgtaatcccagcactttgggaggccgaggtgggcggatctcatgagctcaggagttcgagaccagcctggccaacacggtgaaaccctgtctctactagaaacacaaaaattagccaggcggggtggtgggtgcctgtaatcccagttacttgggaggctgaggcaggagaatcacttgaacccgggaggcagaggttgcagtgagctgagatcgcgccaccgcactccagcctgggcaccaagaccgaaactccgtctcaaaaaaaaaaaaaagaaaaggaacatgtttgaaactgcaagagctaccaaatcatgacccgtggcgacgtgagcactggctgttggaaaagtggcatcgacagacttgctccacgaggcggccgcacccccagtgtgtgaaacacccacaggtgactgcagtgagcgaggctggcctatgagcccgccaggtggaagtcagcatttttctctcttaaaggggctgtgtggattccagcacgttacagtcaaggcagccaggcccccagcttcactgcggtaggagcggagggtcggctcagagtgggccccgtttactgaccccgtgctgtggctctgcagacacagcccgagcccccagcgccagcccaaggcaagccccatcctcggggtccccttcctgcgctcagcccagcccctcacctgttgcagcagagagtttaccaccccggtgagcggtgccagcatctcccagccttcacgacatcacggcctggacacgtgacctcgctggtgggagccggcatccgtcatcatcgtcctgattgtagggccccggcaagtagcggcctctccggagaacacagacgagcaccatgcagagaagtgtcgtggtttcactcaccctcacatgcccacggagaagcaagactccaccttggtcccaaaggagagagaacctgaccccaaaggagggagagaccctgagcctgaaggagagagagaccctgagctcgaaggagggaaagaccctgagcccgaaggagagagagaccctgagtccgaaggagagagagaccctgagcccgaaggagggaaagaacctgagcccgaaggagagagagaccctcagccggaaggagggaaagaccctgagcccgaaagagacagagaccctgagcccgaaggagagagagaccctgaccccgaaggagaaggagagaccctgagcccaaaggagagagagaccctgaccccgaaggagaaggagagaccctgagcccaacggagagagagaccctgagcccgaaggagaaggagagaccctgagcccgaaggagagagagaccctcagcctgaaggagggaaagaccctgagcccaaaagagacagacaccctgagcccgaaggagaaggagagagagacctgagcctgaaggagaaggagagagagaccctgagcccgaaggagaaggagagagagaccctgagcccgaaggggagagagagcctgagcccgaaggagaaggagagagagaccctgagcctgaaggagagagagaccctgagcccgaaggggagagagaccctgagcccacctgtccccccggcccgccaggctccctcctgaatcgaagggctctgctcctgccccgaaggagaaggagagaccctgagcccgaaggggagagagagcctgagcccacctgtccctccggcccgccaggctccctcctgaatcgaagggctctgctcccgccccccaacccccactggctcccctgcaccctctgctcgggggcagcagagccggcttagaggcacctggcttcagccccagggctttggggtaagaacacaatgagactgggtaattctcacagaaacttacttctcacagtgctgggggctgaaagtccaaggccaaggcacccgcatttggtgagggctgctctctacccaagacggtgcctggcgtgcagtgtcccctggagggagaaatgcgggtcctcaggaggcaatggcgggagggacagacccccgataaggctctttctgggggcactaatcccataaggaggggccctcaggccagtcaccacttcacaccatcacatcggcaaacgcaggttcctggcttatttccttctccccagactccacccccgacctcacacagagcgggaactcagtaggtatctgtcaaatgaataaacagaagaaaggaatgtggggggtgggagggaagcactggagaggaggggagagaggatggaggggagagaagaaggaagggagggaggagggaggggagagacgaaggaagggaggggagggaggaaggagggagagaggaaggaagggagggaggagggaggggagagaggacagaggaaaaaggaaggcagggaggagggagggagagagggagggaggaggaagggggcaagcgctcagtggtgaacggcagacgggtagtggctggccaggcctgcccaacacagggttgggttgttcctggggccggggacccaaggcttatgcaatcaggagccaggctttgtgggtgcaggagccggagagcagcccccagccacacacctcaggctcggtggacatctgggaggggtgcctgggccggtgcaggcgagcactgcgctgcccctgtggcccctgagccagggctgaggctgagcgggtgctgcctgcctgcctgccctctcagcctgggtctgggagatccacaaccacaatgggggttctctgaagctcaggctggaagagacgccacgtggaggaaagcggaggaaacagaattcccagagacggagctggagcctgaacaacctccaactgcagcctgggaatcaagggccaggtccctcctccagcgctgtgttgatcatgctggtgcctgaacaacctccaactgcagcctgggaatcaagggccaggtccctcctccagggctgcgttgatcatcacggaaagttgtgcagccaggggaggaggctatgtggccccacgccccaccgcacgctcccaccgccagcttctctctggagctctgcaaggatgggctatgatcacccgtgatactgatctgccgtgtttcgtgtttaaattgctgagctgcagcgtggcttcgtgggggctggcaggaagctgggacaccgcagatgtggaacaaagcaagaggccgctcgagggtcgtcgggaaaacagttagaaccaatgaatgcttgtcaccttcacactgcctcccaccacggcagggtccatggccacagccagcgtttgcgagaccccaggcctgcggacggtggggctcccggggtctgaagggttgggggccaagcactagcaagagtcaggagatttctggagactgaggttgaggtcatcgaggacacctctgtttgcccctctttcaagtaaatgaccccatccccccagcggagggcaggaacccagtcctcgggttggggctcaggatcacttccaaaggtatccctgtttcctgcacagccacaggccctagagtagagctgggagggctccagggtgggtgatggggcacgtgacaccagtaccgctatgcgtccggcccacccgagcctccgtgctgtgcaaggagcgggctgcaccccagagctccccggtggcttcggggcggcgggcaggcgggcgggcggtctgacgaggcctcatgtgtcccactctctccctgcgcgggagccacgtgtgcagcagccactgcgtctctcgacagcccctgagggctcggggccgccgccccgtgagggaggcgaggatgtcctgcctggtggcctccggggcccctcggccctgcccatgcctctgggaacatctgtctgccgatgttcatgtcaatggcttcctgctggtgcccttggtgactgagaacaccactgggtctccaacgctgactgaaggcagccatgaggctggaggtgatgaagctgcaggcaagagggcctcatgcagctccgtatcctagaaaccaacacccactccgcccgtcacccccaagccacctgctcaccccacaccaccatggtccacagtactcacaccatcactggccccagtggcagcaccgccagacacaacaccaccgcccgccccagaccagccccacagcacccccggccctaccaccatccctgccgccaacacggccccgctgccggccggcttgtctttgccaccgacaggctgagcatgagcccccacgtggggcctggcccagtgttggggaacccagagtgaagttgacagccaggggccctgctcaggcagtttctggtccagggacggtgagaggcagcgacagatcagcacacacgtgtggcctcgccggggccggctgtggatcgcatgaggcctggtgcaaaaccaacgggcagggccctcgttctaaaagcagaaaacggcgtgatcacaggaactgcgttccttccttccttttttttttctctttttgtgacagggtctccctctgtcacccaggctgcagtgcagcagcacaatctcagccagaagggggagaaaccacagtgagctcgagctccacaggctgcaacaggcgcaaggctgggtccatctccgctatccacagacctaggaggagacgccgcggttcctgagtctgaactggaggtaacaatattcctgctctgaggagctcccggagctgctccggaaatggagaaggtggctggaactctgtcgtctgaaagcgagagctcacagtataatatacgagcaaaaaatataaaactatggcctatcacttccagacatgggagatccaacctcgttctccatccccatcctcccccatggtggaggctcgcaaggccctgaggctcgccaggatctccagatttggggaaggtgaaagccgtctttaccctcctctacctcgaactggaccgcctgacatctcaagccaggaaccaccgcgcaggggcggtcatggcgagggactcacagcctgggggacgcacaccgcattttttaatggctctagttttatcaaaagtaaacatccatgtggcttaaaaagccagttttacggccaggcgtgtggctcacgcctgtaatcccagcactttgggaggccgaggcagggggatcacttgaggtcaggagttcgagaccagtctggccaacacagtgatgtagcaggacaagccgcagacaaaactcctcagacactgagttaaagaaggaaggggtttattcggctgggggcgtcagcaagactcctgtctcaagagctgagctccccgagtgagcaattcctgtcccttttaagggctcacaactctaagggggtgtgcatgagagggtcgtgatcgattgagcaagcagtgggtacgtgactgggggctgcatgctccggtagttagaacagaacagaacaggacagggattgtcacagtgcttttccatacaatgtctgtaatctatagataacataaccgattaggtcaggggtcaatctttaactacgaggcccaggacacggcgccgggctgtctgcttgtggatttcatttctgccttttagttttttttttttctttctttggaggcagaaatcgggcataagacaatatgaggagtggtctcctcccttagtgaaaccccgtctctactaaaaatacaaaaattagccgggtgtggtggcaggtgcctgtaatcccagctactcgggaggctgaggcaggagaatcacttgaacccaggaggcagaggttacaatgagctgagattacaccactgcactccagcctgggcaacagagcgagactctgtctcaaaaacaaaaatgccagttttacaaggctgctacaaacaagagcggccccaccttctcatccatcgttctccctggagacagccccgtttagacttctctcccctgattcccgaaacgcagccccgggtctctgcatgacaagcagggcttgctgctccccggctgtgtagcactaacgttgtcttccgacttcgaactgtgaagcaaggattcctctctggtctcccccaccataacccaccccacgtggaatctgaggccatgttaaacatgcagattccctggctctgccggtcttgggcaggcggtcctaacacacacaaggctctgtggtaagggccagggccccagagtagggggtccctcaggggctctgagctgcggctccaacagaacctctgtccgctccgctccctgcaaggggcctccggcccttgttctgctcatccggaccacagacctcttctcgttcctggggaaggacagttggcctccggcctggagctctgtctttagttttttagcctcaaatctgccagcttcaggtttggggactctgctgaggcagactcgggggtggcttgaccctgccagcgagtgggttgagggcgtgtcaggagccgggtgtgggttgagagcacgttcggcgccaggcacaggggcttcggtcggcttatgtgctcttcccgggagctcctcagagcaggaatgttgttatgtccatttcagattcaggaaccgcgacatctcctcctaggtccatggagaacagagatggacccagccttgcacctgttccagcctccagagctcgagcttgccgtggctcctctgcctgtcttcagatgggaagagctgggcactggcctctaccaatccctccccactcagccatccgtctgagtccagtgccatgggccctggcattcagccatgtgtccaggttcagtgccacgggtcctggcgtcagcagctccggctctgccagaggccagtggaggcaccctggttcccacgccctccctgctcctgccatgcgtccggtcacagcaggtttgcggtcaccctctgggtccctaccccggccacccactcgtctggtcagagcaggtttgcggtcaccctctgggtcccaaccccggccacccactcctcaggcttcgctctcctaggggaggctcccagatcactgggtcttcctcacctgcctcggtggaatcccggctgttcgcagccgcactggatgaagctctcgtctcctctctggttcctcacaggtgtcggtggacttcggggaaggcaggtgcagcctcctgcgttggctccatcgcctctggccaaggccatggcacacactctgcccgcgttcctctgcactcccaggaaggcgatgcccccggccccagcctcggagaagtggacacgaagccccacttgctttgtggccggttccattttaatttggtctcaacggagtagaaaatgggagagagccggcgcgtgctccagacagaaatcagccaacgagcccatgagaccccaagtcactgaatccccccacactctggcgtctctgaacaacccgcaaggacgtcggtgccacggctgctctggggtctacagtgcacgtccccgtggacccccggctcctgcaggtgaaacccaccactccacggtgatacaagaaccttcccacgtccccatgtctctctgcatggcctgggcaccatggctgccacactctatgcgtgttttaaaacccacagtgcaggccgggcgcagtggctcatgcctgtaatcccagcactttgggaggccgaggcgggcggatcacaaggtcaggagatcgagaccatcttggctaacatggtgaaaccccatctctactagaaatacaaaaaattagctggtgtggtggcgggcgcctgtagtcccagctactcgggaggctgaggcaggagaatggcgtgaacccgggaggtgaagcttgcagtgagccgagatcgcgccactgcactccagcctgggggacagagcaagactccgccccgaaaaaaaaaaaacccacagtgcactgtgaatattttgtttaaacagtcaattaccttcgacggatacttcatccatttgtcaaatctcaggtatctaattcaccacgccgtggctgttccgggggctccgcgtctgtcgtcccacatctgcgctgctcctgccgggaggacacgcccgtgccccacagcgggtccgctcaccactgctctttcaggcattacctccggagacactcgttccacctttgtctctgagagatgttcttgctgacaggtttcttcttacgacgctgcccttgcgtgggttcactcgcgttgctcctcaggagaaatgagagcgtgtgttttcctccggtgacctggaaagggaccttctgtggctggccgggcactctggcttccatgggcctctgtcccatttcttcgcctttcatgtccttgaggcttgttgagcttctatcatctgtgagttcacagttggcgtcagatttggaaattttggagtcatgattttttcatatcttttcagtgtctccatggtcggctcttcttcagggacccccatacgtattacggttgtgcgtggggtactcttacactcacgggggtgccgggcccctggaacctgcaactcacgcaggatgctcttttaacttactctattatgtttcctgttttatacggtgctgtatcgttggctctgtctttaagatcattcaccttttcctccatgtgtggtctgtgaaccccatccattgtagccttgatttctagaagtttggtttgcatatttttaaatggtctatgtttctacttagctctttcaacacagggaatgcagtcaggatgactgtcagtgtctgtctggcgattctaacacttgtgttagttctgaccaggatttcgcagtggatttttcctccccttacgggtgggttttcctgcttccccgaatgtaatctttgaatcgatggcagacattgttaacatcgcctttgttgggtgtggatgtttgtgtttatgtggaaacattcctgcacctttttctggcgtgcggttcagttacatggaaaaggtttggcctctcaggtcttattttaaagtggccgtcagggccgaatgttctgcccattttgtccacactaattatccctctttggggagcaagacccttgtgagatgccaccgccaccctcgggaggcctccaggctgggggacgggcactgtgggctgctggtgtagggccggacgctctctgacagtgttgcccctggcctccggcggcttcctcccaagctgggttggggctcttctgaacgctcccctccatgccctgtcctgggaactttaaccctctgggcctcccggagccctctgtctcccctgtcccagggggtctgctgggctccaccgggccccgccctgaatgcagcctggagcaacgctggaggccggggctaggaaactgtgagccccgccttgtctgtgtctttctcagggattctcgtcctttccaacctggtgcccgatgtccggaagcacctcttctgtgttttcaaatgggagagcgaatccagtccttttcactccattttggccagaaacagaagtcctccgtgatttatatttttactagaatcttttaaaggggcacaaatgggggtgttttgcaggcatacagaagcccccgtcactcctcccgccttgtctctgaaccgctgtggggtggggaggggtctcttctctctccaacccacatcactttcaccccccgccggccaaggctgcgtttccctcgcccccaccccagtcccccgcgttggtagtgggatcggtttggtattctgaggcttctctcatttctcctttatcaccatctgccccacagcaggcaggcccggagcctctgcagaagggggaaccgggtgcaggcccaacgccggtctctcagtgtggcagccttgcgcgcgagcagaagcagaaggcctagttcctactctgcagccttggctgccgggcacggagaacgttttagcagaaacacctctgcaaaaccacttcctggcccgggcccagccaaacaccatcttctcctccaccccagggctccgcccccatctccaggctcagcccagcacccccacccccgaaacccccagccccactgcatctgccctggccatctgcctccgccctgcctcgctaacacagttattaatgagcaattttcctgtaattacaacgcagttatgccagttaccccgacctgctgacagagagcattcacttccatgtggcactagcccccaggcctgagaggacgcaaacacttgcccctcattcgctgcccccacccccactctgccagccagcaccaccctccacccactctaggcccttaagaaaggagggaagggccgcggggaggagctctcagatcccgaggccccactccccctgcaaggaaggctgtgagctcggccccagcccacctgccagctccccaaacacctcccacctccctccgccgcctcctgaagggactacactcccctggctcctccaaaatccgctaatgaacagcaggcgcagaggctccgccaccggcgtgctcctggcctcagccctccctgttctgaaaccgcctttgctaagacggtagtagtgaggaatcacgacagtggcagaggccaacctgacccgctccacctgcctccaccccaacccgcccggctgcttcctgagcgtgggccaaactaactttgacaggaacttagtttacagtttaagttgggaacaaaaaggataacagcccctccccaaaacagattccctcctcgcttggggggaccagtcccgttgtaaaaccgacaaataacagcaggattaggaattccggctcaggattcacgcagccagacgccacaggactcctccccagccgctcctgtatatgacgtcaccgccgtaagaccacaggacaccgccccagccgcgcctgtagatgacgtcaccatcgtaagaccacaggacccttcccagccgctcctgtatatgacgtcaccgccgtaagaccacaagtcaccgccccagccgctcctgtagatgacgtcaccacagtaagaccacaggataccgccccagccgcgcctgtagatgacgtcaccatcgtaggcccacaggacccttcccagccgctcctgtggatgacgtcaccgccgtaggacctaagattgatgctggagaggttcttcagaccctgcgttctgacggctccgctggcaccacccagacgggtaaactagctcttccggtctgtggccctcacaggaaccgactcggtgcaggaggacagcttcagcccctgtgatttcatccccgaccaaccagccagcactccccactccctagccccctgcctgccaaactatcttttaaaaaactccagtttccaaattttcagggaggctgatttgagtaataataaaactccagtctcctgctagctggctctggatgcactagactctattgcaattctcctgtcctgataaatcggctgtcaggcaagaagaacccgttgggtggttacagtttcaaggctatattcagagaactatccactaataaaatctctgtttatgcagtaggtcccaccccacaccctccctgctcaaactgctgcaatcccggcacagctttgttgacaatgtacccatcagccaacaaaatgtaacaaaatgcactttcttttagttatctcctgctacgtaataaacttccccgggaggtggaggttgccatgagccgagattgcaccattgcactccagcctgggcaacaagagcaagactccgtctcaaaaataaataaataaataaataaataagcctccccggagcttgatggcctaaatagcaatctaccgtgagtgctcagggctctggagttgactgggctgcgctgggtgcttcctgcctagggtctccagtgtggttgcagcaaatgcaggctggagctgtccagcatctctttctgagtagcctctccacgctcagcttggaccccctcacagcatggctgccagggtcatcaagcttcttggcaggcagctggcctcccctaggacaaatcccacaaagctgaggcaggagttccagggctactaagacgccgtctcagagtcacagtctgccacctccagctcatgccactggctacacaggcccagagtccgtgcgtctggggaggcaccatcctgagaagccatcttacgagtgagaagtgggtgccaggaaatggggtgccaccatgattagcaccccaaatatgtgctgtcacctttggagtcacgcagaacctgggggcctccaggagtctacgggggatggtgggaaggctggggaggaggatgggaaggagacccccgctgagggcaggcggagcgctggggtggcaccacctctggctgcggggaaggtcgtggccctgcgaggacctgtctagacagaggctgaagttgggggcggggaggtggggggcaggcacgtgaggagccgttgagtttgcagaatctggaggaatcaagagggcccaggacagtcttttaagccagtaccaggttctcaaagtgagaaatggcctctggcctaagggtgaagacctcaaaggcgtggctgaagcagctttattgagatttgcaagattcacaagctatcttttagactcgatacagtcaggcctctgggaacctcgagggcgcccttccgcagcctcctgggtctcagcccaaggagacaagagcttgccccagcgagcaggtgtgggttaactcagtcacgcccgcaggagacacacagggtttctgcagagagctctgttgtggaagtgccgtcagagagaggcggctcggtgtggaaacaggcctctttatgctcaggaggcaggctgagaagctgcccggccacaagcacaggccacctcttgcagaagagggaccttaactctgacctcagccaagagcccaggagacacagcctggggtcacaaagagtcagctcctaggagcaggcggtgctcacctagaagctgctggtgtggacctggctggagctcaggtttctgccaaccgtgtctgctcctcctgtccctgctgtttgaacgggggtgtcggcgtgttcgtcccgcccctgccttgtcatcgcatattgggtctagggccccagagaagtgcacgcctgtgatcccaggcttcttagttcagttcctcagatggagatgtgggtgagagacgctgagggcctcctccccagccctcgttctgatatgatcaaggactccaagcctgggcctgaggatgcagcggaatgagaggccgaggtctctggagattgagtgtgctttcacgtggagctaagggtcactgagtgagagggtggccgccccttgtgctggcttctcccttgatgaatctggactggccccgagctacagactgaatcatcccaaactgggagacttacacaagcctccctccggcttccaaagttcccttggcttgaggataacttgggcaatctccccttggggagggggcgcaagtccagaatggcctcatctttgctcatcacatctgcgacacggccctatttctaaataagctcaccctctgatgaccctatttcattcttttgagacggagtcccgctctgtcacccaggctggagtgcagtggtgcgatctcggctcactgcaggctccgcttcccgggttcaagccattctcctgcctcagcctcctgagtagctgggactacaggcgcgtgccaccacgcccggctaattttttctaatttttagtagacacggggtttcactgtgttagccaggatggtctcgatctcctgaccttgtgatatgcccgcctcggcctcccaaagtgctgggattacaggtgtgagccactgcacccgcccttttttttttttttttgagacggagtcttgctctgttgcccatgctggagtgcagtggcacaatctcggctcactgcaacctctgcctcccaggctcaagcgattctcctgtctcagcctcctgagtagcttgaattacaggcacatgccaccacacccagctaattttcgtatttttagtagagatggggtttcaccatgttggccaggctggtttcgaactcctgacctcaggtgatccgcctgcctcggtctcccaaagtgctgggattacaggcgtgagccaccgcacctggctgaaaaatttatttttttaaaaagagagaagtgcttaggaaattcaataaacttaccttttttttttctttcaaaaattgccccgcttggagcatgctttgaaagtcacaaataaaggctgttatgtcgtggcattcaaccatttttgtctgaaaagcaacttccaaaaatcagctgtagattcattgtgtttctttctaaaaatgaagtgttgtaattaacactacccagtttcataaataaacaaaacatattttcttgcattctagtttcgggtttcaggatgaaacctccatcgatatctctagttccttcaagtctgctgaaatgtcaccttccctgcggcaagcatattttaggtaaggcgtaaatgcagcctgcccctcccggcaccccacttccccttgacttatttgagtgatgtgtttacctgtgatgaccgcggctcatatctccccaccaacctccgggggccccaggagggcagagagcatgtgctgtgttcactgttgctttgaaagtgcttagaactgtgtctggtacatagtaaatgttcaattaaatttttttttttacagtttcacttttcacacttaagcgtttaatccacttgcagtatagtcatccctcgatatcctcgggattggtttcaggaccgcccttggatcctgaaatcagcaggttcccaaggccctggtataaagtggcctggtatttgcatagagcctacccaccttctcccaatactttcagtcatctctggatgatttgtaatacctaatgccatgtaaatgcatcccctggcgttcccggatacctgcctgcatcacacagtccctgcctgtccatctcgcagctttacagcccaggaaggcccaggcccggctcctcccgacctctcccgaagtccctttcccccagccttggtcccagaaacaaccagctcgaggtgggggcagtgaacgctcagggtggagttgcaggctaagccctcctaagctgccagggagaagcgcttttctgccagcagctctgcggaggaaaattgatttccttggtaatgaagtgttaacccgctgggggtgctcggagccgcgccaggcaggcgggaggccccagtttgcacaggcagtcttcccagacatgtctcagagtcctcgtcccaagctgcctggggccccgggtgggcctggagtgaccaagggcacacagacctgcttgcggggtgagctgagccggcagggcccagctccccaggccgggaggctccatcacctcgtaatcatctggtggtctggtgcctgccggtccaggagagtcgcacacacagtaaaatcctccaaaatcaaacacagctgcttttgctcctcctggaaaggcaatgagaagccccagaggaggttaatgaagtgccttggagccctcggccttagcctgcagctgctgattttccaagcagggccatctgaatgggggaggcttctcccagggtccctgggctgatgtaggggctcagccatctcagtccctgaggctggacccctccttgatgagggtcatggtccgacagggagggccaggcagcatcagcgcaggtgtggccactccctccctcccctcctcctctgctggccccatggcagccccccaggagctacacagccttgaatcccctcagggaggcccccaaggcccgtttggggagctgcccacgcggagcccagcacgcccgcccggcttctgcagggaggggcccatctcttcctggctgtgctgggttttccagtgcaggccagaggggaaactcccatgatcgagcccagctgagccccctgctccagccctggggggccgaggaagagcaggttctgagaccccgaccagctcagggcatccaggaggggccagggcaccctctgtgcggctggggtgtcctcccagtctcccctcctgctgtcactggcccgcgaggcatctggagggcccacacctgccagtgacccctctggggggttgtcccaggctgcgctgacttcctttctgtggcgcgggtgacacagacggcgactctccagggcggggcaggggctggcagggccgccgggtgttccctgaccctggaggcttcggggagggaggggaggacgccaagcaggggcgggagcttagagtcccccccacagctcatcaggccacgcgagtcctgcagggtggtctgggatggcccctcaccctctgacgtcctcttgggctgggccagtgaggagcagccacaggaaggcggagggtcgggggtggaggttggaaggcagagggcggagggcgggcgggggcatccattctcccgaacaggggtcttgctgcgcgactcttccatctcacgctgccggacctgtctcttccccgccgtccacgctggggacggttttagtgatttccccgggttctgtgccctaaatcctgccacacttcagccacatccccctcattactcctaatttggattcccaggtggaggggccagcccaccctggctgcagtgggagggcagcccctgagtgcacagcctgtggcccacagaggacggggtctgcgctctgaggagggttcccggcccgcatcggtcaaggcagagatgaggaggaggccatgaggctggcgtggtgtggccacagcccagctagaggggagggcatttgcacgggatccagtggtgtttccccaaattcgcatccactgaaacctcggaacgtggcctctgcaggtgtgatgtgaagtgaggatgaggtcatcttggattggggtgggccctaaatccaatgactggtgtcataagagaggagagacagatacacacagagaggggatgaccgtgaagagggaggcagaaacgcacacagatacacacatactcagggaagaggaacaacaggccagaggggccgtcaaaccctctcgggggtttgaactccacctacggcgtgtttcagtcttaaaatgtccatgattcttttgtcacgatttccaattctctgatgaaattctccctcttacatattgtcttgaatacaccgatgctgctgttttaaactcccgtcgctgctgcgtctgtttctattgactttcctctgctgctgctgctggccttattacctggtcctgtcacccccatgcctggatatttttgattgaatgcttggcgttgtgaatacacatttacagtgggcttgggtgatgttgtcttcctctggagatgagttgcttttctttaggatggtagttagggttaggggtcgactgccatgaccccatcagggccgggaccactggaggccgccagtctccacgagggcgggaactggaggccgccggtctgcatgaggctgctctcctctggtccccctcactcccaggctgcggcattcaagggcatcaacagaaagcctgatgcaagttcttccctcccagctctgactgccaggaaacctgaggctgcctcagggaaatgaggtctcctcctcctccttggggccgtcacccctcaagtcccagctgccttggttactctctggcacctttgaactgccacctgttcctctggcccagctttgaaagcaactcccaggagcaggtgtgcttggaccctgcggccctgcggacagacccctcactgacctccccttcattaatcccatccaaacgaggccacgttctgagttcatcctggtgaatttcggggacactcttcaacccagtgcgccgtcccccacagagcaagccaacatcctgatggggcagcctttgccactttgcccccgctggccccatcacactgccccccagccaccacacctcccggaggggcctcacacgctgcagccctccatcctcaggcctggcgttggctgctccttggcttgtgtgcccctccctgcaccccaatatgccaggatctccccgcacctcctcattctaccatcacctcacggagacatcctggtcaccccgtgaggcattgctcacgccctccccggcactccacagccttgaagggcactgaccgccagtgcctccacccactgtgcctcctgcccagactgcaaccccccaagccagggctcgtctccggttcacggctgtgtcccacatgtctgtggtgcctcccagctccagggaggtctgggtcctgtcggggggtggggggcagcctccgtggccaagggtctcccaggctgctgtcaggccaggctcgccagccgggctcctgatcaccttcctgggccagcctctccaggaacccaggagccagagggcggctgatgtaactgaattccagaatccgtcatgagccgggaagtgagtgcctgcggtttgtggggctgaggtgaccggccaacgcctttggggctttgttactcctcacacggggaggttgattggagccaggagccctgcagtggctccaggcctgctgctccaattaacctccctggccctggggagccgggccttagggctggggctggagggctgctggcatcggtgcccgggctcagcctgcaggtggcaggccctgaggtggaggggagcatcccgcagccctgccgctccctctgggtgcttggcctgcaccctgccaaggaaactagctagttaaccatcccaagtgcatcccaggggctgggcagagcacagcaggcttggtcagcagtgatggggtggagagatgcctgctcggagccagggacacaagacagctgtggccgactctgccccccacccccagcccgggcctcctgggaaggccgtgtctgagttcatgggccagaagaagagagatggatggagtcaggcggaacagctcttggcgccaaggagacagccagtcttaggtcctgaggagggacagttaggggttagggttaggtgtgattggtggtgggggtgaggggcgtgggtgttgttaggattagggttaggggtagatgtgatgggtgttggcgggtgagcggggagagagttaggtttagggttagcgctaggattagggttggagtagatgtgatgggtgttgggggtgagggggcggggcatgttaggattagggttggggtagatgttatgggtgtgggccttgagggaacgggcctgttaggtttagggttggagtagatgtgatgggtgttgggggtgagggcgcagtggtgtcaggtttagggttagtgctgggattagggttggggtagatgtgatgagtgttggggtgtggtcgcaggaggatttggcttttattctgggggaggtgctgcactgggctgcacagggtaccagcaccggcctcctctgaccagatgctatttagacccctcccccaacccctgtgtccttggagcccctccctctgcccagcgtccctccctgagtttgctcttctctgtggtaagagtgagggctgcctttggcttccaggcaggcagcttggagggtgggcagggtgaggaagtgggttctgcatctcccggggagtctgaggccagaggcagctctgagcagcccggccgtgcagggggcagctgggggaggctgcggccaccccagggctctcctccatgctaagccagcaactggaaggccaggggtagccggttgcagatggggtgggagccagggtgaccagccacccgtgttccccaagacgaagtgggccgtgggggtcccaggtaaacatgggggaatctgtcaccctctgagagcagagtccagtggggacgatgcaggtctgggcacgacctctgggaggggcagcaggtcagggggacccctggtttccaaggagcagacactgccaggggagaggaagctgttgaccctggtcagaggcccaggctgaggagagtggggtcagggccaccaggaacagccgggggcagtagctccaacctcacagcagcacctggacagacaccgactggggaccacagaaaggtctaggatccatgagttatgcctgccaacagcagaccctgtgtatgtgtgcatgtgaacgtgtgtgaacatgtatgtggatgtgtgtgcgtgtggacatatgtgtgtgcatgtggatgtgtgtgcgtgtgttgtgtctgcatgtgtgtgtgacttgtgtgtgtgtgcatgtgtgtgcatgtgaacgtgtgtgtgaacatggatgtgtgcatgtgggcgtgtgtatgcaagtggatgcgtgtgcatgtggatgtgtgtgtgcatgtgtgtgcgtatgtgtgtggacgtgtgtgatgcgtgtggatatgtatgcatgtgcattgcgtcagtgcatttggacgtgtgtgtgaacttgtgtgtgtgtgcgtgtgtgtgcatgtgaacgtgtgtgtgtgaacatggatgtgtgcatgtggacgtgtgcgtgtggtgtgtctgcatgtgtgtgtggacttgtgtgtgtgtgcgtctgtgcatgtgaacgtgtgtgtgcatgtgaacatggatgtgtgcatgtgggcatgtgtatgcaagtggatgcatgtgcatgtggatgtgtgtgtgcatgtgtgtgcgtatgtgtgtgtggacgtgtgtgatgcatgtggatatgtatgcatgtgcattgcagcagtgcatttggacgtgtgtgtgtggatgtgtgtgcgcgtgtgtgcatgtgaacgtgtgtgtgaacatggatgtgtgcatgtggacgtgtgcgtgtggtgtctgcatgtgtgtgtggacgtgtgtgatgcgtgtggatatgtatgcatgtgcattgcatcagtgcatttggacgtgtgtgtgtggacgtgtgtgatgcgtgtggatatgtatgcatgtgcattgccgcagtgcatttggacgtgtgtgtgtggatgtgtgtgcgcttgtgtgcctgtgggcgcgtgtgtgtgaacacgggtgtgagtgggtgtgcacgaatctgtgtgtgtgtgtatgaacatggagctcagtgcggggtctgcttcccctccagtcagagctgccctggcatctggctttgaccttaggatggggcatgacctcgggaggccgtccactctcccttcgtgccgtggaagccctggggactcagggctgcgtgagaggaaccgtgcggcagccggcaacagctcccaatgtgtgagtgaggccaggtgagacctccgcccagctgagcagctgatgaccgacacagaggtgacccggggagctcagcagaggggcctagacagcaactccctgcacctgaggctcacagaccctcggcaagcacaggtgttcacagtctcacagcagaagtgaggttcagacgctggaccccagcgcactcatctgccagagaagaggtcagggccccacagggcgaggggtccatgggggcgagaggcctggtgtggctgagggtcctgtggagcagagtgaggagacagctcctgccctcaccccaggctgagcaggaccacctggccggggggtgtggagctcctggtgctgggtgctgtccccaggacttgatgaggctgagtcgtgccccagaccagtctcatcccggccccagcacccaagaaggtgcctctgcgtggagaagggagctcgtgctggatggaggtcagacgtggccgccgtgctaatccccagagcctgcgcctgtgtcgggttaccgggcgggggagttaaggctgcagatggaaaaactgctaatcagctgaccttaaaacacaattacccggattatccgtgggcccagtgcaatcacaagggtcctcgaatggggaggaggaggcaggagacgaggccgggagacgctgcagggagtctctgcggccgccgaggctctgaagacggagggagggcctggcccggacgggccactcctggggctgacgaggcaggcggcgggtcctccccaggccccagcagaaccggccttgctcgccccacactgggcttccaacctccagagctgcgagatgataaatctgtgcggcgttgcggtcacttgctccggcagccacaggaagctctcacatggtgaggcgtcgggagagagggctccgttggcttccacgccccccagtccttgggctcgaacgggcgggggagtgggtgggtgggtgggtggacgggcgggcaggtgggtggatgggcgggtgagtggctgggtgggcgggcggccaggtgagtggatggctgggtgggtgggtggctgcggcagtggatggctgccatacccagtcacgcccccccgtatcgccccatttgcccaatatgcatccgcccgcggacgtataaatcccgccccattcgcggccgggtgagagatgcccccccccgcgcgatccatatttcatgcccccccggtcggtcttccccccgccccgcgccgccgcgggagtgaagggacaccgcaggcgggggcggggcgttaccacccgccccgtatccattgtcccccaccccataaaagaaatagtcccgccccccccgcaggagagacggagcgattgagggccgaccgccgggcgatagagcctacctgccgaccccgcgcgcgccgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacactgctttttgtctatactatggcctcttcctttataggtttacaaaccttccatttttttttttttttggcttcttaagggaaaaccttaagattctagacctttcttcttttcccatataagcacaagctagttttcctttaaggattgctttagctgcatcccataaattttgacgtagtattccttattttctagtgaaattcaggtcagagattcaggaggtggaagctaaggacctgcctggctgggtgtgctgggtgggaggacaggggagtgaggagaggagaatgactgtcaacttctagcccagtcatctgggtggttccaggttcacccactgaaatggggaaagacagaagctggtgtgtctggtttgtctgtgccaagtgaggggtgcatcctgggtctcggcaggacactctggcctgatgcatgaggtctggcctcaaaccatagagccgatgaggtagaggatgaggagacagacagcaggcgcctgggaacagcatgggcatgagataagcactcacagagggtatattgttctggaccccccacacctccctgctgtcagccttgtggttattgggcgcagaagctgccagtctaaactcaagtgttgtaaatgtaaaacacctgctggctttcccagactctacaaaaaaaagagtaaaaaagatgtgacaatttttatatagattacattgttgaaatactattttcaaagtacatggagtgaaacgcaatacttcattaaaatgaattttacttatttcttcttaactctatatgtggctcacataacactcctattaaacagtgctgccctaggagagtccagggccctacccacccctgctggatgagaagctgcactctgccaggtcccagggtacaccagggagccctctaggtcgtgtaccggccctaggagaggcttcgtgccaaatccctgcaccatggccgggactgtggctcagcatgaaaacccttcttcctcggagtccccccacagctttgcaccgtggccgggcctgtggctcagcatggaaacccttccccctcggggtctccccacagctttgtgaactgctagggatgtcccctatcactgcagcttctggccggaggaggatggccggtggcctcggcctggtcaatgccagtccagctcagtctggtactgcggtcctgggccacctgggaagacgccagggaggccagagagatcctgggtcaggccgcagccctgctcagatccctccgaggccccaggactccccctggacttctgggcggccctgggtctcccttgggcacctgcgggtagtcctgccttctggcctctgaacatccaggtgcccccccagccccccactcatgccctctgtgtctttgccctcaccacagtcgcccagcatgctatcccagcctgtctccccacacacggaggagccgagccctgacgcgagaacagaggcggagctcatcgtcctcagtgcccagacaaggatcccgaatgagcaaacggggaaggcccaggaggtggtgtttccaacacgcagggcagggcctgggggagggactgtggctattcacctgcagtgaggggtccagagagacggggccctcggacgagggtctgcaggcagatgcccacacaccaggcgtggatgctgggccaggtgccgggagcccacccacgctcacacccctccctccctgggggctgctcagcgatggctcatggacttggcctgacctggggaggacccaagggccttagagctccaggcccctcgtggggttggccccaccgccacagtctcagtgtcacccatcttccaggaatccaccccgacctccccttctcctcccccaacaacaaaccaaccactgccctcgtctgccgtgggctctgcaggaacacgcctcggcctctcccagaaggctcacgccctccccataaccccttctgcagatgggaggggaccagcctgcctgtgccaacaacaacaaggtgggcagaggcccccacagaggtgaccagagggctgatggtcactaaagcactgcacgcaggccccagtctccagaggggttcctgaggcagcaacagggtctctgtagtcgggcagcgggcagcctcccccagatccccactgtcaccccccggaagacacctccatcctcaaccttcaggctgggctgcccccaccccctctacagcagccaggacacaagcccatcttcctgggcaggcgcagccccactgagtaccaaccccttccagaaacaagggaacaagccatgttccaaccaggcctcaggctccaatctgctgcctgtgatgggagccaaatcccacttgccggaggcctcgcaggcccacagctgcatcttctggtcagcaaagtgagtcataaaaattagaattgaccaccaacatttcaacattgccaaatccagagaaacctggattcccagctcttcagaaacatcaaagatctggccacacgaaatctgcatttcccagggcgacgcctggcagcagtgtccccaccagggcgcgggccccaggacacaacatggatgtccagcaccatagcgccctggtgtctctgccctccccatggcggcaccccgaccgcaagccagtgcagacagtgggttcgagctggaggctgcagggtcatggccaggcctcgagagcccctctgggtcctgaatgtttcctccacgggtgtcctctgcacccccagctgttggccacagggacccaggctgcagtttccagctctcctcagccctccctggcagcctggccttccccattaaggggcagccaagtgccactgctcagctccagcatggatggcccctccccactccctcagcccgttcaggcctgccccagacatggctctactcactcggccccctctgtactcacaggagcccgggggtaggggcaggggcctgaaagtggaaagagggcaggagactgtttaaatcatcactgttccccacgcctgacaacagggacgtctgaaggcaacttcagcccctctgcggggcaatggcttgtgtgggtgactctgagatggcaccgccctccaagcccgcaccccaagtgtgccaggtccagcctggagctcagccagggcgctgcagccaggactcggcccctccatgccccggccttccgtgagcagaacacaagcacctgacaggctgtgcagaggatgctgggctgaaccatgctccctcacgcgtgcccaggccatgcagaggactctgagctgaaccaccctccctcaccagtccccaggacactgatcccggggatgggtgccccccaggcatgagccgagaggggggtctcgacccctgtcacactggcccacacagtagccttgcggtggggggatctggaggccggtgcccccatgctgagcacagtacaaacccccattccaggcctcagatgggtgggcaggaaggtcaggaacagatgctccaggtctcccctctgttcggtcagagtgcaatgaatcccgagccaagcccagcacaaaagccctttgtgggaataaatcacgtaagacacatgctcgtctgtttaaattacaaacgctgatgctgttataaaaaatagtggcacggcactttttattttctttaatcagaaaaataagccctgcgcttctgggatggaggccccaggtgagcaccggaggaaggggcccgggtgggtggggagcgagggggcccggaggccaaagcagatgctgcaccagaggctggtcaggacccgggagggcctgcgggggtggggtcctcatgagcaagtgcggggtgctggaggtcagcagctgcctggcctgggagccagggacacccatccccttcctgacacctgaggcagcccagctgggcaagaccaggcctgcaggaccagagcctcctgtcacgtggcgcaggggtccaggtggtcaacgctgctctctggaggaccactggttagagcctgcccagctcccctgaggtctggagacagtcaaagcccccccaaacaccccctcccttttgggcgagtggcgtgccttggactccagaagactcgagtggggctgccttgagaccaggtcctgagggggtggcaacacctgaccacaggtgggggccgtggaaggggcagggatgggcccaggggtagccttgtagtgtgaggtgtgcccgacacatgtaggtcaacagccagacgggacgctgcaggggactgtggggaagccgggagaaggcgctgccaccctgtggggtccccctcgcctggagaccctgcaggcaacccttcagtgcatgcccacgggggtggtggaggcagagtcctgagaggtgggggtgggagcctccgggtcccctgcaggtcctgacccaccagatgggcccatgtgccccctgtagcttgggggccctggaggtggacaccagcacctcctgactaccagggggagggcctggactgaaacccacaccttcaccattcgccactgggccactctgcaggaactgcagcaccccacagatccttcatgcccagcacgccactcactctcacaccctctcgcacacatgcacacacagcacgcacacaccaggctcacgcgctccgcacaggtggcacgccaggggcaagcgtgcacgtagactcagagatgcaaggacagtattggcaattcagaggcacagaaagacgctgaggggcccccagcaaggtccccgccctcaggggctgtgttcccctcccagggcacgcacaccacaggcagcaacgcgggtgggggcactgtgacgccagtggggggagagggagcatggcggggcggcaggcagacgcgggttcatctctcttcctggtgtggtgagcctcagcctgatcgtggcactgtaggggctcccgcctctggccgagcctcaatttccaacgacaaacagctcagccctgtctagacaaggcctcaggctagtccggcaaagcatctccagcccgaagggcaatgcggccttggcccttggggccctgccagggtgcagatcacactggagtgggctggaaaacccatatggggaggtgcctgcaggcatcaggctccagggctcacagatggggcctgacgggccatcccgggggcacaggatcgggtccaccgggaccgcaggggccggcagggatggcccagggccaggagcgagagccggggctgacgggccggcaccagatccaatagggaccgccgcggctggcacaggagccccaggagaggccggcagggtgggcccggctgccccaggagtgaagggcgatcgggaatggggagcaacggctggggtttgcagggcttgttggggcccatgagcggccgcaggggctggcagggctgctctgggcccatgagcggccgcttgggtgggcagggctgctccgggcccatgagcggctgcttctgctgcctcggccgtcccgggcccaggagtgaaggcgtgagtgggccgggctgctctggggcttccactaaccgctggggctgcctggggcgcagcagcgaccgccgggggcggctgggctggcccagcagggaccttcggggctggccgtactgacacggggctaggaaggcccgccgggggcagcagcactgtcctgggaggaagctggcgggccgtcggcgtggtcggagggtgaggagtggccgcgggggctggtaccgctggcactgggctagcagcgaccacaggggccggctgcgctgtcctgaggatgccctaccgggctggccacagtgacacgggctggcccacggccgcaggggtcggcagcggtgccacagggtcagcagggaccgcaggcgcctgcagcggtgccttggggccaggaggaaccgcaggcgccggcagtagaggcaggggaccaggagggaccgtggggccaggagggaccgcaggcgccggcagtggtgacacggggtcagcagggaccgcaggcgcctgcagcactgcctggggcctgggagtgcccaatgcggccggcagggctgggccgggcgtgaccgctggggctggcagagctgatctggggatggaaggagccgctggggccggcagggctgaccggggcccagaagtgaccgccggggctggcagggctgtttcaggcccagaagtgaccgctggggccagctgcgctgacccaggagtggccgctgggagggctggcagggctgcccagggtccgggagtgccgacggggctgggagggacccctggggctggctggactggctgggctggagctgttgctggcgctgggccgggccgttctggtcccagtggctggctgggagcggccccccttctggggagcacacctgcatggaagaaagagcacgtgtccacctgggcaggtgtcaccgcccgcggaacccccgtccagcccgggcccaggaggcatgctgcccttctccagcagcccaattcccaagggggccgaggagagccgaggacaccgcgcagagccccaccctggaaggaaggcgcacaccagcggacccccgcggaggaagcagctgcaggctgagctgcacccaggacagagccccacgcgctggggaagcccccacctgctctgacagcccctcctgggcaggaggcccctgggcagggcaggcagagccctgttcccagctgggccacgcacctgaccactgaccacagtcacgtgcctgcagccactgccgggaccaagtattcccttccccacgccgcacacgtgagcggatggcgctgcgtgtggacaggacagccctcggcaatgagcctggaccccctccttatagacactctggacacctgtagtcggcggagcctgatggacacggcagggaaacggggccggcctatcagcttggcgccccagcccggaacgcgcgccttgctgccccagacaggcacctctcctgctgtggccctgggcacgtcacggcccctccgtgacccagccggctcctgcctctgctaggccccagccctgtccacgtgtcctgcaccccaagcctgacaacgatgggcgcgctgccaggcaggcccgggggccacgtggcgtggtgtccaggtgctggcatggccctggggcggtgagcactgacccgccgcagagcttccggtcggggagggacctgctcacctgcttggagggctgcagtgggacctttctcgccccatcgcaggcgggttcgaggtcctgcccggggctgcctgcctccaggggccgcctgttctcactgggctccgcaggggggcaggtttccgactcccggggcttcttgatgagacgacgctcccacttctccttccgctcatgtggcttcagggccatatccttctgcagggagacagggaaacgccagttaattggcgggaccccagggccttgggcccaggacagcacccacctgagcagctcttgggaaggagcctccccacttgggaggggcacctcagagggaaaggaagatggctgctgtgggacgggggatgggaggggaaggacgatggcaggtgagatgctgctgcgggatgggggatgggagtttcccagggctcagccatcgaaggggccagacgagaaaaagcttagtccagcagggagtctccagtaagcttcacaggaggccagcccagggctgcccaggactgcccctccctgctgagaccagggctacctttcaagagcgagtgccctgcagtgggggccagggaccacaggagcctctccaggggacacccaggccccacaagaagtgctcccccaggtgacagcccacaggaagtgctcccccaggtgacaccatattccagagggcctgaggggttctggccagtgctcccagacgggtctgtggatttgggacagagatgcttccccgtgttcacctttgggctaccagaccctggggacacccccaggccccctgtaaacctgctggcctcccctggtcccctctcgtcccatctcgactccttcagagcaccttctagcctgcggacagccccaggacactccagcctccgccctgccggtggacatcgggcagccccaggttctggggtccccacctccacactcgataaaccactagtaagcaccttctgtatgctggctcagctcctggcaccagggctggtgcagacagatacggcgcgtcaagtttagggtccagaggagccagccggccagggagaagcgtccacgaaaggacagaatcctctcggggagggcacagctgtgaggaaaacagcagcagtgaagcccaggacagaacccatgtcagagctgctgccaagaaccctgggaagccactggggaggatccgcccccacggagggccacagtgtccccgaggaggacccgcccccgcatagagccatggtgtccctggggagaaggaccttggctgtccctccggtaagggcagacgacagagacaagagccatggtggtgccggccacgccctctccggctgggcgcccgccccatgacacaagcgccacccccaccagtctgagctggaggccctgagaggcccagcagcgtttccgggccccctgcccacgagggctgatcctgtcactccaactctttgctgtttccggctccaggaagactccttgcctccccgaggcccagctcccgccatatgctctctgcagagccaccactcaaggcccagagccctgctgtgagcggcctgctcctgcacaagcccgagagcccatggcctccagagttcctgctcgcccacccaggatctgtcagggctgcccatcccaggcagctgtggacgcaatctgctaacactgcagaaacggttcccagtgagctctgagggtctcagcctggatgaatcaaaggctgcagcccagagaacggctgtttgcagcgctggatcaaaagcaggaacaaatcaaggtgttacctttcacagtaactaggaaacctgcaagggcagcctgccacgcagggcaccactgtgctgggatttgtctttctactgggcaaagagtcagaggggacaggcagagggcagatctgaggaggcgggaccgggtggtaccctcggggcacagacgctcccccaggcccgctccacacctctccccattgccacagtgctcacagctggccagaaggacgcatgtgtcaagggcaaattgtttaaatttaccacattttctgtaaacctgctctagtgttactctgctttcaaaaaaatataaagatttctgccggcccctcctcccatccacagacccaccctccagctccctccccaccccggccacagtcacaccaagcacaaggcagtttcctgtcccgtctgacccccaccagaatgtccatctgtcctgccccctgctcagccccagacagggctcacaagtgctgctgagtgaacattctagagaacagacagcatggggtgggtgcccacaccgaggaggagaggcctccgacatctccggctccaggcgcagcccctgtgcccacacacccccagccagcactgcagccacgctcactgcagagaacagaggccattcccaggaagctctgggagggctgtcccagcactctgctcttgagatgccagccagcgcttcgcctgctaccttaagacggtgggaaaggtacccaggcctgggagagccgtgcggctggcccctctgctggtcactccggggctttccagggtaaggctggccctgtgggcttcgcctggcaggtttcagaggccccacagcaacgccacagcactgccctgcccagctgctgagagaggcacgaccaaggaggcccaggcaggggcccttgccagccccaccgctgcacccaacaccccactctgcccagtcgctcagtcactccacgtacacctgaggggttggtggtgcagctcagagaccatacagcgtcccgtccaaggccaccatgacaggcagcagcgtggtcacccccgctcctgtgaggaccagagttccccttggggcagaccacgggtgggggtggggccgggacaggagtccaggccagacggggggcagtccccagggactgagggacagtgcgtgccctgggcagccccagtgtcctcatttgtaagctaggcaacagccccaccccatgggcggtgccaaccaccacaccccaaggatgcctgggctccgtggaaggaagggcccagaaggttcgcatggggaagtgacatgagctccgggtgggggccctgcaccaagccaaggagaccagcagcggccgcgctcacccacttcatcgtgttcaccgcagtgaggtctgtgccaggtgctctgctaagtggtgggtcaggccccgcttatctttttgtttttgagatgaagtctcactgtgctgcccaggctggagtgcagtggcacaatcttggctcactgcaacttctgcatcccgggtttaagcaattctcctgcctcagcctcctgagcagctgggattacaggtcaccacgcccagctaatttttttgtgtttttactagagacagaatttcaccatgttggccaggctggtctcaaactcctgacctcaggtgatccgcccacctcagccccccagagtgctgggattacaggcgtgagccaccgtgcctggcctgggccccgcttatctaatccacacaaacaggaccccatgagttggtcgcagtgaccaccccagtgtcgaatgaagacacaagagacacagagaggcctggaaaggctccaggagctgtccccagcaccacccaccacccagcccagccctggggtgccagccagggccgcctcaggccactgtcccagctgcaggaacccctgctaggctgaggcagcggaggccttgaacccccccacaggtgtgcagtgcacacctgggtcagcacccgtggcaccacacctgcgcacacaggggccctccaagaaggcgcggtggaggccctccctgcgcaacgccactgccctgcagtggcgccagcacccccagtagtggctagggccccagacctccctgctcctctcccaggaggaccaccagggctgggcgcaggctgccgtgacattgctagacagattttcctgtagcaattctatgcgactgcttttggctctcttaatgtcattaccatacagcaccaataacattcctaatcacgctacagtgaaccagacacggagagataaaataattctacctcagcacacacagagccctgctgcccctctttgggacggggctgcctgtttgcaccaaggcctggcccaccccctgcagccaggtggccacgccctgctcctgaaaccacagcaagggcctctcccctccttggcaccaggcaggaggctctggagaaccacctacccaagacctcacctccctggcaggcccctctgcttcccacctagagtgatgaccatgttcccctgggcaaagtcaggcctggaacccccagggatcttctcagatgggtcagaagctgctctccatgggggcagggggctgagggagcccccaggggtcttctcggatgggttggaagctgctctccagtgggggcaggaggctgagggaggctgcagctgcttggctcccagaaccttgttggctcacaccttcgtcaggcttgtctctgtcattccaagagctcaggcccaaagcccagagcctctgactctcaactgtgttcagtctgtgtgcaaaccccacagctctccctgcagagcacctgaaaatctgctcagcacccagctggcatggctgcctcccatacccgggacctgtggtggcctgtgccccgacatcctctctgccttgggtcaaaagctgaacagaaactggcacaggagacctacagggaggcccaccccatggccccgtgtggggactgggtctaattacccctcagctgcgaaggtgggaacgggaccctttcccaccatgacccatctcccccatggctcacactcacctggtgggcgacagcccccacatctccccccgcccagggcgtcccatgtccaatgtcgccttggccggttttttctgatggggaccccacatcacgcacccacagaaactgccccggcaagcctcactgacacctcacttgttccagaggcctccaggtcgtgcccagctgctcctatggcctccaggatgtggtcctgcgggcttgcggctctcgcctagcaacggaccagcagctgggagctgggctgcccctgcaggaccaccaaaagcatggtggctgctgcctctcggggctggctgacattcccaagcacccagtgagggcatgtggctgcactctaggggcaaggaggtagggtcagggctcctggggggtggggtgggaggcggggcactgtgaggcccagcttggccgttactgctgcactccaccccttgggagctatggaggctgtggcctggccctgtgcgggccgggaagagctacctgcagacaagtcggagacccagaccattggtgacggtgtcatggagaacagcagtgctgcctgggatggagtggtgccaggacgggtgtgaatgcagggggcacggcaggtggacaggagagggcggggacaggagagggtgagaacaggagggggcggggacaggagagggtgaggacaggagggggcggggacaggagggggcggggacaggagagggcagggacggtagggggcggggacaggagggggcggggacaggcaggcatggggatagcgggctcgaggcctgaagcagggaggtgggggatggtgtaaggggcaggctggtgtgaggactgcagtggagctactgcttggccctggttttatcccagggttccagtccagccacgcctggagaaccgtctgataggggctgagcctggagggtgaaagaggctgcccagtcaccctctgaccagcccgactgggaggccactgtcacgtgccaggcctggaggtcagtcctgctgtgcactcggacgttcctccctccagctccgatttactggaagaccacggatcacacctggctgtggcccgcagtctcacccttcaaaccaaaggccttccgcaggattcctctgggtggccataagggccgggggtggagggctgaggtggcaccagggaagatggcccagggcggcagtttgccaggagggaggtgacaaagggctggagcctgccccggccaccagtggggtctgccaaggattctagaagggcccccagaaggacggaccacaccattgctggcaggtgggggaaagcaggcagctgccccctctgtccctaaggaaatgcggggctgccgcaggttggggcatgaggacgcatcaggatggtggtcaacacactgagtgggacgcatcactcagacccgggaggtcacctcttcaaaaccaacatatgtcccgtccatgcactctctgtacaaacagacttcctcacaataacgaaaagaataaaaggaaaggcaagtcatttggatttagatttagaggaagacaacagaaagaagccaggtgctggagacaccgggcaggtgaggctgtccccaaaggggggacgcagggcaggaccctgtgagcagagatctgggcagtcgaaggaaggagaggagccacgggcctgggtgtcctgctccccgccagctcctgctcagccgccctgcatgctgggccctgctgtgtggccagcgctgctgggacgaggaatccaccactggggtcccaccctctccagaggcccctgtcctggcccctcccctcactggcccctgcacaggaatgggccgtgcatttgctcacggcagcccctctcactcctgtccaaggccttgggccccgagcggaaggcaggctcaggcttcatttccatggcccacactggcccctgtgaactcatgacagcagtgagggcacccagcgcaccaaccactggggctgggctttgtcagcccacactggtctctgaggctcctggccctgggagcccctcccccggccatcacccctgctgacagctgccactggcgatcccacgcagcagcctgggacacacagagcctcttcctcagccatggggagggcggcccgggcccacgctagccaggtgtcgctaaagccacaggcctggggcgcgaggaccacaggggcagccgccgctcggccccagctttatcccggaattctagtccagctgtgcccacagaactgacgacccctggggctaggggctggtaggggctgggctcccagagtgaacaggaccacgaggccgacccacttctgacctcagggccccagggagcagagttgcagggggaccaatgtagcccccacccagtccagtccacgtcaggggcccggtccacatcagggtcccctccctggcagtggctgcaggccccttgggctccttccccgcccagctcctggccacatggtccctggggagaggcacgcagccacgccggccacaggacagggtgtgaggggcaggcgagtgaggcatgggatgagggtctggccgaggacagccagaggcctgctggggtatgagcagcagcaactggggcaggggccaagggctgtgggggacactgcggcaggagaggttagagagggtggggctgtggcagggcctgagctccctgtgaggacacagactgttccaggctggacggagtctgcagggcctgggctccctgtaagggtgtgaatgggctgtcccgggctggacggagtctgcagggcctgggatccctgtaagggtgtgaatgggctgtcccgggctggatggagtctgcagggccctgggctcccaggcaggacagcagctggatgaggtcggattcaggaaactatggactgggtgggtggaggggccaggacaggggatggcaacagggccaggactccccggaggctggtctggacacacagcaggaccggctggccctatgggggacagaggacagggagcagagaggccggccccatgagcccaggccagagaggggcagccccagcctccagcccttgcctgagttctgatcctgctcagccactcgccagcagtgtagacacgggaagtgactgcacggctctgtgcgtcaggttcctcatgtgcagcatggggacagcacagcacccacagtgggggtgtaagcctgggacacactcggctgctctgctccctaaagccgccagccaggaccaagttctcaacagagggaaggtggcggccacagactgggcaggtgtccctctggcctcagtggggcagggtcacggcgtgcggctcccagccccagacgcttgatggctcccgcagagtctagagggcagtgccggcgcctcctgagccagacaccacggattccggccagagggtcccgggtgcacgtacatggtacacacgtgggccgggaagacgggcgtggagaccttcacacctgtctgggctgcggagagcccagtagcccacccagcctcctccctgacgccagcacagctctggggaaccccatccaccccacaggccagctcacaaaccagatcagcacagctctgctgcgccaacggagctggggctcagaggccgttctgtccctcacactcctgaggacgcctgccgtcctccacaggtacgtggaaccaagtaccccatttgccctgagtccccagagcacctgatctcacggagtttaggtgctgcgcagcgccccaccccccagccctgcagccccccagccacagcccccagctgtctccagcctgcctgccaccggcaccccaaacctgtaccacctgctacatgtgcccttcctgacgggctctcgggaaccgccacgccacggtgctgcccctcacagcctgcactcttccccagaagccctcgtggcctcctctgtgactcctagccttcgacgacagactctttactgccatcccaatactcactggcaatggggcctgtgggtgtatcttgggggccggcccagggcctggcacacagccggtgctcaataaatgcttataaagtctgtcagggaaagcagaacagctcagaacccttccctgctggccagcggctcacctggcctctcccagaggtccagcaccactgctgcccagcaccacccctgcctggctggcccttccctgctggccagcggctcacctggcctctcccagaggtccagcaccacccctgcccggcaccacccctgcccggcaccatccctgcctggccggccctggaggctccactgtgcagcatcaagacctgggcagagcagagatctggaatgggcggggcggctgccgaggccggatgaggcccaccagtccccagggaccagtctggccacccaagctcctggaggccttgcagagcactgtcccagggacagcagaggtggcaggtacccttggtcacatacacaggcagaagggccccagcctgccgtggtgagagcagaggaagcccgctgagcagacgggagcatgggcaggtggccacgggacctggctggggttgtcggcctctctgcccagcccccagtggggtgagtaccatggccaagcctcagtttccacgcatcacacagggtagctgcagctgcgcctccagctgtcctggcccacggggacaccagcacctgatggctcttcagcctctgacctccctcccctagaataggttggtggccacccaagcacagccccacccagctctgcaaggcccacgcagggccgcctgctgaccaggatggggggccctgtgcagtagcacctcaagggccccggcacctcccaaagctcccaggggatctggacattccaggctgtagagcaggagaacccagacttccatgacccacatccccacatgggggtggtgggggcagcccaggacaggtgtgtggggatggcccatcctcctcatttccctggagggtctgtaggatgagagtggagggctaggggccgggaggggtcggcagccacagatccactctgctgcggtcctcgacagcctgtagctcagcctccagccgggattggccagaaggtgtctgacaggcaggtagctgctgcggcgcctctgcaagggtggctgggggcctgtgggtcccgcaggcctccccactggaacattccgactgctgtcacatcccaacacagcccccggccccatgcccccgacacaggcctcactgtgagcgaggggcccggagagagacccacacccacacagggggcacgtagctgtggggcttgacagatctggacggccggctttccctgccagccacctccccaggctcccaaagaaacagcaggcaccctccccagaggccctgtgggccagctctcccggggtgcagccagccaggctgtgacgggccccccagctctcccaggggtgcaggccaggctcagcaatgggcctcccagctgctgccacacgaccacttcagatgccatacactcctggggtggggccggggaggacaccaggcccgaggggtctctaggggaggcacatgcgtggcacaaacacacacatcgcacgccacaagccctggccctccctcagggacctgggggctgcttacatgctcacccttctttagggacaaatggctttgtcatgggccacatggcgggagtcagggcctgaccccgggccactaagaagggttagatccccagcccggggttgcctcagcaggtgtgaggcggcgccctaggggtcccgaggcccagagcctggattctagcctggggccactcactcagctcatctggacaggggcaggaggcctgggggcactgaagggtggtcaggcccgtgggctcctgaaagcaggagctgaggccagagggggtcctggtgccatctgggtaggggagtatggagggggagtccggagggagggggcagcctgggacacaggggtcactcagggactcctggagactcaggtgggctgggctcctcccgtggctgcctctgactcagggcagccagactgggtctgccctgggaccttgggccagctctgtggtcctcctacttagagggccctcctgagccagccaggccaccccgggctcctctcccccagcctccactcctagcgaggtggtcccatgacctctccctcattacccgtgtccccaccccaaaccatgctgacttggggtctctaactggtcaccagtaaatgggctggagtgctgggacccgagtattctgtccaggtgctgagaaagtgataaattcttatgccattttgacgttacagaaaaaaatgaaaagttcccaaccaaaatgcagcaaaaccagcggaagcaagactaccagactaactttactagaaacagggtggcaaaaatccgaaccgtcggcaaacaacccgaaatgagactccaccaacacggcccgccagggccacgtccggagttcacggacagcctgacagcaacacaggacaccgcagggcctgggaaggaagcgcggggcagcggcacaagctgggtgagcagggccacccctacccgatgctggaccagagacgcgccccgcgcacacaggacaccgcagggcctgggaaggaagcgcggggcggcggcacaagctgggtgagcagggtcacccctacctgatgctggaccagagatgcgtcccgtgcaagacagagcgcccatcagaatgtggggaaacagggaaggagggagggacacagatacccacaaacagcaacaccaatcctcacgctctggacacactcacaaatccagcgcagccgcagggaagcagcaacgtcacagccatgtgcagacgccagcagggccaatgacaaccccctaagagtcccctagaaactgcctgtgctgaggagggaatccaacaaagtacccaggtagagatgtcaggtgggaagacaaacagcaacaaccagccagaaaacacagtgaaacgaggcttccagagtgacaaaaacacaagcccgggtaaatacgcaacacgggcccctcggcagggaacagaccctcacaaccatcaggagccttaaaactgccagccacagacagcagggccagttctgggcacttctctttctccagagaagcaatcacacaaaggcgggatatggcggacgtctggcgacagacctccccgtaaggacagctggggcacgagagcctagtggggaaggagggtctagtgtgggtctgactccctgctgcaggactgtgcggtgactcacaggaccccggagacccctccaggcaaagggcagccgcaaccagcccccaaacgcgaaggtcgcagcacgtgcggaggtgcaggcacgcgcgtagccacggcaaggacaggaaggccttggaaacctgagccaagaactgacaggcccaagcagccgggagggaggggatggggaagagggccggtgactcctgctgtaacagccccgaccccgaggccagcaagccactgggcaggggcccgtgaggggcagaagcacaggcagaggacgtggaacccttcccagagccaaagcaggccaggtgcaagccctgctccagccatggcagggcctgaggagctgctggcccccatgacnagggcctggacaggtggcgggcacctancgtggaccgaggggccagcgacgctgctttcagggcctctgagtccacctccccggagggagcagcccttgcccacagctgtgggactctgtgggaggaacaggaatccatgcagcttccaggcagcccnttcattgtacatcagggcaggccctcgncttaaagtccagcacaccctgctctccnatgaacatgtcgggtnaaagacnacnttctgcatgcaaccatatctctctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagaaattcagaaattaatgaggcaggccaggtgcggtggctcacgcctgtaatcccagcactttgggaccccaaggagggtggatcacttgaggtcaggagttcaagaccagcctggccaacatggtgaaacccgtctctactaaaaatacaaaaaattagccaggcacggtggcgcacacctgtagtcccagctgcttgggaggctgaggcatgccaatcacttgaacccaggaggtggaggttgcagtgagctgagatcacgccactgcactccagcctgggcaacagagtgagactccgtctcaaaaaaaaaaaaaaaaaaaaaattaataaggtaggaaacagacaatagaggaaatgaacaatgccaaaaggtgttttcaaagttgagaaatccctagctagatcaatcagaaaaaaaaaacccaaattatgaatattaggaacaaaaggggaaatatcattacaggcactatagacacgaaaaaggtgaaatggggacaattttattccaacaaattcaacagcttaggtgaagtgggcaaactacttggaaaacaaaactgacacaagatgaaatagataatccgaatagtcttttttttttttttttgagatggagtcttgctctatcacccaggctggagcgcagtggcacaatgttgcgcaagctctgcctcccgggttcaagcagttctcctgcctcagcttcctgagtagctgggatcacaggcaagtgccaccacgcccagctaatttttgtatttttagtagagataggtttcaccatgttggccaggctggtcttgaactcctgacctcaggtgatccacccacctcggcctcccaaagtgctgggaacaggcgtgaacctccacgcccggcttagataatctgaagagtcttacatctgttagatggagtttctggatgtccacgttttctgtcttcagtgccacctcccccagcctgctcagcaccctgtcgccagcctagcctaacacttgaagtcttttctgatcgtaccaggcacatttccaccagttaacatgcatcagcttgtttaactgcaaccctgtaactattcccatttgccggatgaggatgctgaagaaaaaaagccgcctgtaaataacttgcacaaggttcacacagtgagcagctggaccaggattcaagcccagcggcttggctttgttgtggaatctgtaccctgggccattacctggagggcagctttctgggcctcagttttcctgtctgtaaaactggggatgttactaaatagttcatttgttttcgggttgttgagatgataaaatgagctaacatgcaaggtttgtactgtctacatagctgccatgatgatatcgattcctgcttttattattatgaattctcagagtaatttctcccgcctcctgggcccagcctggctggtttgaggcccagacgctagaggcttatctttgtcccggttgccaggcaagggtcctcctgtgcagggcctgtggagagaggcactcagttaatcagtgccttagacactgggcctgggcctgccacctgcagggagcagcaggctgggtcacagggtcctagagcttcctcccacctgacagggccctcctacaaaccaagagttggtccaggggaaggggccactcaggagggctgggggccacgccggccagggtgctgttaggtgggagtggaagaggaaggctgagcacctgggcctagcaggcactgctccccacagcctggggctagccgttccggggcgagcatggccacctctgctttcccagcctcactctggtcgggaaggctcttccgactggcatccattttgtacttttggtcattccgcccctgttctgggcctggggctgcagtgacaaacaagacaagtgaccgtgctgccctcgagaagttaaactataactgggacaacagcagagcgggtggagactgttctgagtgtgagcacagctgtgcctgggaaggagagaaggcaccgttagaccaggcggtcagggaagagcgctctgggtagagggtgtagccacccaggcctctggtggcgtgtgcctgaggagccgagcgggcatggggtgggcagacagggctaaggaggggcctggtctcatacagagggaaaccactgagggttttaagccagggaacaacgtgagctcctgtgtttttacaaactcgtgggggaggcagcacggttgtgggggtggtggcgcctgtcgggaggctgctgcagccgttcaggagggggtggcagtggcttgaattaggtcattcttctgttggacagggcgccaactgagcaagaccaagtgatgcagcccaggcggcaaatgtggtggagccaggagtccagtggccccaactccagagctggcggcacacacctgctagagtccactctgacacagcatagctgctgttcccacccctcctccggcacacaggactgcacaggcagggccttgcagacacttacctgcacttgcccacacacactagtgtccccaagagcctgctggcaacgcacttcctaggccttaactcagccagcatccctcatatcatctgtagtgtatctcatccatccatccacccatctgtccatcatccacctgtctgtccatccatccacccatgcatctacccatgcatccatcatccacccatctgtccatccagccacccatgcatctgtccatccacccacgcattcatcatccactcatctgtagtgtatctcatccatccatccacctgtctgtccatccatccacccatgcgtccatcatccacccgtctgtagtgtatctcatccatccatccacccgtctgtccatccatccacccatgtgtccatccacccatctgtccatccatccaccatgcatgcatgcatccatccatccatccacttgtgcatccatccatctacccatctggccatccatccacccatctgtccatccatccacccgtctatccatgcatccacccatctacccatctgtccatccacccgtgcatccatccatccacccatctgtccttccatccacccatctgtccatccatccactcaggcatccatcattcaccccatgcatccatccacccatacatccacacatccatccatccacccatctacctgtctgtccatccatccacccatgcatccacccatctacccgtccatccatccaccacatgcatccatcatccacccatntgaatcacaatagaagaaggtggagcagcgtactggagtgtcccgcactgggcgggcagtaccctgctccctgacactgtgctgactcagggaacacttggtctctcccaaacattgcctgagtccctgtttactgtgtctgcctgtgctaggtaggcaaggataaaagacagccccgcccactggatgcttacagtctactgaagagagacacagaaacaagcaaccccacttctcttttagagagacacttaggggactgtgggagcctggaggagctctttacctagcctggttggcatgtggagtgaatggagtgtcaggaacggtttcaggaagaagcagggccacagccatactgcgtggtgttagcctggaggaggggatggcatgctttgctaataccagggtcctggagacagacaacagagtttccctcattctggagcttctgactccccactcccaactctgagagtcgttctccttcccataggctatgcagtctcatacagctgggctgcagtgccacacctcaccagtaggtgctgccttcagctcaatgtgactccagcctgagcttcgagctgtgggtgctaagaagtggctacccctggctgggcgcggtggctcacgcctgtaatcccagcactttgggaggccaaggcaaatggatcacgaagtcaggagttcaagaccagtctggccaagatggtgaaaccccatctctactaaaaatacaaaacttagctgagtgtggtggcaagtgcctgtaatcccagctactagagaggctgaggcagagaatcgcttgaacccgggaggcagaggttgcagtgagccaagatctcaccactgcactccagcctgggcaagactctgtctcaaaaaaaaaaaaaaaaaaaagtggctactcttccagtctgagggttgtaggttgagtatgtgtggaagagagcccagaggctgtgcaggcagcgtgtatgggtggtgaggaagttgggcccctcttccagtgcccccaccagcaggtacacagccttcctcgcactcctccagcaccccctccttgcacccctccagcacaccctccttgcacacctccagcaccccctccttgcacccctccagcacaccctccttgcaccctccagcaaccctccttgtacccctccagcacaccctccttgcacccctccagcacaccctccttgcaccctccagcaaccctccttgcacacctctagcacaccctccttgcacacctccagcagctgtgggagagctccctttccctggctgctcctgctgtctgggacgctccccagggctctcccatctctttctttgcagatggcaattttcccgaggcagcccctgctcaggttgaccccggaactgggtcacttcctttccccatcaggctcaccttaggagtacaagttctggagcagcaccagtgactgccacaaagcccctgccctccaaacgcccgagggtggggacaacagtccacaaaacagagcaggatgcagtcgctggtgtcacgtgctgtgggtgcggcatcggctcctcccgaccagggacatgagcccagcccccaggaggtagcagcaggggactgtggtagggctgaaggcagggcgtagcatctgcctgcaagtccctgtggcctgggcaggttcgggacagaggggccccagagtcgggctctgctcttgctgaatgtgaggggcccatagtcatcatccatggctcaaccaggcctggggacactgtgagggctctgggactgtcccgtcgggagcgaaggcagcggagagaggtaccacccacccacagttgtgccaggcacctgctctcaggattcggggacggctttgtgggctcccaaaacaggcaggaaaccaggaccagctgggagctggtagggactgtgggaggtggggaaatggagtgttgtggacgaaagcagccactccctctttgccctgccctgccctgccctgagccagggagctggacacccactgcagtcccctgaggctgctcaaccttggtgggtggggaacttggaaagtctcaagtctggacccatgacatccagtccctgggggaggcccaggagtcctgaaagctccccgagggagcactgtttgcactgggccaggagccatgttctaggggctcagctccttaagaggaagcgggagctgcgaggaggagggagcgcaggctgtggggctggggcaggggtgcgctgtgtccacactcatttccactcagacacggatggcggcagctccgcctctgcatacctgtgctccatttctgcaggggcgtcgcgttcccgtctcctgctggaactgtggcccagcccaactagggggtgtgggggcctgacctctgccccatctcccagggggcctgtccttggcctggcaggtctgaggaagccgtaggccccttctcagggttctccagggtctgcattagaacagcagcccaggcagcccccgactctcaccctcgctcccaggcctgcaggtgcagaggctggaggcatcgtggccggccagtctcagttcatgcccctgtaggatagtccttgtctgaatgtgatgccatgggatggggtgtgagagtcgccctggtgtgatccgattggtgtgagacttcaccagggctgcagagtatggctgtcagagttgtgcactgcaccgctccagggctgccattcccaccgtgccgtatgtagtgcgtgcatttgccctgaccattgcacattccccgggagggcaccttctgctcagtttgcacaagaggacacgggggctggtgtggggcctcttgggtgctccactttgggcggggcctgcgcaggacagtgcgtgcttagagccttggggcgggtctggggagcaggtggggcgatgagtccgtgtgcatggggtgaggtgtgtacagggccagtgtgactgctgtggtagagaggggtgtgggtgtgtgtatgcagccagcgtggcccctcagcctgccggcgcctgtgggtctgcgtgggtctctgtgtgcagccggcgtggcccctcagcctggggtggtgtgtgtgcctgcgggtctccgtgcaccctagagggtttcctggctgcatggcggggccactgctggctcccgtctctctggccccttcccagcaacaggacagctcaagggcactagaaccggacaggccaggccgcacctgagcccccgactgagcccgagcctcccagtggaaccatgtttctgtgggcaacccagaggcagtgatttttggacgtgcagcctggagctgggggacggtgtggagggagggggttggtgaggggaggggactttgggggaggggctctgtgcgcctggagccaccatgttcctacggttactgccagaaccctcagggccccagtgctcctggtccaccagcggctggtctgcggctgcccagtggagtgcagcttgtaggagcaggttgctgagggttcaggaaatttgaagccggctgttaaactgttagtggcttccatcagctttggtttggatactgacgtcacagaaactgacaggcgctccatgctggcccacagggagctgttcctcctgccctgctcctgctgcacgccccacctgctgacataactggacagactcagccttccttccccaccccaggaagcacaggcttggtggagcagcagggtgccctgtgaggagggcaactcagggctgcagtgtgtgtgctgggccgttggtgccgtcagtgagctgtgtccggggccctccccggcctgcgctgcctttccccccgcacctgccgcctggcagacggagccaccttctgtgtgcactgggaacagtcactcctttgtcactctagggggggcaggggcttgggtcggctctgctcactgcccagaacggtacctggctcgtcagggctccataagcatcggttggacgggtggacagataggtgggcagaccacaaggctggggtgggcacaggtgcagtagctcctgcccaccctccagggcaaaaggggccccctctggccccagacgtggacttgtcatccagggactgtgatcttgtccctccagctcctgctgggagtggacgtgtggcctccccggcccctggtgtggctggcagcactgagaagcggctgggctgagggcagccaccttggctgtttgaggtcctgcctggggacagagtggggtgaccaggacacagattcccagttctacagggtttttcgagacgtgggactttcagagctaaaaccggccacccgaggaaggggaagagaccccaccccacgaccggcctggccacctttcagggcctccgggtttgggaggagcacacgcagggcagcccaccgagcccctctgtggcatgggggtgacgcgttccatctgcgcccagccctgaccggaggtggcttttgtgtgggtgtgaagtgtagagaggtgccctactcctcacggctcagctgtgtgggtgtttccgacccacctcccttcccatcggccaggtgtccttgggcagtgagcagcctgcaccactatactcagcagccctgtggcagcctttcccatcgctgccaggtactgccctgagcctctgtccctagaagtgagtgcagggctcatggggccatcgccaatggtcagactccccagggggccggtgatacacggttcctggagcgggctggaaactcattccttgcaggctctgggagacgatgatgcattcccgggaccccgcgttgagaaccgctaggagtgggacacgtggcttcctgcagaggtggacagaacccctgatggccccagcagggcagcaagtgtgggacccggtgggcagggctgcccagctgggaccgtggtgccagctccgggggtgagaaaggagaggttgtgagagtccagctggtgacaacagtgacccctggtggcctggaaggtgccggccccgggctctgctgcacaggccgtgcctccacctaaacctcattgcaccgaggggccctgccagggttcccgaatgttacagttacagatgccgaaactgaggctggggcaggccagtcgcttgcccgaggccacagtgccaggaagagccgggcagcctggccagggcctgtgagggctactgtgcagctgagcaggtcactagcccaccaccctgcccccggctcccgcccagtaaggctcagactcctcggggctacatccctgcccggccagggcctcctccagtgtgggtgcctgctactgtgcggcttgatggacctcatgggccgggggcatttgacctcaggggcctgggtgacatcccttaattcgcactggcaccgtctgccttgtgtgcaccctgtcagccacccagggaggcctgttgctgcaggaggtgcacagagcgggcctctggctgagccgaaggtcggcagggagccaggctcatggctgcagcaagccacaccagccagtcctgggacgggtttccccgggctggggcgtgctcctgacttggatgactcaaagtaaagaacctcaccaggggccctggcatgcgaggcctgggggcccagatgtgctggggcgtgtcactacaaggtgcagaattgttccagatccaagttggccagagagggagaccgctgggcttccacgtgagtctgggcgctggctgtgcaggggcgtctctgctgggcgctggccagcaggagctctggcctctcacttccctcagctttgtgcaggtttgaaattatttccaagtaaaaaaagtaaatacatgcagggctcggggtctggtccctgcatggtcacttaacctgtctgcgcctctgttttctcatccgtgaaatgtaaaggaaaatagtttctactcggggccaccgtgtgagcaaatgtgtgagtgtgtgcaaagcgcccgggccaggccctggcacgcatcggcgcccatgttggctggtgtcaggggtggtggcggtgggcgtggggcgtgggggtggggtgaagggagtatgggtgctcccttcagcaggtgatgaaactgaggcacggggaggccgagcagtggcccaagggcccatggccagggtcaggcaggtcccaccaccacctcgctgcttgctctggcatggagccgaccgaaggaggtgctgtgggcacagccaggggacagtgggtggcactgaggctcgacctggaggtcatagccctgtacagccagatggggtggtgcgaaccagccagggtgtgggtggaggccctgcctgtggtccctagcacccccaggatgccttcaaagtcagcggcttgtggaaggggcggctccaagcacgtggcggttctcgtgtcactgagccggtgggtcctgggtaggtcctccccgtcctggtagagtgtgttatcagtgtgtgcgctgtcagctgggatggcattcctggctgtgcagagctctgtcctgctgctgctcccgcccccagaccaggacccagcccaccacagctcgtcacatcccaaagcgcccagcggctgtcggggcgcctggggccggggtgctggggtgccgggagcaggcatgtagccctagccagggggccccgatgcggacgcggtgaggtgggggtttgcctgagacagtgtctctctctgtcccagatgaaggtcaccgtgtccaaagggggcgaccgggacagtgacgacgacagcgtcctcgaagccaccagctcccgggacccgctcagcgatgtgagtacccagctgcccgcgcccggaggctccgagtctgggccgcctgcccactgcgccccgcacaagggcgtccagtccgagtctgggccgcctgcccactgtgccctgcacaagggcgtccagtccgagtctgggccccctgcccgctgcaccctgcacaagggcgtccaggaagccgctggttagggtccggtttcccaccaaggctttgtcttagcaatgagcattttgccttcgttaaagcgtgattttttactcattaggactttcccattaggagagatttaaatgaagaaatggtgagtgagctggcaggagcccagaggccaaaacgttaagccttggacgctgtgcctgcactgctggcctgtgggtggagggcaggcggacggccgccgagtcttgagatgggcactggcggggcagtggggaggtttctgctgactggaacttgaggcatctcattatcatttaaatgaaggcctcactgcccggctccccatcttgttgccacaagttaggaaaataggctgggaattacctgggactgccgctgccttggtttgtcctctaattgccagcccctggtgaaggaagtcacattctgggcacaatgcagcagctggggctgaggctcaaactcagggcaacgaaggccctcccacccctctggcagctgggagctggcgggtgggcccatcgggacccagggccttgggctctgtcccctgacatcctggggcccttcaggagctgacctgtccccggcaagggtctgtcttgggaaggggagggggtgtcctccctgactctgcagtgggggttgtggattgatttgggagagtggagggctgcagtcagctggccccaaagccctccttttcttcctctgccttgccctcagagggggtgttggatctttgcatctgcccccactcctcagggggctctggaccctccctgtgagccccacttgcccagctcagtgacccaccccatccactacagcagccctgagcctgtttccccacccctcctgctgggggaggccctggtggtctgagtgtgtagctggtgtgatccatacctctgtcctgaagacctcacaacacccactcgagccagagggatccaagggtgtgggggacctcagcagcccctgcaggccagagggatccccaccagaggtgtggggggcccctagctgcccctgcagaccagagtgtgccctgatgtctgaggggcccccagctaccatcccccagccccaacccccaccacctgtcaggcccctgtggtgaaccctcctttgagggctccatctggtacctcctcccggaagccttccttgtctagccagggcaccctccccaaagtcctgcaaccatggacccctctggcgggtgggcacggagggaggtcagcagaagctggggccctgggctgacctcccccaggtcttcctgcctcctctgaggagcatttctggtggggccttccctcttggggacagggagctagccaagggcgtccctgtgggagcctcctcgggtttggatcccagagctgctgcaggggagcctcagactgtctgggcccctcaggaggacgacagcccctggggaggaccccaccacgacgcctaactctgtcctcctccctgcggcctcagccctcgtggcccctgcctgagaggatgtctcgctggtggtcttgggtctgggcatctggacctgtccccatccgagttgagggctgcggggctgcggggcagggttgagggctgcggggctgcggggcagggttgagggctgcggggctgcggggcagggttgtgggctgcggggctgtggggcagggttgtgggctgcggggctgtggggcagggttgagggctgcggggcagggttgagggctgtggggctgtggggcagggttgtgggctgcggggctgccgggcagggttgagggcttcgggtctgtggatctgcagggcagggctgtgagctgcagggctgcggggcagggctaagggctgagggctgcggggcagctgtcgggtgcatccctgggagtttgttccgagtggcagcctcactgactgtcccctcttccttcctgcagagctctgcgcatgcggtctcggggagaggctactctgtaagtctcccagcacccctcctccatctttgtccccctggggccttaggaccaggtccccacctcacctgtccgaggccccacaacttagctcaccccagtcccgtgcccgctttccctctggagccccagactggttctggcctcaaacaccatggggctggtggggggtggacaagctccagagtgaagatttgggggtgcgtcctgctcacggtttgccagggggcccccaggctaacatgctgccccagggggacgggctggccctgtggctgtggccttgccaggagcctcagagtagtcagcctgcacagaccccagctgcagctaagggtgccgggatccgcggggccaaggccgggctgcttcttggggtcctgttgggggcctgggacatttggggtgggaggtgcccatggtgtgagcagccacctccaatgccctgaccggcacctgcctcaccccggacagaaaggcctgggcccaggctgggcaacacccagggagccagcaccccgtggcgggcagggggaaggagacctgtgtgcagccttcatgacgggtgtgtgcccagggggagcgggtgtgtttcccggggggagcgggtgtctgcctggggggagcgggtgtgtgtccgggggagcgggtgtgtttcagtgtgtgctgtgcctccccgtgggtgcacgggtgtgtttcagtgtgtgcctgagggaagcaggtgtgtttcagtgtgtgccgtgcctccccgtgggtacacgggtgtgtttcagggtgtgccatgcctccccgtgggtgcacatggcacggtggagggctccttgcacatgtgcctggacttgctgtgggaatggcctgggaggctgggcgccgacccctgccccccggacctggaggcccagcaccatctccccggcccccatcaccactgtcccctgccctcctcatgactgtgtttcattttcccttaagtatcaggaggaacattaatgacaacataaaacccagagctccataaaagccatttctacagattgacggcctgctgggctcgtgggagggtgggggcctggactctgcccaccccatccctgcagcccccgaaatttccaggccgtagaggctccctcactaaaccacagcagctttttatagggtgtgtaattaaaccaggaatgacccagtgtggccaggccagaggggacgcagcctggtggggacggccccccactgtctctgtcccacagcttctgctggtggcagagcaggaagcggcaagggagcggcatgggcggcgcggccacaggccaggagtggaccccaggatccctggacccagcctcatgggcaggaattggccacttggctgggtcacagcaggggctcagccaggccctttgcacccccaccccagctcccctgaggctgccctttcacctgagggtctgtctaaagccctgggctcagctctaccatcctgggctcttctctgccaccctgggctcggctctgccaccctgggctcttctctgccaccctgggctctgccaccctgggctcttctctgccaccctaagctctgccaccctgggcttggctctgccaccctgggctcggctctgcacccctgggctctgcccccctgggctcttctctgccaccctgggctctaccaccctgggctcttctctgccaccctgggctcttctctgccaccctgggctcagctctgccaccctgggctctgcctttggcctctcacctggtttggcccagagtccgtgagctgttgacctggggtggctggagctcacttctgggcagtggttcctggagcagctgcctgcccaagggccctcttcctagggtttccttcctcctgtgctgcatggggtctcaggcagccttgctgttgtcacctgtgcgcgggggcaacccctcagaggtggctgtgggtgtcctgacagccatggtcatgagtatgatgacactcctccgcccttcccattgtcatgagtatgatgacactcctccgcccttcccatcatcatgagtatgatgacactcctctgcccttcccatcgtcatgagtatgatgacgctcctccgcccttcccatcatcatgagtatgatgacactcctccgcccttctctgggcagtgtcctgacagaccagctcctggtgtgcgtgttcagggtcagagtgtggaaatgggctaaggccacctggctccggctgctgggaggcacctgggtcaagtggggtgtcctgatgcagactccatgggcaggaggactgtggcccccacataggtgccagactgtgagtgtcagtgacatctccgagtgctgggcaggactcctgtcggctcactgtgggtcagggggagggccgggtcttaagctctggaaggtgggctctgccccctgttgctggtgaggtgtgcacgtggccacctcctgtggccaccccagctggtctgaggtccccagggcacctgggtctctctgccctgagccactgggtgcccttctgcttctgggtctccactcattattcaagtcttctccccagagcactctgtgtttcctgagaaagcccgttattaacttgccagctgcttgcagcttaacccccacagccgaggcacacaagtgacagatggcggggtggggggtggggctggggggtggggggagggggaaggggggaggggctggcctgctgcactggggatggggttccctccaagccgcaggagcctgggaggaccctgagggctgcagagggtcctgtgcgtgtgcactgggccccagcacacacatacctgtttcagaccctggtgcatacagatgggccctgccatgtgcaggtgtgcgcccggggccttggtccagtgtggccctcagttgcccatgctgtcagccctgcgggccccttgtgtccagtgtgggggggggggtgcaggtgagagcccggggtgcaggtgagagcccaggctccaggcagagagcagggaggtgcctggcctccttggaagtgctcttccccggcactgaggactggaggcaggtggaggccagaccaccccaggggtggaggaccaagaaccggtcccatgggacgcatgcccaggagcaggacaggacccaggagcaggacaggacccaggagcaggcgaggggcccaggcgagggtctggattgtgctgaagcctgggacccactagtgggggtttgggacttccctgaggcctcagactcctgggttgctccctaggctgaggctgccatgtgtgtgtgggcgtgtgtgtgcatgtgcatgtgtgtatgtgtgtgtgcgtgcatgtgtgcatgtgcgtgtgggcaggtctgtgcctgtcctgtgtgcagctcgtgtccgtggtacccccgtgtggtgggctgcatggggctgtgcgttgccttgtagaacagtgtcacgggttcctctctgggcctctgtgtgtgcgtgtgtgtgtgtgtgtgcacccgcgtgtgtgtgacctgtgtttgtgtgtttgcatgctgtgcatgtggcattgtgttgtgcacatggcgttgcgtgttgtgcacttggcgttgtgtgttgtgcacgtggcgttgtgtgttgtgcacgtggcgttgcgtgttgtgcacgtgtgcaccccttgccacctgcctgtgactggggcctccagcctaatgagaaggcacagccaggccagcagcctcccgtgttgctgagtggcacaggcattcatcacctggtctggttttatgaaccatccttagagtggtgtaattttgtccacattggtggccagcaaagccccagctattgctcatcctcagcagcttgtgccccaagtgtgtggtttggccttctcagccaccgtcagtgctgtaaggtagagttgcttccacccaaggatgtggtgactgactccagcgtggcagggggctagtggatcgattagacagaatgaggatccacaagagcttgctggggttggagccattcctgccggcacaggaccctggcttgccctcccacacccatgcacagaatgttctggaggggcctttggccagcaggagccagagtgaggggctgggtgagctgcagggtggtggtggcagcccatggtgaggcccaggcctcagggacccatctcaccctgcacacggcatttagttaccagatcatcccgttctccagacaggatcacaggcccagagaggccaacagggccacccacctcagtgactgggagctgagaccctcagacctccctcaccactcggccatgcccacccagaattctcctccatgcggctgcccagccccttgtgcccgtcaagaagagccatctgcctggctatgcccacatgccctactctgcccccagtagcacccacttggccacagcccccccaggcccttcctgtccccactggcaaggtcctccatcagggtcacagatgcccaccctgcacaaactgaggtgtggagaaatccgtccccttgcctcccctccagcccatgtgtgctgagcgtgtccatggccaggcatgcacacagggagaaagatgggaaagacctgggtaagggaagccaaggagtcgctgtcccaggcggggtgttaagcgcagcgcaggagggtgggagggggggccaggccagccgaagcaggcataggtttgaacagaggggccggtgagaggccctgaggcccctgaggaaggagcccaccccgtgtgcttgggggcatgcctgggacagggaggctggaggtgggtgggaggagcagagacccagccaggtgggacactgcagatgcccaccagccgctggggtcccgctgccctcgctctgtgccagggcccgatacaggcgctgtctttacaaggcaggtttgtgacactcattacggggctccttgggcctcttctgagcagccacaacttgtacagaagcaataaaaacccatcagcctctccctggagtcagagagccacggtctcctcccaacccagcctctccctggagtcagagagctgcagtctcctcccgacccagcctctccctggagtcagagagctgcagtctcctcccgacccagcctctccctggagtcacagagccacagtctcctcccgacccagccacagtctcctcccgacccagcctctccctggagtcagagagcctcagtctcctcccgacccagcctctccctggagtcagagagcctcagtctcctcccgacccagcctctccctggagtcagagagtcacagtctcctcccgacccagcctctccctggagtcagagagcctcagtctcctcccgacccagcctctccctggagtcagagagccacagtctcctcccgacccagcctctccctggagtcagagagccacagtctcctcccaacctctgagcatagaagggtctttcaggctggctgctgtgtgggtaccgtaggggtgggggctgagccatgtcctcgccccatggtgggcacagcccgcacccatctgctcacccatttgtccatctgcacccacccacatccatgcacttaccacctgtccctcgtctgccacccatctgtccgtccatgccacagtgatcatgtgcctgagggcagtggcctcagcacagcctgactctgggctgggctccatgccgggcactgggttgtgaggagcacgtcacacagggtccctgcccccagggagctgccattccagaggggagaggagccagtcagtaaagagagcagcagctgccaggtcggaaggaaggtggccggggtcagggcagcatctcagaaggggcaggccagggtgtctgagtaggggcaagcctgtgtgtgcagaacctgaggcgggtgggtgccactgtgggagagaacagggaggggtgcaggggagctgggccgtagaggatgggaggctgtgcagatagtaccactatcccccaccaccccaggctaagtgacaaaggggctgacccacccagtgctgagaggggcagggtccaggccaggtttgttccagcagcccaagcaccaccactcagccctgggaggtcagcatgggggcagcagggacttggggtcctgggaggtggccatcctgccgtccgcctccactccagtcctggcctccatgggctgcgggagggtgggacgccacgtgcgttgtcgggccccaggtgaagggagtgtctgcgtgtgagaacaccttcatctccatggcatttagatcatctgactcctccacctgtggtatttgattgcaaacaggtgaggtccatgaggagacctcgcctccatctgcagatgcggaagccgaggcccaggcatcagctgcacctgtcgcaccctctgccagggcggggtccagatggggccaatggatttggtcccctccctgtccacctttttctcctcgccacctccctgccccacatgtgcccacacagggctcacttcccgcagcgggcacgcgctcttttatctcctgttttgtgggtcagaattgagcaaggctcagcccgggtggctcctccatgctgcactgtgctcactggggtctcctggggatggtggctgggctgggtggagggttcagggtggctttgctgacgtgcctggcttctgggccttggtggctcaaggcccaggcagctgtggccagcccttgcagagccttagccaggctggcagcaccattccagcacattctgcaggtcagagccccccagcccagcccaggttctaggggaggggttggaccctggcctggaggggcctcatgagtgccgcctttcaccccacccacagctccctgcagcgctcccaggtatgggggccacagccatccaccaggcaggacagccccacagggcagggagatgcctgaccaaggagggtggcacaggcagtgaaggtggcggcgcacagccctgctggagagggccaggccagagtctggggtgcccatcaagctgaaatccaattatgagaacaggccgggctgctgtgacacgggggttaggaattaatgttaacactgtttctggttaagactttttgtgttgataaataattcatgaggcagttagcactttgagcctgacaacacgagaatatattaatacggtcggctccaagaaaggtcagccacgtgcttggggccagggggccatcttttattcattccctgacacaggctcattaattattctggcccagccggagctgtgctcggacgggacactaatgagaaaaaggagagtggatttgagatccacacgccatccgctgtggggacgtagagggagagatggaagaaacactggtgaggctctgaggcgggatgggggctgcagcctggctccctgacagtgctggttgggtgtgaagaggtgagcggactgatccgcaggtgtgtggggcactggctgccaaatcccagcactcccagagagatgaggaacaggagcagatgcagccagtatcagagagcaggaggtgcatggggaagtgaggctgaggctgtgggtgccccaagcacactaggcccagcgggtgcaggaacccccagagaagccactgagcagagacccagaggggaggctcgcagggccagcggttaggagtcctgcatgtgtgcacgtgtacatgacagtgtgagtgcacgtgtgtccatgatggtgtgcgtgagtgcacgtgtccatgatggtgtgagtgcacgtgtccatggtgtgtgagtgcacgtgtgtccatgatggtgtgagtgcacgtgtccatggtgtgtgagtgcacgtgtgtccatgatggtgtgtgtgagtgcacatgtgtccatgatggtgtgtgagcacacgtgtgtccatgatggtgtgagtgcacgtgtacatgatgcgtggatgtttgtacatggtgtgttgtttacatgtacatgacagtgtgtgtgccacgtgtgcatgatagtgtgttctgtgtgtacatggtgtgtgtgtgcatgtgtacatgacagtgtgccatgtgtacatgatggtgtgtgagtgcacgtgtgcatgacagtgtgtacacgatggtgtgtgagtgcacatgtacatgatagtgtgtgtgagtgcacgtgtaaaatggtgtgagtgcacatgtacatgacctcgtgccatgtgtacatgatggtgtgtgagtgcatgtgtacatgacggggtgtgtgagtgcatgtgtacatgatggtgtgtgtgccacgtgtacatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccaaacagaagtggtaacgatcacagtgaggccaggggctctgcgggcactcgggggtcttcaggctgacgtggggtggggtagagtggaagcggctggtggccagctcttgtcaccaggaacccccttgctgtgtggagatcagctggagggccagagcacaggggccccaggtggccacgccgggcatgatgtaggccacaccggtggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccctgtcgtgtgtgggtgccctctgctgtgggtgtgaagcccacggagtgtgtgccaggtgacatgtacttaacaggaagagggcgccccgggtgtagaatggaaagctgttcagagtgagactgttcctgtccagtgtgtgagtcggccgagcccagaggtggctgaggtggtgctttccccacccacgtcccatggcgtcacagcacaaatgccagtccagcctgtccagtgtgtgggttgggccgaacccagaggcagctgtggtgggtcctccctggcccgtgtcccagggcgtcgcagtgcaaatgccagtccagatgttcctatttgtggcagtcgcgacttgagaaaattaaaggtgattttgtgcattttaaagcatttagacccaaggctcaggtggtgctaagcaggtgtctaattctgcacatgtctgatggaatgttctggaattgtattggggctgggcagtgctcccttgaggactggcccccagcacctagtgccccaatctttgtgacagttgggagcccccacgaggatagttttgtcccctccaaccacagtgtggggcaacaggcaatgcggacttcagagcccaggccgcccacacgtgtgcctgctatgtctccagctaagtggaccccatggatccttgggaacaggatccatgttctcaacagacaagaccatggataacaaataagcagctgatcggagatcatcgctgggtgggatcagggtcctgagcaggagctggccgcactcgtgtgcaggcgcagtggccaccactgcacggagagctcgggggaggggccgcagagccctgagtgccaggaggagccagactggctgggactcgaagaagagcattgggggaacgggctcacccagatccctggtcagagtgagcttgggtgtggctgggctgaggccctgtgacccaggggccggtccctggggccaggcctgggagggagttagtttgattcataggaggtcctgagacggaaggggcctgggagggtgtgttctccagctgcctgtccttctaaccagggctccagccccacgttctcgccgacgcagggctctccaggcctgctcccttggcagctctcagggaaagttcagaaatgcatcgggagatcctggggccagaggcaggggtgccagccctgcagccccaccactcccctttcccatccccagctgtctcttcacgggcctggactggaggtcaagggctgcctgagtcctgcaaggcccaaggcaagcacggactgtgccaggtgcactgagtgggggcctccagtgggcgacgcagagcccagagctttccctggcagtgatggccacggggccgccacgtggcacagcctctcctgagggcttgagcccccaccgggaggcaccctcgcaggcgggcgcacagcccatggggccttggcactgtggggagggtgcacaggcaagtccggctctggcgtgtctgctccagagcctcactcacctgcagctcctggaggctgtggctgttggctgcagtgacttgattgcttgttaattgctcattaattgggtaattagtgctttgttgtgctttgaagcctaaatactcataaaaactgaatttgctgagtaagcaaacatagcatttttcttcaggacccaccacccggttatcttgtgtaaccaggttgcaagggtgcctccacctcccaggacagcgagaggaaggtgggcctcagtgtggcggggccctgaccggagggtgagagtggcctccagggcttctgccacagattccagagcctggattcaggattcagaacccacccagtcacccccggtctgtgccctggtgggctcccatgcactcagtcctcagtttccccatccggcagcaggtgggtctgtggcgacttgcaagtgagcccagtgtgagccgcatccccacacactgcccggcccccacccctcgggctccatggcagctctttccaggcgcctgctcttccagtctccagagaagaaaggcctggggagcgggcggagagtgtctatgctaggatcagggtcagagagggaggagctggccgtcaggtgggccaggaagcctcagtcccatgccccggccctccagcccgatgcccacccagtcctgccctccagcccgatgcccacccagtcctgccctccagccccatgtccacccagtcctgccctccagccccatgtccacccagtccagtctccaagccccatgccccacccacccagtcctgccctccagcccgatgcccacccagtcctgccctccagcctcatgcccacccagtcctgccctccagccccgtgcccacccagttctgccctccagccccgtgcccacccagtcctgccctccagcccgatgcccacccagtcctgccctccagcccgatgcccacccagtcctgccctccagccccgtgcccgcccagtcctgccctccagccccatgcctacctagtcctgccgtccagcccgatgcccacccagtcctgccttccagccccatgcccacccagtccagtctcccagccccgtgcccccacccacccagtcctgccctccagccccgtgtccccacccacccagtcctgccctccagcccccatccacctagtcgtgtccttcagccccatgcccacacagcccagtctcccagccccgtgccccacccacccagtcctgccctccagcccgatgcctacccagtcctgccctccagcccgatgcccacccagtcctgccctccagccccgtgcccacccagtcctgccctccagccccgtgcccacccagtcctgccctccagcccgatgcccacccagtcctgccctccagcccgatgcccacccagtcctgccctccagccccgtgcccacccagtcctgccctccagccccgtgcccacccagtcctgcccttcagcccgatgcccacccagtcctgccctccagccccatgcccacccagtccagtctcccagcccctgcccccacccacccagtcctgccctccagccccgtgtccccacccacccagtcctgccctccagcccccatccacctagtcgtgtccttcagccccatgcccacacagcccagtctcccagccccgtgcccccacccacccagtcctgcccccagccctctctcagttgaccccaggtccctcccgccaggtgccacctcccctcggccttgggccccattccctgtgggccaccctgagagtgcgcccagctggtcccggccacctacccaccctggcccgggccacctacccactctggtccctggcacacctccatctggcctggtgcagcagcagagcccagccccacactgtctcctgcacccaaccctgccagaatggaggccagacatcccctctcagtggactccacacgccccctgacccgcccaccacacactgtcactgccagccatcccgtgggcttccgagccacctgtggtgtgtgtggcgcctgctctgggctcaacacatcagcacctggaaccaggctccagggcaagcccactgctcactgcacctgcctcacccgggggggcccctccccgatggcaggaggactcccagccccacacctatggccccacaagcccagatccccagatccccagatccccagctctgagtcctgggctcagctccaggcccttgctgagtagccatacagctgaagaaagttctttccctctgaacctctgcttcctcacctatgaaatgggctgatactgctgtgacactgggggtacagcctcccaccacacccctaccccaaggcacgtcaggtgcaaatccactgtgagcctggggggcagagccccacaccacacccctaccccgaggcacgtcaggtgcaaatccactgtgagcctggggggcacagcctcccaccacatccctaccccgaggcatgtcaggtgcaaatccactgtgagcctggggggcacagcctcccaccacacccctaccccgaggcacgtcaggtgcaaatccactgtcagcctggggggcacagccccacaccacacccctaccctgaggcacgtcaggtgcaaatccactcagtgggccccacccatccattctatgccagtaccgtggatggccaaaggtgcctcaccctcaagtgccagatttgggccctgcagctccagcacccacacccgtaaccccctgcccacgaggggccagcagccccgccagaggtcatgcacccccccaccccggggacagctgcccagctgcgtggggtgagtgcacaagtggctcccacctggcggtgcccccccaggcagcccagttctgcccatgcaggggaagggaagtggagcctgggctaagcccacatggtggaggggtgcggattcacaggactgaggcggccgaaaggggctgagagtgacctttccaatcgtgagacatttcacacagtgtgaagctcaactcgaaatctccccagctgctctcagccctgggggctgccggtgccatgccagcccctgccccttatttcagccgaatcgcttgattggaatgcattgcatatcccgcccgagcgtgcggcccaaatgaaggtgggccccttggcactgccatctgggaagatggggtcccacagggcagggcacggggcccacagccactcatgcttctgccccatcccttccagagctgctccccccaccaccccgaaccatccgggttgctggagtttctgggctgcaggttcagacagaataggtgaagcagccaagctgccgtctgccccacgagggcccagcacaggtggcgcaggtggtccttttccccactcggcggcacgtggctctgtggcaggtcctgaggcacccacatgccacgtacagacattgggacaagtggcaggacactgagggcagaagccaccaagggcaggatgaccagatggcacagggaggggccaggaactggcacacgcaggacgcgccacggcacatgtgcacacggcagatgctcctcgtatccccgggcacctgggtgggcacgcgaggctcaacagggccccacggaggacacatgtgcacactcaggccacacatgctcagccagggtggggcttccgcaccggtgttcccagcagctcggcctctcacccgacactcaggctgggcctttccactccatcctgcccacaccttgccactgttagaggtacctcgggttggtgcaggcgcccgtgttgttggggtgttttttctgctggtgaggaggggtcagggccccctgccccaggtagttctgctcaggaaccttcatgcagtgcctcagagcagaaacccggccctcactggccctgcctcagcccctctcccacccactgggcccagacagctctcctggatgggaagctggggaggtggaagcagaggctggcagtgtttccagcacccttccccaatgctgggcctagaccctccgcaggacagccccttggcccctctgtctcctgtctcctccccaccctgcctggtcggggccagacactgagggacccctgggagcagcaacctcagcgcagggtccctgcttatgaatttttcatgcctttgtttgagcagtgggatcaggcggcccctgagcacaccgaagccataattaacacttgcactgggaaggggaggcatgtgttctttgctgcttaatagccgtgctgctgatttgtgtctccccatgtgtggggctgacaggcagccccaaccccaacccgtagccgcccagggtctggaaggggtgcagggaggcctgggtgatgggggccaagccccctccaggctcttcgggtagcaagggtgcactgcctggctgtggggtgggctcagatgcctctgagggatgagggaagggggaggggttggtggcagtggtggtgacagtgacagtgaagatgacactgatggcagctcccatttatgaagcctggccgccagcggctgctgtcctgagcctgccacgcacgttgcctcctccgactcagaagccctatgaaggtgccactgtctctgcagatgaggaaacaggctcggagaaacgaagagacctttgccacggtgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacagggagctgtcaggtggggatgcagtttcctgttctcagcaggaagcagccatcggtgctcatgagaagtctccaggtgctcaaatgttggcagccaattttaaaaaaataaatcaggccagaccaagcccatgtgcccccctacccagcttgtggctctaaaagccatgtctcaaggccgttgtccacccacgggtgagggtctgggaaggccgctaatggagcctggaggtgctaggcatccccactcgcatagccacatctgtgaaaacagtgacacgcagtggcccctggggtggttggggaagccactctcacggaggacgaaaccggtgcctgtgcttccgagccccactgcggctctcacacccagcccgggatggaggtggggcagatagagcttcccagggcctgggggagctgagctgcgggcttggggtggggagccctgactcacgcctggcctctgactcgtgccgctgagtggtctggaacccctgtcgggtgcctccctctggccaccccacaccttaggcgtgagggccggggccctgggcaggaggaaggaacagagcccagtggttcaggggcagagcctgcccccacggccaatcaccggaatcacccggctgctactccccaccccaggcacccgggtttaagtggtctaggggccccgagcctcggtgcggcttaaaaccagactgactgagggcgtgggtggagacaacaagtactgagaagtggtcacgagggccattattggatggtgaggtccgacagactcagaggggccttgtaggctggcagaccatggtacagggagctgctgcctcctggctgccattggagctcaggacaagcagagaaggagagacttgatatcggggtctcctcgtggctacaggaaggctcacctttccagccttggccatcagggtcatagacaagcgtgagcactgccagggctaagagactctaaaactcccagaccaggacttcacctacgccagggtaaatggcatcttctcgttcttggctttgtgggcagacaatgatggtgatgatggtggtgaggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgacgatggtgatggtgatggttgtgacaatggtgatagtgattatggcggtgatggcgatggtgaggatgatggtgatggtggcaatggcgaggatgatggtgaaaatggtggtgaggatgatggtgacggtgatgagggtgatggtgatgaggatggtgatggtagtgatgatactgtcatgtgtataatgtactgactatatatcaagcactgccttagtgctttgcacatattcacttatttaagccacacagtaatcctatgagctgtaagggacaaccctgtaaattgttcctatttacagaagcacaaactgagacacagagagctcagggcctcgcccagcatggggccgtgcggcacggagctcagggcctcgcccagtgtggggcagtgcggcacagagcgggcgtcttctttggagcctgagtcttggcctcctgaccatgcccagcatgtcccttcggggcctggggtctgtcctctgctcccaggcattcctgcctatcacaaacccacaccagggtgacgttccctgagcccccgagcccagccccggcgccgtgaatggtcgcctcactcgggcagctcccgagaggtggatgtgtctctccttttctcctcgccctgattaattgcctcattcaatgccgactccactgcagttaaacattaattcagtaggacttaataacacgaattcattcacgcccctgcctgcgcctggctgacagtgccgtgctatttggttaatgagaggatccatgcagcgtcctctggtgcgcttgctggaaagcacccctcagtgtctccttgctgttggatgcattaaaccctcgcctgtgtggtcagcctggctgggtccagccacagacctgaaacccacggggagatccgtaaccaggtccgggcttgtgggagctgctggctctggcccatgggtctcggggccaacccaggctcaagcagggatctgggtgcggggataagagcagaggctggactgggcaggtggccccaggccacgggtgcacccatgtggccccaagtgtcaggctgctctcgaggcctgattggccagaaccctgacagtctggtgggattgcagtttccaagtcaaaggctctgcagcgcaaattcagcagggagaggcctcactgggggtccccagaaatcccactgtgaggctagaagggcacctgactcccctgcaggcctctggatgctggtggggctgcctcctgtcccacctccagggcgcactccctctcggccctccccaggctccccatgtgcagagggcatccttggcacagtctcggctcctgctttgccctcttccggtcccctcagccctggcgtgttctggcatgttcctcccctcccctgcgctccccgcaggagcttgtggctttcccctgccccacgtcctggtctttgcttcctttgctcctggctgagcctgggcagttccatttcatactttcctcaccaaacaccaaggcccgcccatatcacagcaggggagatggaggactcagaggcccagggccaccagcaaagctggtctgcatgtcggggtcctgtggcccagcccttggtgagctccgcacctgcagcctccggggcgggatgggcccggttctgacttggagccctcagttcttgtgtggtgggccgggctgggcgggtgcaggtgggactgaggcccttctctacctctcaccctgaaggccagaccgggggaaccctaggagagggcttggccacggctgaaaggccagaccggggggaccctaggagagggcttggccacggctgaaaggccagaccggggggaccctaggagagggcttggccacggctgaaaggccagaccgggggggaccctaggagagggcttggccacggctgaaaggccagaccaggggggaccagcacacagccgggacagacagcctgggggagcctgtcagcctcaggagaccccccccacaggcccaccccagctgcccagcttccccaggggtcccagctggggtcccacttgtaggagccacctggagtgtgactcgtcatgcgctgggagcagcacgttctcgctgcagagtgtctgctaaagcgcatttcacaccgtactgtgagctccgtcgctgaacactcggcagccgcggctgcacatggagggtggctgtgcgtttggttccctgcattaacccagtgggctccacataggagggcgccgcccacacatccggctggcactcaccaccctccgtgcactggggggtttattcttccaccaggtcattcattcgacgtgaatgcctcataattgcagttgccaggaggggatttttccccttttgactgtttcgggggacattgcagtcagtgtgttcttcgtagagctctgcttactgaaaacggagaacggacagtcagtgtgttcttcgtagggctctgcttactgaaaacggagaacggacagtcagtgtgttcttcgtagggctctgcttactgaaaacggagaacggacagtcagtgtgttctttgtagggctctgcttactgaaaacggagaacggatttgttttcgggattatcacacccccaccctaaccagccaagctgacaaatggcgctggcatcgagtgtctaaccctgagcggccgtggccctccgtgcgctgccagcccctcctctgcccccggctgtcctgaccccaggggctcccaggctctgcccaccatcaggagctggggtgcctggatctcccagcccatgtggtgccatcgatcccctcagggggtcactggggacagtggggctgtcctgggccggaggctgccctccttcctggtgtgaggaaggctctggctggcccaggatgggggtcttcatggccgccctgctctgagggtctggccagtgagggctcctctcgggctgcagggccagtcttgtccccaccgctggctagtcggcctggctgtgcccctttgtccatcccacccggggggctgtgatccaggtctgtctggtgcagcactgggccctggcccaggttcctcctaaccgccccgaccacctgggcctgctggtacctccctctcctggcagcagccagggccgccccacccgtgcccctgcagcctggctgctgccgtgccccggggggtgacactggttggtggggccccgactcacttctgtctctctgtccctgcagtgtgacagcgagagcggcccggacgacaaggtaagcccagcgtcctcctcctgggctcggctgacagccctgcccttccctgctgaccttggccctgtgaggtgggccctggagaccaggcagaagatcgggccttggggggatccccccgcccggtgggtgcagggggcttgtggcctcccaggtatgggggtgctggcctctcctggctgtggaagagcctgtccagggctggggccggtaccgtgtctggagggacacaggcccaggtgggcatcagtgctgccccagccaggagggtgcctgggcagggctgccatggggtcgaggcatcagctccagctcctgggcagcagagggcagctgggcctgtgccccaggactggtcccatcagtcctgttggagcaggggcagagccagcccctaccctatacccggtggccccaggaccaggatgtatatgcgcagcctatgaccacatcacagtcaccctcagtgctcaggagcaagcaggattcctgcagcctcagccaggagtgaaccccccgggcagcccctgagccacgtcccctcagcctcggagcagcctccgggggggctctccttctgccccgcttgccccagagccctgcggggaggaaccgtcacctgctgtggccgaggagcatcaggccccggagggcgaggaggccaggcaggtggcgtgaggtcccggcccgtaaccactgcacctcactgtctccctgtgactgccaagggctacccgggggcacctggacgggggtgagggccctgccagatgtgccaggggaatggtcaccccggcctcagggacggccctgcagaggcccgaggcggactgcatgtgtgcgacgattctcaccctgagccagggagacgctgccctgggtttccaggcaggtttttatgaatggaacagttccatgaggggtctgcacaggggttaggggacgcccactgtggcccgtggcctggcaggagctgtctgggctgtggggtctcacagctgagggcccggtgggggtccagatattggagtcagtggcggtggccgggggaggagggtctgggcggttcagttttcgacgtaccaagaagtcaaggtaagtcgccgtggaagccagaggccgcaccgtcgccgcggcctggggtctggggcaggcgccgtgtgggccgcagtgccgggctcagccgtgtctggggctccagcatcctgggctgcttccagccacgatgtccctgcccaacacacctcttctcgcccgtccgcagatggacactgttggggacgcgtcctggtggtcacaaagcccataggagtggcctcacccgggaccccgcgtggctccgcgtggccctcagcccctgcccacagcttccgcgcccgaaccgtgacgggcctaacatttcagatgagtaaccttgtcctgatctcaggaatgaaatgaggtcacgggcacccaggaaatagccactcaccccctccccacctcctttcatttaaaagcagtttttggggaagacaccctccacaaccaagggttgctctgagagaggcaggaaggaggggatttcgggagcctggggcctactgggggctccctctcccctccccgcctgccttaccgagatgaggcaaagccacctgtggccccggaggccaggtccacgtggagtcggcgatgccggcggggaaggctgacagccgcccccataactgcacgccccccatgtccagcaaccaagggtaacgccagcctccgagacccaaacgatgtctgtgcaggctgtgcctgcagagatgcggcccctgcccgggcctgggctggaggccgaggggtccatgggagagcacaggctgaaagagggttctagaatggggtcaggtggagtctgcacactggggcgtttatttctgagacgcccaagcagccccaggggagatgaccagctctgggcggtgtcggggaggctgagtccagtccagggctctgcacacggagggtcccggcagggcgagtttggcattcctgcacacggagggtcccggcagggagagtttggcattcctgcacacggagggtcccggcagggcgagtttggcattccgtgccgttggggccgtgttggggcttctagggctgtggtggccacaggtcctgaggaggacagcaggggagggagaggggctgcggaggacggcaggggagcggagaggggctgcggaggacggcaggggagcggagaggggctgccagcctttctccagggcagaacttcgggtcacgcccactctggggagagcagagaggcctggcggggcggggacggagaaggcagctccgccaaacactgagtccccgtgatggtggctccttctggctgcggcaaggtctgagcgccggcgcacaaagcgggggcacggtgctggcagagtgggtgggacctgcctgtggccccgtttgcttctgttggggggcagctcccggaggctgctcgggcagagcagcagggtgggccaggaaaactgcaggggcctctccttgttggcccgtcagcctgtccgtctgtgtgaccttggggcatgctctgaggggtgtgtcccaggctgactcaagacagctaagccagaggtggggacgaccctggtgcgttctgggagccggcagtgcatcctgggctgcagcggagcgagagagaggagcccagagccggcagcaggagtttccgtttccctccgagtgcatgggatgctgcaccgtaggactcccccgtccagacgtctccgtttccccatggcatccagcccctgatgctcagaaattagcttcctgagtttgggagagttgggagggcaggaggcctcaggtccctcctggtcttctctgcccggcgctgggttcagggggtcaggaacttacgctgggcggagggtgtgcgtggagcccatccagacgcacacagaggcgtaggcaggtgtgggaagtcagccagcaccccactggccgtccccagccctcctccctacccgctgggagcagaggcacccagatctctgtccctgggcactgctgtgcgaggccggcacccctgccagggagcaggcaggagggacagagccctgcaggctccagatggcagaattcccggctctgagacaggaacatgggggtgcttcgcatcagcagtgcccagagcccctcagcagccccgggcttgtgtggaacccgtctgtgaactggatatggaaggaaggtccccgagtgcccacatttacagggaccctcagagacctcactcagacctgggaggcccattgctcacatggcctggctgctcccggtgggcagaagatggagaagccacagacagcgtcctgcgtggggtctgtgggcgctgacccagcagccgtgcagggaacagccctgcccgcagaagcggatgccggggcaggtggcagtgcaccccgaggaagccttctggacggagtggtggggagggcgcgggcgcatgtctcaggccagtgcacttcacatctcatcccacacctgcgggtttgagcttggtttggggtgccagctcccacctggccagccaccccttggggactcaccctgggctctcctgccaatcaaggtggagactttgggacagcactcctccacgtgaacagactgaccgagacacctctccaccacctccctcacactgtgcccgcccagccgccccctcccctggcccttggcaggaggctccttggcagctgacgggaggctcgggcactgccagatggccccttcgcaagtcttcggtttgtgtctaaccactttttccttggaaaagtgtggggtgaagagcgatatgggactccataggcagccgccaggtggtggtggcctcgctcctcctgctgccgggggctgccacggccacctccagggatggctgtctggcccgtctgtggaagcccatcaggaagcacccccagtgccgggcctcagccaagagcaccggcctggaaggggcagggctgggggacagtggcatgaggtcagacatggcgtggggccgaccccgcaggcagcccaccatccacagcctccatgttctgtctgcaaaatggggccacagtggggcctgggcagaggagagaactgcccactgccccaagcacggtccccagagagctggaggccagccagtcctccacacccagcccctccccagcagacccttcttccagtggggcgctgtgcccgactgggtcctctctgaacctctgccttttcgtcactgaagttcgtaggttcttgttcttgggaactgtgagttcaggcactaccagcacgacagccagagggacggacggacggctggacaggctggaggcccctgccatgggcactcaccccgtgggacagacagaaggatggatggacggttggacaggctggaggcccctgccttggggcactcaccccgcaggatggacagaagggcggatggatggctggacaggctggaggcccctgctatggggcactcaccccacgggacagacaaaggatggatggacagctggacaggctggaggcccctgccatgggcactcaccccgcgggacagacagaaggacggatggacggctggacaggctggaggccccttccatggggcactcaccccgtgcgacagacagaaggacggatggacggctggacgggccggaggcccctgccgtggacactcaccccgcaggacagacagaaggacggatggacggctggacaggctggaggcccctgccgtggacactcaccccgcaggacagacagaaggacggatggacggctggacaggctggaggcccctgccgtgggcgctcaccccgcagttgctgggcctccgtggggtcctgggaaatttttcagcagtccagtgtgcgggccgcgcctttgttctgtccagccagcggcccaggctgcgcctttgttgtatctggccgccggcaggccaggcaccttctgaggaagggttgctgcgtgtctgtggctcacggaggccttcctctgtgtgtgactcacaccccccacccaccccagcccacttctgggagcatcttcctgggggctttggaggcccatccattcttccctagggacaaaagtgcagggagcggcgtcccaggtgccaccgtctctggggaacgtgggccaggactccctttgctggacacagaccctgcccacactgggtgaccgtggggtgacctcacagggtgtgtggggttccgaagccgccaccctccttcctgagcctgcactttgacctgggactgctgagcccagaagggccttgagagggctggctcagtggcacgtgggggccttgggtggttgggtccccgagacaggccatctcgctccttgtgtggcaggctgcggggccctgcttgcctgggtcccacgtggtagaactcggcgtttggtgggggcctgctggggacaggaagggacagcaccccaccctgagctggcactcatgcttcactggagccaggcggaggggccgagggcaccggcacaaggtgcagacgtgtcggtccctttgaggaccgagatcatgaccaccacggagcaagcgcccgggtcctcagatcaaaggcccaatagccagtgaggcttctctgcactggtcccagcagaagcggggcctggctgaggcagtggcatcagagactcggggcaatgggagtgcgaggggggtctcagcgtcccacagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacgggcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcgggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagctgggggcgtcactgcagggcaccggcagaaactggggtctgaaaacagcagcccagagtggatttggaacagaacagggtgtcacagaaaggatgtttcatgaggtgggttttgatgagtatgtttaaataaatgtaacttaattgatgttaaatatgcatcttaatgcttttctaaaatgtgcaattgggccagttgcggagactcatgcctgtaatcccagcactttgggaggctgaggcgggcatataaactactgcaggtgacccaaaattcccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctaacctaattagtaaattggggaacatcttgggctttgtggccaacccgacctcccaggattttttttccccccagaactccatgagttcactcccagggatttagacgggtggaagtcacgctctgaaaggtggattactagaaatcacacagctttaggtctgttaaaggatatctgcaaaacaacaaacaaacaaaaaaaaacccagttaacaactttcttcctaaaaattattttttattgtaataaaacatttaacatgagacccacccttttaacaacattttaattgaacaatacagtattgttaactacaggtgtgatgttgtatagcagacctggaacatactcattttgcataactgaaactgaaactttatccctgttcaggagcaattcccttttaccctctctgcagcctctggcaaccaccattctactctccacttctatgagtttgacaacataattttttttcataattttttttgagataggatctcactctgttgcccaggctggagtgcagtggtgcaatcctagctcactgcagccttgacctccgggctcaagtgaccctcccacctcagcctcctgagtagttgggaccacaggcacgtgccaccacgctaggctactttttccattttctgtagagacagggtctcactgggttacccatcagcctggtctcgaactcctgggctcaactgatcttgccttggcctccaaaagttctggaattacaggcacgagccactgtgctcaagtgacaacataattctttttttttttttgagatagtatttgactctgtcacccaggctggagtgtggtggtacgatcttggctcactgcaacctccacctcctgggttcaagcgatactcttgcctcagcctcctgagtagctgagactccaggtgtaagacaccatgcctggctaattttttatttattttttggtagagatggggtctccctatgttacccacgctggtctcgaactcctgggctcaagcgatcctcccaccttgctctcccaaagtgctgggattacaggtgtgagccactgtgcccggttgacataattttttttttttgagacagagtttctctcttgttgcccagggtggagtaaaatggtgtgatctcggcccaccgcaacctgcacctcccaggttcaagctattctcctgcctcagccccccgagtagctgggattacaggcatgcaccactatgcctggctaattttgtatttttagtagagacagggtttctccatgttggtcaggctggtctcaaactccagacctcaggtgatccacccccttcggcctcccaaagtgctgggattacaggcctgagccacagcacccagccagcatggtctttcttaaaggctcttaaaagagggctcttggcccctgctgggattacaggtttgagccaccccacctgacctggttgacatagttttgaatggtgaagagaataattgcttttcccctgcactcaagagtaagacaaaagtgtcctctcttgccacttctattcaatattatgctgaaattctagttatgacaagtaggtaataaattgagaaaaactgcaaaagaagaaagatcatctctatatgcagatggtatgatattgtataagggaaaccctaaggaatccactggaaactgttagagctattaagttcagagaggtttcaggatacaacataaacatacaaaaatcagttatattttctttctttttttttttttttttttttgagacagggtctcactctgtcacctagactagagtacaatggtaccatctttgctcactgcaacctccgcttcctggattcaggcaatcctcccatctcagcttcctgagtggctgggaatacaggcatgcaccaccacacccagctaatttcttatttttgtatgttttgtagagacagggtttcccatgtcttgaactcctggactcaagcaatccaccctccccagcctcccaaagtgctggaatgacaggtgtgagccgccacgcctggccaagtttaattattttagattcttcaggcaagtggaatcatgtagcatttgtgtttctgtgcctggcctgtctcactgcatactgccctcaagggacacccatgttgtagcatatggcagcagtttcttcttttttaaggctgaacagtattatgttgcctggacacaccacactttatccatcattcatccatcaacgggcatttaggttgtttcccactaatctactttctgtatctatggatttgcctgttctggacattttctatacactaacagatttatttttatttgtttaaagccttctctctcaaaaaagtttataacatttctgagatataagtcacatattatacaattcacccatttaaagtgtaccttcattgttattagtataattacaagattgtgcaaactccaccatgatgtaaatttaggatactttcatcactccaaaaagcttgctcccctcccctccccatcccgccctgcctccacgcttccactgggtgaggaagtgtgtagtccctgagctgtctctgggactcacttttggccaatagaatgcggttgaggtgatgttgtgtgacctctgggtaggtcagaagaagccttgcagatcctcctggggctcttgctctggggaaggtgctagccaccctggggccgtcatgttgtgaggaagcctctgcgagcctcatgggggccgcgtgaagaggagaagagttgatgggctcccagcccatcagtccctccacctaccagatgcaggagtgaaggagccatcttggacacagccctgttgagtcttcagataattgtcggcagcctagctgctactgaaagctgatgcctaagcaacacgtgtgagaacgcccagctgagcacagtcaaactacctgaaagctgatgcctaagcaacacgtgtgagaaccgcccagctgagcacagtcaacccacagacacagcgaccatcacaagtcatgtttttgggctactgagttttgggtgctttgttttctggtggtcgacagtgcaggtgctgcattagactgggtacatgtgctcctcgttcctgttgccagaggccagggctcactttgaattcccaccctgactccccacattcacacccctcagcgtccccactgctcttccctgcctctctctctgctccttgttcccccagccctgcctgactgagcctcctatcccctctggccgggcatgcatgctatcgcatgggtcctctcgcttccagcctcgccctgcccattacagaggccaccatgcacccaggagcttccacatcctgcctgtggttctcacccgagacccctttaatggtctcggcgttcaaaagggcagcatgactggcactcgagctccagggctggctcctccccgccctctctagtgtccccctgggctgtccctggcctccccaccctccccgcctcagctccccagacactgggccgtgccccgcccctcctccccgtgcccggcgctctcctcgctctcccatccccactgggccgtgctcctggcagcaggtgtcgtgcaggtgtctctgtgaagtctccctggcatccctgctgtgcggtgtccccctggcacctccgtcgtgcccctaacgacgcccaccactctctgcgcagtgtgttcgttgccaggcccagctcttgcactggactgagagaaccaagttgacaccggggcacagcctgctcccccgctgagcctgccgcggcgcctggcacatggtcgatcacaaataaataacgagcaaacagcccatacgtgtgtactgcataagcagatgcatgtggagataaagaaagaccacccagacgacagcaagcccaggctctgagttcggagcttgggagcgccccaccctgagatcagcaggcagggggcggggcacaggtccctccgcttagggtggtggggatgctgtggggaaggcaggggcggctgatggagagtcaggtgtccggtggttggtgataggacgtgtttggcgtcctctggttggtcctgagttggaagtgggggcagaacacagagaaaaaagctctgcaattggctgcagaggcggagctgctgcttccagcttctttgtggtccggagtcagtagccttgtgggactggcccctgtccagacgcctacactgagcctctcatgtggggagatgagcgtctttctcctgggaccgaaggagggaacaagacggagaaggaagaggcggggctgcgactgtgcccagcgtgctgccgggctgccgggtccctgctctgggtacttctctgctttcgggcgtctcgtctagaagctgcagcttggcctgtctcacctctacacagaggggctgctggcgcctgacggaaaaaggtagggccgctgaatgtccacgcagctgtcagccaccagggaagttttcagcaagggaggcccaatctcacgagtcactcgcacgtcctgtcctcggggtgtcaataggacgtgtgcacagcccagagcccaggatcgaccctgcggcggaaccagctctgccctcggccggggtgccctgtggggatgaccccacctgccaggtgcccggcccggccctgctgggccgccgaaactcagaagggtctgggcaggggttacagcaccagccccagggtcttacgctcaaaacatgaaagctgtggtttcgcagacgatctatggagatttgcaatgtctttgacaagatttagcatcgagctttttacttagctgattgaactactataaaaacaaactagatattgataattgcaggaaaaactgaagaagggtctgatccaagagatttttaagcaaatgtcccggaatagagacccccatatatagaacatttgaaaataatgagcttccatcccaggggcaacagcacctccagggcactcatgaggtctgcctgtgacctttgcttttattgtggtaaaatacctttaacataaagttgaccattttaacaatttttttttgagatggagtctcactctgttgcccaggctggaatgtagtggcgtgatctcggctcactgcaacctttgcctccagggttcaagcgattctcctgcctcagcctcctaagtagctgggactaccgggatgcaccaccacacccagctaattttgtatttttagtagagacagggtttcaccatgttggtcaggctggttttgaactcccgacctcaggtaatcgcccaccttggcctcccaaagtgctgggattacaggcgtgagccaccccatgcccgggccgtcttaatgatttttaagtgcacaggtcagtggcatgaagcacattcacgttgccgtgcagccatcactgccatccacctgcagagctttacatcttcccaaatgtcaaccggccccatcaaacaccaacccccacctgccctgggcaccaccatcgtactgtctgtctctgtgggtttgacgactctggagacctcacacgtgggatcaaacggtatttgagcttctgagaggggctcgttccctcagcatcaggtcctcagggtggctgtgtggccctgggtccgagctgccttccatttctgggaccactgacgtcccattgcgcgtacatatcacattcggggcaggggtcatgtaacacattcgtccaccctctggccgttgtgaaaaatgctgctgtgaacggtgtgacctgtgacctgttagacaccggactttcccagcacaggcagctgcctgttcctgggctgagcagggccctttgatctgtcaggcacatcgtgctccatttggaaacgaagcctgtgaactttgcaaggacctacgaaaaggtttgagaccagaaaaaaatttttcctggttccaagtacaggaaagatactgcaagcttgaaatttagaaaagttctagttgtgattcaatttagcttttatgtagttacattaaaaattatatttaagacgggcacagtggctcacacctctcattccagctactcgggaggctgagctgggaggatcacctgagcccaggaggttgagtctgcagtgagctgcgattgtgccactgcactccagcctgggcaacagagcaaggccccatctctaaacaaagttatattgaacaggcttgatatgattggaaacagggcttactaagtttgcctgatggctggggatgtggccattcatcttggaaagtgtcgacatgactcatttgtctggggtcagggctccaggatcaggtgccaggggcatctaagacctttgacctttgacttcctgtgagggaggtaaaatcagttcctgacctcgtggtgctcacgcagtggcaggaaagacaggagggagtgctgggagcggggaggctgcccagccgcaggcagaggtgtgggtgcggggactgctcacgtggggaggccactgccggggctcagctgcccctgcgatgggcatgggggaggtgggcatccatatttgggttcctctggctggtcttgagtgtggagtggggtcactgactgagtcctgatctgctgcggcttccccagcaggtggctataggttgtggccagagctccacctttcccctgagtgcacgcgagataacatgaggaatttaagaaaaataataatcaaggggattcaagagacagagacagagagagacagagacagagagagacagagacagagagagacagagacagggagacagaaagagacagagagagggagaggcagagaaagagagggagagacagagagagacagagacggagagagggagagacagagagacagagacagagggagagacagagacagagaggcagagagagacagagacagaaagagacagagacagaaagagacagagagagggagacagagacagagagagggagaggcagagaaagagagggagagacagagagagacagagacggagagagggagagacagagagacagagacagagggagagacagagacagagacagaaagagacagagacagaaagagacagagagagggagacagagggagagacagagagacagggagagacagaggcagagacagagagacagggagaccctgcccagccccctggccctagcgcagccctgagtgatatgtggtctcacagcacggggtgagggagccgagggggaggccaagggtggactttctttgtgtggacttcatattcgcccttcatcttacataacgaatggtttatcttgttatcgtgcatggtgttcattttctattttctggttatttatggccagtgtggagaaatcgttttgaattttgtgttgatcttggtctggcctctcctgtcagttttcatgaattgtggagtctactgggttttcccgtatggctttggaacccaggaggaaaagagagaccctcctaatgacgtctccgcctgggcccggctggaagagtcccgaggaagggttcctgtcatccaccctgtactgggccggtcgctgtggtgggggcagcgccgtccgggcatggggctcacaatgagcatagcttggccgctgaccacacgcagggcaatgccgctgcttcatctgatgcccgcactgctgcggggctgggcagcaagggcccctccaggagggaccccaggctgaggcccccgctcccgctcacagcaggtgctcacgttcaaattcatcaggggaaccactgtccgctgggaaaagtcttcttcaaaatccatttttcacgttttgcctcgatgtgttaaaaaaaatccattttccatgcagtgctaaaaagaaatgagtcattatgccacgaaaagccacagaggaaccttaaatggcacttagtgaaataagccaacccgaaaaggctacagaccgattccaaccaaacgggattctggagaaggcaaaaccaagctgacagtgaaaagctcggtggctgtcagcagctggggagggaggagcgaatagacggggcacggggatgtttagggcatcggatcggctttgcaggatactgaaatggcagttatgagaacgcactcacccaaacccgcagcaggcacacaccggctgagctgtggactccgggtgatgatggcacgtccctgtgggtctatcaatggtggacagatgtgtcacacgagtgcagcatgtttataataggggaaactgaggcaggggaaaggaggtggcatatgagaattatattttctgcactttttttgtaagcataaaactgctttagaaaataaagtccattaagtttttaaaagtctgtcttgcaagagaaaggatcgggaagggatgggaagggagtggggaggccagcaccaggtgccaggcaggacaaggctggcgtggacacactcccacacaatcctgggtctctgcaggtccacacacccgatggccggcccggggtggacgctgctgctactgctgctgctgctgctgctgctggggtccatggcagggtatgggccacagaagaagttgaacctgtcccataaggtgggtgccgggcacccctgatgcccctgcaggccccacacgcgccataaggtgggtgccgggcgcccctgaggcccttgcagtccccacccgcgagggctgccactttccgtcaggagggtctcaaagggacacaaagcgccttcctggatgaaaccctccctgaggctacactcgctctcctggccacacgcccggctgtgctgcccaggcacacttgaggctatgggacggcgaccccagcaccaggagcagccctggggccaccacagtcaccgtcaaccaggcaggagagagcggggccacatgggagctgcaccagtgcgcacttctgtttttgaaaatatacccatttttcttttttattttattactttttaaattgtgtgcgtgtgtgtgtaagagagagagagagagagagagatgaagcctcgctctgtcgcccaggctggagtgcagtggcacgatctcagctcactgcaaccttcaccttctgggttcaggcgattctcctgcctctgcctcccgagtagctgggattacaggcgcgcgccaccacgcctggctaaattttgcatttttggtagagatggggtttcaccatgttgacgaggctgttctcaaactcctgacctcaggtgatccaccggcctcagcctcccaaagtgctgggattacaggcatgagccactgcgcctggccagaaaatatacccacttttaataaaaagttgttatttatgttaacatgcaatgggattactgtttttatcttaaaattctctcagttttagggtggaatcctagtaacgtcaatagacatagcctcatccacaacactctgagcaaacaagaccagaggtcgcgcacacagcagcaccttgcgtgtgtgtgggtggggggtggctacaagccacgtggtgctaggggggaggcctggctctcagctcacctctgccagctgtgcaatcctgggcaccttgctcgccttccctgagcctgtttcttctcctgtaaaatgccaggcactgggctggcctgagagcttcacccatgctctgctgctgcatccttgccctcagtgccttggtttaccctcttccacgtggctcacagtagacattccctttctcagccccgggcccccagcactgacctgccagaaccacggcagtctgggtttgttccagaaacttctcaggaaacccaagtttgaaggatggtgacacaggggagccaaggagagggcaggcctttcctgagtgctgagtctgcaggccctgcccaggaacaggtgagtgagctggtgagtggcgtttcagggcatcggggagccatgcgggagacacgaggagtgccagagcaactgctgtaccatcaacagcctggccccacacacgctctgcacccctaagaccatcttcctgcagtgcctgccctggaggaaggtgaggtgcgtgcaggggcgggggtggaggagcgagactgcctgtggccccctcctacctgcccctgaagagccagggagtggatggtgggtgcagggatgacgcatctcctgtcccatagcccaatgggtacagatgctcgcacgactcagagtgccagagcagctgctgcgtccgcaacaacagcccgcaggagttgtgcacgccccaaagcgtcttcctgcagtgtgtgccctggcgcaaggtgagctggggcacccggggcagatggagcaggggtagccggagacagcccctctccacgactgctgcctggctgcctccccagcccaacggcgacttctgcagcagccatcaggagtgtcacagccagtgctgcatccagctgagggagtacagccccttccgctgcattccccggaccgggatcctggcccagtgcctgcccctggtaagtcccgggcgggggctcagcctccaggccctcccttggccgccacagggaagtcgcacagaaacacagcaactggaccgggaccgcggctgtgagaggtgggctctgagcacccaggcacccctgctgggagaggccggcgcttcaccgcccatctcataaggtgggggccgcagagaaggctcctgggctggcactgagcccaccaggccccgcagggcacgggtgcccggtcagagaccgtcagagcctgcggagccgcggggagggggacccaggaccatcccccgtgggagctggggttggacgtcttcaggccggagagggaacagcctcaccagccctggaggaggagggtcctggcttctcccctccctcccccgacctctgctgtggcttttcctgacgggaaatccatgggacaagccgtgctcggtgcaggctcccgctctgctgagccctggggccaggggagggggccaggtcgccagcggcgcaaacgcggtgggggcgcaagtgcgtgtttgctggagcccagagctcccgtctggggtgaaagggtcgtggcacccagaggtgaggtttgttcacagccctcgggtaccaccaggcgccctcgtgggcgctgggagcagctccgggcgcctggcgcggctcgtgggcatccctctcgcgagctgagcgtgggcgtcggcctctgggtgctgtcccgacccccacgaggctggtgccgggagatgctgtggccccgggttcccgtcctccttccgcggccgcttcgaggcccgtcccctgcacgtttcctcagctttggcttctccttcagtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcaaagtgtctgtgagaacaaatcccaggcactggggtgtagcctgattgttaaacatcaataaaggctcctggccgactgagcagccgtgtctcaccccttctgtgttttgaataataaaagcataaaatctgaaggaaacctggaggtcacagagaggtggcgtcggctgggtccgtgccagagcggccttctgggaagcctggggaggcacaggccatgctgtgggaggcgaggccagggccagagtatcgggtttgctgtcacctccccacactgcaggggcgtcaaataaaggggtgcaagcccgtgtggtcaccgcaggtaaaaatcgctccctccctgtccctggcacgggcagtcctcagcacataggcacccgcgtccgggacgcaagcccaggccccttccccttccccaggccctggctgagcttccatggtcacctcccctcccctcggaggatccctggttcaggccgagaactcttctggccgctgactccccagggcagcactgggctctgcgcggctgggggcgggtctctctgcctcgttcggtttctgattccatctgcctgaccttcccggaaatgcctccatccccagcccaccccatccctgccgttttcagcctgggctgctgtgtatttgtttttgtcttgttcccgagtccttccctggcacgtgggtcttcctttcctaactaatcataaacgatttccatctctgtgactgccggaccatctgaggctcccccaggagagacctgcaggggcaggaacacctggccgcggtcaactctgcacagcctgaagttacatagttttggcgacttccttaagaaaagtcatatgacattatgaacacagtgttaggcctaaaactgaacatacttacggtgaaagacccagcacaccatgagtgtaggaagctcacataggcagcatcacacacagaatcggaggctcacacaggcggcgtcacacacagaatcggaggctcacacaggcggcgtcacacacagaatcggaggctcacacaggcggcgtcacacacagaatcggaggctcacacaggcggcgtcacacacagaatcggaggctcacacaggcggcgtcacacacagaatcgcacagcacgttttttaccctaaagttcctgactgcacagccttggatcacgtttacaaaacggcaatttggtaacgttttctatgggagaatggaaaatcaacttagtcttcccacggatggggctgagcgatgttttctatggatacaagttgctcaggtgtgaacctccctgggcgtgtgtgggcgacagacacagccgccatcacgcgattcccataagaggtcaaaacaaacctccatcctgattagaagctgctgagaactgaattttccacgcatacctctacctgtctgaagccgtcccacaccccagtgtctagatccggaatcttcaaacaggattgcccaatgccagcaggacacgtcggagacaccatcaggctcctaccttcatgttgatgtcagatgggtgagcccagcacgggggccatccctatgtgggtgagctgaggtttgcaggctgtccccacagaggtgagccagggctcgggggccgaccccacgggggtgagccagggagtgggggccgaccccatgggggtgagccagggagtggggaccgaccccacgggggcgagccagggctcgggggccgtcctcacgggggtgacccagggaatgggggccgtccccatggaagtgagccatggcacggggcccattcccacgggggtgagcccagcaacaccagggaaaagcttcctcaactcaccttccccacaggtagctcccggctgcttggcgctcctcctcccgcagagataccggaagcacacgggggccgtgccgagtagggacaggtcttgacccagtacagtgaaaagatcttattttcccaaacttcacagaaacatcaaccgtgtgtttgtcagagtcagttggcggcagacgccacaccaacatggggacaggggcgtctacggtgaggggttgtgcgctggttccaggaggagcaaagtgagcccagcaggcagcccccagggtggatgcagaaggggttccctgcctggcgctcgggagacggtggggccacagccactgatttggagaagctctctgggttgaggccgggggcccacagcggggccagcagcactgtgcgctagagggaagcacctctgggtctacgcggccaggggagccactgaaccgggaagcccccgctgcacccacccatggcagaggggctgccggtgggcagttccagaaccatctatcagtgtgaggctgccggccccaggataccgatgatccccccatctgtccaaacccctcgaatcctgtttgttgtcatgttgggtcaacttcactatgaatttggaagtctaagaaaattacaaaacgaaacaacatcgtgaaagggcgtcagacgccaccgcttctgagtgcgcctgtccgttccttccacatgggcgccctctcccgggcctctgcctggctgttccttccgcatgggccccctctcccggccgctgcctggccagagtgtggccagggtccgcccctgctcctcagggacacagccttgctgtggactgatcgtgtcctcgcattcatgggttcaggccctgagcctcagcgtgacgggactggagtggggttctgggaggtgactgaggttttgatgaggccgtgaggggccttacgagaagggaattcacgcccttgtaataagaggctccaggtgaccatggtggtaaacagtcacgcactgtgagaaaaaagagacaacagagccgagcgtgccagctccccctgccctgccatgcccacctgccgggggaggacgccctgggaaggcagctgcctgcaacccagaggggggccctcatggagcttgtcctgctggcacccggatctcaatgtcattattttagctgctgggtgtgtggtgttccgcacggcagtccaagaaggctgagacaatccttgtagcgaaatcctgagaaaccgttgcttccaccctaacagtgagaacaagccagatacgccgcaacgtgatcgttgttattttgaccactcatcctcaagttctaacaaaatgataatttttaaaagacagaacagaataggtaaacataacccatcaaacttgaaagcatctggaagaagtgtggctcccagcacttcgggaggctgaggtaggaggactgcttgagcccaggggtttgagaccacctttggcaacataccaagattccatctctacaaaaaatacaaaacttagctgggtgtggtggtgcatgcttgtggtcccagctactagggaggctgaggcaggaggatcacttgagtccaggaggtcgaggctgcagtgagctgtgattgcatcactgccctccagcctgggcaacagagcaggaacttgtctgaaaagaaagggccgggcgtggtggctcatgtctgtaatcccaacactttgggaggccgaggtgggcggatcacaaggtcaggagatggagaccatcctggctaacacagtgaaactccatctctactaaaaatacaaaaacaaaattagctgggcatggtggcgggcgcctgtagtcccagctactcaggaggttgaggtgggagaatggtgtgaacccgggaggcagaggttgcagtgagccgagatcacgccactgcactccagcctgggcgacagaaggagactccatctcaaaaaaaaaaaaaaaaaaaaaaagaacaagttgtgttggtttggttttccgggttgttttttctgcatgaactaacttctagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcgagcttggttcgctgcagtagttcttaggtacttacttcctttttttttttggagatgaagtcttgctcttgtcacccaggctggagtgcagtggcgtgatctcggctcacagcaacttctgcctctggggttcaagtgattctcctgccttagcctcccaagtagctgggactacaggtttgcaccaccatgtcctgctaatttttttttttttgtatttttaatagagacagggtttctcctcattggccaggctggtctcgaactcctgacctcagacgatccacctgcctcagcctcccgaagtgttgggattacaggcacgagccactgtgcccggccatcattcctttttactgctgactaatagtctgctgtgtgaatccaccgctagaaacccactcatcagttgatggtcatgtgggttgcttctgctattcgcttattatgaacagtgctggaataaacgttcctgtgcactcttgggcatacgcctaggagtggaactgctgggtcaaatggtgactttacgtttaacgttctgaggagccgccaggcgttttaacacagtgactgcaccatttcacattcctgccaacaatgtgtgagaattccaatttctctacatccccaacattttcctttaaaaaaaagaaaaaagaaacatagccatctaagtggatgtggagcagactgtccctctggtttgggtttgcgttgcttttatggctcatgatgtctgagtctctctccatgtgctcatggggattcgtatatctactttgggaaatgcttattcaagtcctttgtccacatttgactgggttgcttgtctttttatttcatttactacgatgacagcccctacatggaaggattttgtttttgtaatcccattaccccgaggtgagaatgaattgccagttgctcaaggccttcagctcttagggaggagcctggacctggagctgctccgggctctggcaaagctccaatcccggcctcagtccttgaggcctggtcctcacccagctttctccttccaccgtgccatggaggaagcccgacctccctgcacggctggcctggggttgttcacgactgagtccaggtgtccccagaacggatgtcactggtcacagtgttcctggtaataggtgaccccaggcacagggtgttcctgatcataggtaacccaggcacaggtgtcccagtcacaggtgtctccaggcacaggtgtccccagtcacaggtgtcccaggtcacaggcgtccccaggcacaggtgtccctggtcacagatgtccccaggcacaggtgtcccaggcacaggtgtctccaggcacaggcgtcccaggtcacaggtgtccccggtcacaggtgtccctggtcacaggtgtctccaggcacaggtgtccctggtcacaggtgtccccggtcacaggtgtcccaggtcacaggtgtccccaggcacaggtgtccccggtcacaggtgtctccggtcacaggtgtccccaggcataggtgtccctggtcacaggcacccatggtcacaggtgtccccaggcacaggtgtcctggtcacaggtgtcccagtcacagctgtccccggtcacaggtgtctccaggcacaggtgttcccggtcacaggtgtccccaggcacaggtgtcccggtcacaggtgtccccaggcacaggagttcctggtcacaggtgtccccaggcacaggcagccacaggaagccgatgcagggaacagagagaaacagagacacaaagaaaagagagtgagagacagaagaaatgggaaacagaaatggttggagaaaagcatccagtagagatgaagagagaggaagaggaggagggggacgggcagcagagacccagggaggctgcagtgcctggacccctcaccacactttccattctgcccttcctggggaagacttccagaaaagtgggccaggctgaggggacgatgaggacacagaggccccaggggagggagggaggagcgggccacccggaggggctgtggtcagctcaaagcctctggagtcaaggataaatcctctgacctttgacctccgacctccctctccttggctccaggctccccacacagctttccatgaccaaatcttacaggaagctgaagggcagtccggtgagggtctgtaagtcaccgccagggcacagaacggaggttggcaggggaggagagacccctgggctgccgtctgccttcaccctgcacatcaggcctgtgtgggggtgtcaccatccttcactccctggcatctgatccaagattacgcctggcagggcctctcctctgggattagctccgggaaagctcccatcagtgaagggaggggctcaggctctgtgcacacaggggtgcccccttccagggagggagcagctctcccacatggcagaacactcatttcctgtcagtgctctcctgagcacacaaggattaaactgagcagcaagcactccaggtggccgagaggccctgggggatgggccccttgccctggcctcccctgcaaggcagctcccgccccggggccctgcctctgagagcgaggtgtgcaggctcttcctatgggctacctggcccatccccagaacggcctgcactgtccctccccgacctgcacccagacatggacactcaccctccccaacccctgagacattcaggtccacactggggcctgggccccctcaagttgcatggggactggggtgccttggcgcctcttctgtgagtattcctacacacagagcctgcttcctctccaacctgcacctaaacatggacactcaccatccccaacccccgagactttcaggtccacactggggcctgggccccctcaagttgcatggggactgggctgcctcggcgcctcttctgtgagtgttcctacacacagagcctgcctcctgtccgggtgatgttgggtcgtcctccgcctctgggagcacctgcaggggctgttgctctgggctccctggagatgcaagcccccgggcctgcctgcctgttctgtgtgtattcactaagcccatgccagcgggggtctccgcaagaaacaggcacaggctgtgagggggctaatgaggcctgacttctccaggggcaggcaggacgggagcccatgagggttgctgaggacccagggatgtgcactgtgggaagccaccaccacccagaagccggcaagggcaagggagaagttagtggtgccagaacatggctaaacgaggcagccatggaaaggggatgcagacaggaagtggagaggaaggcggttctccaggagccctaggacctgctctggggctgctgctgctgagcccaactgggaaccagagcacaggataatggtgacactggtgatgatggcgatggagatgattatgatggtgatgatgatggtgatggtggtgatgatggtgatgatgatggtgacggtggtgatggtgatggtgatgatggtgatgatggtgacggtggtgatggtgctgatgatgatggtgatgctgatggtgatggtgacggtgatgatgatggtgacggtgatgatggtgatgatggtgatggtgatgctgatggtggtggtggtgatgatggtggtgatggtgatgatgatgatggtgatgatggtgatgctgatggtgatgatgatgatggtgatggtgatgatggtgatgatagtgactgtgatggtgatgatggtgatggtggtgatgatggtgatggtgatggtgactgtgatggtgatggtggtgatggtgatggtggtgatgatggtgatgatggtgatgctgatggtgatgatgatggtgatggtgatgatggtgatgatggtgactgtgatggtgatgatggtgatggtggtggtgatgatgatggtgatgatggtgatggtgatggtggtgatggtgatgatggtgatggtgatgatagtgatgatgatggtgatgatggtgatgctgatggtgatgatggtgatgatgcttatgatgatggtgatgatggtgatggtgatgatgatgatggtgactgtgatggtgatgatggtgatgatggtgatggtgatgatggtgatggtgatggtgatgctgatggtgatgatggtgatggtgatgctgatggtgatgatggtgatggtgatggtgatgatggtgatgatggtgatggtgatggtgatggtgatgatggcaatggtgatgatggtactgataatgatggtgatgctgatgatgatggtgatagtgctgttatttaatccagttcagattcctagttaggctcccctgtttctcctcaggcacactgtgggtcactggctggtatgtatgggtggtcagaatgcctgtgtccaatctgtgttgtactctttttctcaaagagaactcagctatgctttcacaaggagggggttgtgggaggaagagtctgccaggagagaaagctggatatgctggcaccaggaaagagcctcttagtttactgtccccaggcagcatccccatccacatctgagctcaccttctgggtgcttgcccagggggccttttgaatctcagcatctctggaacaagactaaggctgggagacatctggagtggagtttctgtccagcaatggcaagttccctgctgaagctgagaatggggaaggcatggctctcagggctgagcgcccttgtgctgggcggttcacccgtcagcaggaagggggagggcactttgctcttcatggtcagccttatgctgtggggatttcctgaagagcgcaccttagtattttgccacccagcttccagtcattctttgggttaatcaagaatgcattcagctgcaagtattagaaaacctagtaattaagcaacaaaggcttttgattctcttaatcagaagctccgagttacagtatttgaggctggttaaccagttcacccatgttttcaggggtttgctctgccatcctcagggtgttagatttttacctaactgttttggtgaggtataacacactaacagaaaaatgcacagctccttgaattctcacaaaatgttgtgtgttacatgttacaaatgtaacaatcaggaaatagaatattactagcagtgttggcttttgtttctcctacttgatgtcttattgacccaacaaggctgctgcagctccaggcatcatgtccacattccagcaccctgtgcagagaggcaagtaagcagtggtgtagcagccagagctcccacctggcttctcaaatctcattgaccagaagagtgtctcatggcattgcttgtggtgaaggaagctgggaaagtggaaatcaggcaaaggggatggatttactgtgactgtctcaacccaaatagaattcatcacaaggctgggggatggagtctatctttcctgagaccaagaggtttctgcctcttattggaacaaaactggggttctctgagcaggacagaggaggcgcgggtggctacgtggtgggcagtagcactgtgtaccatgccctgcctttggcaacagtttcccattttcctctgggaaacgctgctctcctgtgttccgcccatgaagttagggaggttcaactccatccttgggtccaggtgtgagtgtgtcccttaggcgttgccagtgggagcaccccgttcctctttgccccacgattggcccagtcttggggcatggcccaggacctcgatggcagtgagtggaataaagttccctccttccctcaggtcttggggcaggaggtgtaggcttgggtttttgtgtgctcgcatggaggatggtgggcaaagacacagagagacaaagaccggaggacaccggtagcctctggatgcatccatacttgaagctgacgctgctcatggacttcacagatgcacggttcattgcattccctcactgcgtaagctgagttttctgccacaggccacatcttactggaagaatgctgtctggaatgccactatcacctaccagagctgagggagccacagaagggggatgcgacccagttctccagctcctgggcctcgagccctgatcctccctccccaggctcctggcggcccctcactcagggctgaggccacgaactgcctgctcaggtcaggagacagacttgaggggtctggcacccacagctgtcaggaaccaagctgtccttttctttgtttatacatcaaatatttcctgagctgccctgaactccagcatttatctcaggttatggagaacccacaggtgaacgagcttccagacacccgtgtctctgaatgttccttttttgctgttgctgcaaatggcagacacccaactttaacttcaactgacttgggcagaaaaagggccacactggaaggatcctggaggttgtccaattggaggaaggctgaacaaagaactcctcaggaggtcaggtgtgggtgggcctcaggagcagctggaaggggggtgcaaacgtgcttcatgcggttaggacttgttttgttttttgtttgtttgttttgagatggagtctcgctctgtcaccagactggagtgcagtggtgcgatctcggctcactgcaacctccacctcctgggttcaagcaattctcctgcctcagcctcctgagtagctgggactacaggcacgtgccaccacgcctggctaatctttgtatttttagtagagacaaggtctcaccatgttggccaggctggtctcgaactcctgagatccaggtgatctcgcccgcctcggcctcccaaaatgctgggattccaggcatgagctgccgtgcctggcctatggttaggaatccgtagctgcttttgctgctgcgtccctctgtctctctgtcccgtgtctttccaggcacagcctcttcccaggcggcgtgaaatatggaaacgtgccctacagcaccccctgttggagagaggtgagctttcttccacaacctggttccaaagtcccagggaagggctctgattggcttaaacagcagtgttgttgagatacgtataattcacatacacgatttacccatttaaagtgtaagattcagaagtttttgggattattttttaagaattgtaaaatatatatggcataaaatgtgccattgtaaccgttgtgaacgtgcctggagtggccttaattccagtcacactgttgtgccgtcactgccaccatctgtttctgagtctttttcattgccccaaaaagaaaccctgtgactgttaaccaataactctccattccctcctccgcagcccctgctggcaatggataattttttggtttcatgcaccttttgggatgaactcatgtgaaaaatcactgttttggccaggtgcagtggtgcacgcctgtaatcccagcactttgggaggccgaggtgggcggatcacgaggtcaggaaatcgagaccatcctggctaacatggggaaaccccgtctctagtaaaaatacaaaaaattagctgggcgtggtggtgggtgcctgtagtcccagctacttgggaggctgaggcaggagaatggcgtcaacccgggaggcggagcttgcagtgaaccgagattgcgccactgcactccagcctgggtgacagagtgagactccgtctcaaaaaaaaaaaaaaaagaaaagaaaaaaagaaaaatcactgtgtttctctgacgttctaatttaattggttatcctgtcttttacccggcaactctgcctagcagggggtgggggccgtgagccacagcaccctccataacacagtctgctgctttgggcccagcttagggggctgaaaggtgaggcctgggtgagcacagggtccacacggtggtccggcatggtggcaaggccagggagggcctgcctgggatagaggtgcgaaagggggagagacaggcggagaacgctgcacactcagcactcggctctttgctggagactgggttttctctggttggtttttgtgttcatgagtgtcgtgggcactggatgcccccccgaccctccccactgctgggaacgctgggacgtcactgcatgtgtcctcagccgtgtcctccccaggactgccctccgctgcagagagcccccctgcacaaggttacacccctcccaaggtggtctcagcctggggcagtgctgacagcgtctcagcccagggcgtcctgtgggtcggccgggccggttgggtcagctgcactctacacaccctgccttcctcacctcctacatctgcctcctaagatcacgccctgataaacctgctcccagcccagctccttcgcagggcctgtctccaggagatccaagctaagacccgaagtacgtgggcggctttgggagttttgctttctgtggctcctccggccgctgcttccacggtgacgggcctgagatgggctggctgctgcctctggcctttcctcatgtccgccgctgtccgcgtctgctttttaaacatagataggatcatgctttgagtttataaagggacaaaaatgtcctgtgccttccaaaggttcagcagacacaaaagcctttgtgtgctgagcagtgcggaatagaactagaccacacaaaactggagaaatcgggctgggcgtggtggtggcacctgtggtcctagctactccgaaggctgaggccagaggacggcttgagcccaggaattccagactgcagtgagctaagatcgcacctgcactgcagcctgggggacagagcaagaccctgtctctgaaagaaaaaaaaaaaaaaaaaaggaatttcaagagaaatttgataaaacccatcacaggggaggcatcctgccctctccggacaggacaggtgcggtggccattggccattctttgcctacccagcatctgaacccatatcctgtgtagggaattctccacctcacgggcaggtgggacgcagaggcagtgtcttgctgttaaagccaaaagtgtgatgctcagtttcctgccccccaacccctgaggtcccaggggcctgtcccaggctcagctttcgggcaccaccactcctggacaatgagctgggagcggacggcatggagggtgcactgtggtggggtggacccagcagagtgcagccggggcctgaggccagcacagggctgaggtgctgctggcagcgttcatatttgcactcagccactaaccccaacagatcactccatccctcggcctcagtctcctcacctgtaaagggggaggatagcagcacctccctcgtggatgctgcaaagaccagatgagttaaagaagtgtggagaagagtgccagacacacagggaatgctacgtgtgtgtgggaaatgctcaatcaatactgacagcacacagaatgtttgaaggagcggaaaccggattcgatatatacctgtattcataaggctgagatttcaatacgtattttcatctctctctacttaagatatgaagcttcacagccatctgtccacccacctgcccgcccagccacatcacccgcccatccactcacccgcccactcgctcacccatcacccacccacccgtccacccacctgtccacctacccacccgtccattcacccacccacccactcacccacccacccgctcacccgcccgtccacccacctggtcacctacccacccgtcaactcacccacccacccgctcacctgcccgtccacccacccgtccacctacccacccgtccactcacccacccacccgctcacccacccacccgctcacctgcctgtccacccacctgtccacctacccacccgtccactcacccacccatccgctcacctgcccatccacccacctgtctacctacccacccgtccactcatccacccacccactcacccgcccgtccacccacccacccactcacctgcccgtccacccacctgtccactcacccacccacccgctcacccgcccatccacccacctgtccacccaatccactcacccgcccatccacccacctgtccacccaatccactcatccacccagccactcacccgcccgtccactcacccacttacccactcactcgcccgtccacccacccacccatccactcccgcacccacccacccacccagccatccactcacctgaccgcccggccagccagtgggtcacattattttatctgtgtcgtggacgctacattcagaccggcctggaggaatgggggttgaggaaatgacgaggaggaggggggggggggtgggggggtagggagggggcgggggcggggggggtggggagtgagaggtgggctggaaggagttggggagcgcgggggggtgggagaggatgggggggggagagggagggggagatgtgggtcgtgggagtaggtggtggcgcgggagtagtggcgggagtggagggggggtgaaaggggaagccgtggggaggggagagtgataaaggagggacgccagcacctagtgtggttggggtttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatttgagttcgactgcaagtagttcattcatgggatacaggcgtgaaccactgtgcccagcctgaagtttctgattatagacatacactgtttgtttatctgatctccgaagatgttcagatgtgtgaccccagtgaagggcaggggctctgtagacctcctcaggggcttcctttttgggctcccccccgggtttccctggctgtcctggggaaggcgtccccaggtgccttctctcctttgatccatttccaggtgtccagatggccaaccagggaccagccgccatctctggagttctgggctcaagtgctccccagggaccagccgccgatgctggagttctgggctcaggtgctccccagggaccagccgccgtctctggagttctgggctcaggtgctccccagggagggcttgctttgggaaccttctcttacagaagaaagcagctgggctacgtgctggatgggaagcccttgggagggatggtggttctgggggtggttctgggggtggtttctgacagatgcgtacttgcctgcttgcggaccgggctgtgtgtctccgggagcacgcatcacagtgaccggacatcccacccaggactccgaacctccctggggcttgccagggccctgggcagagcttgcagcacgaaccccaccccccacactcccactgacttcttggtgtggtgcaggttggacctcctgtgcttgtttggtttttcagtttgtgtgctcacacatctgccctctcttgccccgggcaggatggggtgctttggaaggtagagactgcagcggttaggagacctccaggccagtggcctgcagagctcggaagtggagggaatggctgggttgtccggacggtggccgccagccacgagtggctcaagcctctgcagtgtggcaagtgcagctgaagaactggattatacattttacttacagactttaatctaaaatataatagcctgtggggctggtggctaccatgctggacagggaagttctagaccggctcgcctgggccccagcctcagctgtgccacccacttagaatattttgggcaaatgatttaacgtgcttccatcgtcccgtctataaagtgggggtggcgtggcgatgaggcgtcccgccgtcgggggtgtgaaagcccctgggtgtgtgtgaatcggtgtgtgagtcaatggaggcctcagacccacgacgggagggaggtgtgagcacacacagctgagcccaccccagggttccccacccctcacgtctgaggttctctggggctggtcggggaccacactctgggaaccatgggtttgaatgcaccacagtcagggccctggtacaatcagggccgtaggtgggtgctcatcaagccctccagcccctccccaccctcttccccagctcttgccagcaaaaccccttttctctccactctgctggaggcccacagctcctgcccacaactccttcccagcccctagggctcagctctctggccccaccaccagcccaggtccctttcctgctcacgccacaccccttagctctcatccttccaaccagcccgggtccctttcctgctcacgtcacaccccttagctctcatccttccaacccgcccgggtcagagccctgagtggtgctatgagcatcggtgggctccgggatggcacatcagctcctccatcgtagccactggcctttgctttagagagtccttccctgccatctgtaaggctctgtgcaaagttaattgatgtgaaattgtattcaaaattcaatttggggcaacggatccaaattaggctctataaatcagctaagccatttgccctttgggtttcaaacttgcctgtggggtgacagccaaaaagtagaaagtatgttccatttcttgcagcccccagccccatctgtgagccggctgtcagctccagccctccgcatgcacccctcttccttcccgtaatggcacctcagtgtattttggatgcatagtctgctcttgtgggtgccgtctggtgacacagcaggtcctaaggccccatgctcccctagaaaaggaacaaaggaacgtcagtcagctcttgcttggagaacgctgtgtaacaaacagcccctgggccctcagtgacaatgccttgctcacagggttgcagggtgacaagaggggctttgcttcttcatttggactttggttaggcccagctataatccactggcctctttctgtgggatgcaggcgttcattctccctcagtggctcaggaggctgagcagagccatataaacctaggagaagcccgtgcttgaagcctcatgttgtgtctgtcaaggaagtttcaaggctaggaccagcctccacggggcagagaagtcgtgctttctgctctggtggggtgtgatggctcagtttgtcatgcaggtgacccaggtgacaccagtcaggtggcctcttcctggcattgcagttagaatgtgccttgagccacatgtcaaggcaattgagtgtttggagtcctcaacgtgcccccttccagtcatcctgctcctgaggatgtgctgttgcctggttccgagcctgctgcagctctgcgggccgccccctccctgttcacccaggggagcaggcgtgttccctccgcaggggcttgagacctgccgtcctttcccctggaccctccctctcccccaagccctaacccaatgccactccttcctgaggctgatggtggctttgcgtgaggtgggccctgctgagcagcagagaatttcttagaattttcatcgccagatggctctgggttagggctgaccacagaaaaccagcaggcatgttggaaagcaggagtggaatgcagaaggcagagggagccacacggagcagccaggttacactcctgccgtcgtgtgactgctgcagaccccctgtccccgcacctcagcgggcttgggccgttccaggcctgcagcaccgtgggctccagccacctcctgccactgcccctcccagtctgtgtcaggagcactggagtctcccagtcagttcctcaggacgctatgtcaccgtcatgatgtccgtgagctcccatgcgcctggctctccccgttaccacacttacctttctctcctggcagccactccctggctctccttggagagtgtttcagctggccatgctccgtgtgcagtgtgagagtgcacaagcttgcacaggtgctcacaccagaaagggacgttgcaggttgggaggagggtccttgtgccaggccctggcccccgagtctgccccttgcagtggggtgcccagcctggtgtggggtcaggctgtgggaaggaggagaggccagggacaagcagccgggattagcttgggctctttcccttgaaagtggcagaaatgcaaacccaaagcagcccgtacctgtggggttcccgacaggccccggcttcaggcagggctggattcaggcagcagcccacaccccgtggggttcccgacaggctccggcttcaggcagggctggattcaggcagcaccccgtaccccgtggggttcctgacaggccccggcttcaggcagggctggattcaggcagcaccccgtacccgctggggttcccgacacgccctggcttcaggcagggctggattcaggcagcaccccgtacccgctggggttcccgacatgccccggcttcaggcagggctggattcaggcagcaccccgtaccccgtggggttcctgacaggccccggcttcaggcagggctggattcaggcagcaccccgtacccgctggggttcccgacacgccctggcttcaggcagggctggattcagggacaggggttccagcagcctcagctttaagtggggagttaaggggttcaatgtcgacaggaaaaatagaattttatgaagctctgagcaaagtcccgagtcctctctgaatgggatcttcaggccgccaagtccctgcagctcgggggtgtgaagctgtgactgacaggcctcggtctaccgagaccacagactgaggaggcagaggcgggccctaaaactagatgggaacggacaccgtagggggccaggtccccacctgaggcccacctgcctcactggaccagcaccggggctcgagtctgcaccccacctacccacctccccgcagtgtcccggccaccccacgcagctctctggacatcgtgtcccggctgccccacacaagtctctgaggcccgggcagctctctggacacctttctgctacttgtgccacactgttggttcttgggcccgagctgttcccacctcccatgcccagcaggtcccggttatgtcccggttatgtccggtttacgtcctggttatgtccaggttatgtcccggttgtgttccggttatgtcctggttaggtcccggttatgtccgggttaggtccgggttaggttccggttatttctgggttatgtctggttaggtcccggttatgtccgggttatgtcccagttaggtcccggttatgtccaggttgtgtccgggttaggtcccggttatttccaggttatgtccaggttaggtcctggttatgtccgggttacatccaggttacgtcctggttacgtccaggttaggtcccggttaggtccgggttatgtcgcgttaggtcccggttaggtccgggttatgtccgggttatgtccgggttaggttccggttatttctgggttatgtccgggttaggtcctgttatgttccggttatttccaggttaggtcccagttaggtctgggcgcatctgtcagtcattgctgtgtcccagcgatggcaaatctcagtgtctgcggccgtgagcgctcacattcttctcagctctgcaggtcagctgcagggctcccatccaccccagggaggagtcatgcccggctggagcctgggtgactgtgtttccccatgtgagaccaggggatgggtgagccaggcctgtgaggtataaggcaatgtctgcaagggcgtctggggaagatgcccctctgtgatgaagagagaaggacacacaaagatgtcatccgtttttcatcctgcccactcgccccactcctggctttgaatgctgccctgtgagcatatgctccctagagctgtggcagcctttttgcactcatgaggcagcgagctccaggaggaagagccaacgtgctgacacagtggggcagaaagacagagacaacagaatggggagctggcggcctggaccagctacctccagacatttcatccgggaagtagctgtccgtacagtttgagctgctctttgttggatgttctgttacttgcatcctatggatttggcctctggctgcaacgtgacagcatcagtttggggaaacaaaaacatgtctgtattcaggcagagaggcatttaacgtggggacaggtacacaaatgtcggaagggctgtgcggccatcgcggacacgagggggctgggacactctcagtgccaacgggactggacacgagggggctgggatgctctcgtgccaatgggaccggacatgagggggctgggacactcccagggccaatgggactggctggggagctcctggtgacctgcagagcatgatttttggctgcctctgtgcaggtgtttccagaggagactgcagtgtgtgtccgagtggcggaggtgaagatgacctgccctcagtgtgggtggcaccttccagctggggtctggagagaacagaaacagaaaaggggaatgtgtctctccccacggcagctgggatgcacgcttcctctcctgccctcagacagaactgcaggcgccccagcctttgggctctaggactcgcactggcagccccgggtctcacgcctgtggcctcgggctgagtcgcgccatcagcttcccgggttctgatgccttctgacgtggactgagccacactaccggcatccggtgttgtccagcctgcagacagcctgttgtgggacttcccagcctccatcatctggttcccctaacagaccctgctcacttctctctctgtgtcatgttggctctgtctctctggagacccctgactaacacagttgtgctggaggtgaaggaagtgaggaggctgtgttatgggttaccgtgtgtcctcagtatcactcactggagtcccaacccccagaaccccagaatgtaacactatttggaaattgggtctttgcagatgtaattgcaaatgttaaaatgaagttcccagatttggctggtctctacatccaaacactggcccccttgtgaaaagacacacaggcctaggggagacggtgtgtggggacgggagcagaggctgcagcgacgcaaccacacaggcgggaaggccaacaccaccaggaacaggaagagacacgggtcctcccctggagcctcctgaggcagcgtggctccaataacactggttctggacatcaggtctctaaatctcaagggaagacatttctgtgctttaagctgtactttttttttctttttgacggcgtcttactctgttgctcaggctggagtgcagtgtcgcgatctcagctcaccaccatctctgcctcctgggttcaagcgattctcctgcctcagcctcccaagtagctgggtttacaggtgctcaccactatacctggttaatttttgtatttttagtagagacagggtttcaccatgttggtcaggctggtcttgaactcctgatgtcaagtgatccacccgcctcggcctctcaaattgttaggattacaggcgtgagccactgcacccagccttccactgcactttgctatggagcctgggaaacgaccacagggtgctcccaagaaggggagcttctaccccacacagatgagagcccagcaggacagcctcagggaggcccacagtgcacaggggccagggctgctgatgggagggggccgctgggtccctaggggtgcagcctcactggtgtggaggccgaacagcttcccttccagttggcagggccacctggaagcccagctgcagggaagcctggggcacacagggtgtggacggccggcccgctcatgcaccgtgccccagggttggggtgctgccaggaggaaatgacaggggcctggggcctcgtggacagtctggaagtttctctttcctgaatgcataatcagtccttcgaagatcccacaaacccaaacttaacccacagaagccgaccagcgtgtcggatgcagcagctccggtgggaacgggccctgaagccagtgtctttcctggaggacacaggggacagtcccggctgagagccgggagtttcattagaaaccctggaggagagcagctgccccagagccccatctgcgatagaacattagaaacagtccccgtggcctttgttacggaaaaggctcgctgcggcggcatccttgagcgcaaacgctgctgcggctaaggcacgaggttgctctggaggtgacgtcgcggagggaagaggccatacggcaggaggggtgcagccgctcgtgtgagcgggaggagccccgtgggacggtgctatgcctttcccgagggtccctgggagtgtccgaaagtgcggagaaaggtctggaaggtggccccctgccgccacactcggaaccttattttttcagcaagtgtgagctttggagcgcaccaagatacgggcgtgtgttctggggtgcgtgaggtggtggtgccgcggcagcccaggcatccctgtggctctcccagaggctctgtgaggccgcccgtgaccctggaggggtgggctgtgagggccacctgcgaccctgggggggctgcatctgcagagctcaatcctctggcaaggtcaggggtgaggcgaggggccaagctgagctccccacctccctattccccccatgcacttcccagcgtcatggtgtgcagcccacacatcctcccaggacggcccttggagccctttcctccccatttctccagtctgagtttggggcgagagtgccgacatctgacttgtagttaggagggttcctgcacagcactgtagaccgtgggccaggggccaagagtagaagtgctgaggggccaaggaggctgctacagggcccagggagaggcaggggtggcctgtacctgaccagcatgggggctcacttggagggcagtaggggagtgtttccaacaggacttgttcctggctgtttgggaagtgaggcagagctgagagccacagccggaggtgcaggcctgaaccctcaccagcctgttcagggcattgagggaggatgctgaggccgtggggaccagccttgggctccgggagctccatgcccggtcccaggagcctgggatgtagcaccttccgtggtgaggagacttggtggatatggttgagctgaagatcttgagatggtgacggagccctgcatggtccaggcggccctggatgtgttcacaagcgtccttgtgggaggctcggcaccctccggacgctggaagattcaagggtgggaccctcccacagcctgcagaggaacccggcctgcccacacctccacgtcagccccaggagcccctctgggacttcaggctatgagaaggtaagtgtgtggttttaaacagcccagtgtgtggtggttcattacggcagctgcaggaagggagatggtgttccagcgacaggcggctgcaatccctgcatcaggagcgtaagtgagaagagcagcccgccgtgcaggcgacacaaggaagggtccactccggcctcctgcggcccactctggcccactccagcctcctgtggtccactccggcctcctgcggcccactcttgccccctgcggctcactcctgcctcctacagtccactctggcccactccagcctcctgtggcctcgtcagtttggaggtctgaatttcattcctaaggcaggtctgggaggttgtgagtcatacaacgcaggttcccttctgagagcattgctcctgccgggctggatggtgccccgtggcctgcacagatagacgggcatcctcagaagcacatgccaactcccagtgcggcctgagtcctggacaccccccccccaaccaactctggcactatctccacccctgcccaccctgcatccccgcctcagagcggcttctgcctcggggcctctgcctgtgttctctccttgctggcagcttccactcatgccttctcggaggggcatggcagggctcctcagggtggcatcaggtcaccttgccccacgctggtgcccacaagaccgatggtggctctcactggtgtagtgctgcctgcactacaccgtgagccccggggacactgtcccttcactgctgacccccgcggctggaacatcacctggtgcacagggagctgctcacatgagtggcgtgaagaaaacggttcccagcagagaacctggtgtgtgggataccgcgaggggggcggcctggtgcgtgggatacctcgaggggggcggcctggtgcgtgggatacctcgaggggggcggcctggtgcgtgggatacctcgaggggggtggcctctggacggtgctcatgaggcccagatcaaggtgtgggccaggaggttcctcctggaggctcctggggagaatgtttcctgggaggatagaaaccaggcccctgtgggcatcgtgcgggaagggtgagctggtctgagagtggagctgactccaagagtgaaggtgagagggagacagaagcaaggcccccatgacgtcctttgagcccctggatccagctagacctgaagccacccactccaggacgtcctggttatgtgagtcactaatttctcccttggcttcaaccacttttgttgccttttctgtcacaattcagaatgccctgacttgtgtggggttgtgcagtcaggaaagaggaaaaggtgtatccagaaggggaatccccagggccagagctcaagaatcagcccccggctgagcaccacatgtagtggatggagcccagggcccccgaggtgcacggcccaggcagatcctcaggctgtggggcaggagagtgctgggggtggcggcctctctcacccccacctcggcctctctcacccctacctcagggtctggccagctgtggtgcttcacagaagggatggaagtgattgtgaacctatcacgagcccaactccagacactgatcccaggaggatgcgcccaggctagtccactggccccaaaaggacacacccaggctagcccactgatcccaagaggacacacccaggctagcccactgatcccaagaggacacacccaggctagcccactgatcctgggaggagcccatgctatcccactgaggaggcaggggagagagattcaggtggggtgagaggacagttggggatgcatcttggtgatcatgattggggaggacctccttatgcctcagctgtggtggggagggggggggatatnaaaagcccttttatctctacccccggtggggacccccgttgtaggcctgcattctgagccgatggcgtggccttgcgcccgccgcccacgtgttccaacgttctctcggggcccttttatcctcctctcggcggtgttcgctctccctgcttgatgatcatctagacctcccttgcgttccgtcaggattgtgtgtgcgtcgcgggccgtcgctgcgtgcggctcgttaccgcgctcgctgagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgcccccccaactcctgttacccggtcactccttccatgagggcctcccccaggtacagccgatgctctcctgatggctcctgcccttgcagagtgctgcccccgcctgcccacctggcctggaccctcgcctgagccccctcagggctctgcgccacctcaacccaggcgtttgttccgcaggaacctcccggctcttcccactcgggaaaggaaggctctgggcatggaggtcggccaggccccatccccgtaccctggcccttcttcctgcttcctgtttgtcactgccccggggcctttgcacctgcattccctctctctgtgagtgtcctggggcccgttacccacgtcaccgtcccaggataccttttcttttctttctctctctccagctttattgaggtatagttgacaattcaggacggtgtgcactcaaggtatgcagcatcacaacctgacacacgtaggcattgtgaaatgagtcccacaattgggctaattaacacacccatcaccttacatggttacttctttctgtggtgagaacactaaattttaaatagaggacacacagcctgggcaacatagtgagaccctgtctctacaaatataaaaaaattatctggacgtggtggtgcacacctgtggtcccagctacttgggaagctgaggctggagaatcacttgagcctgggaggcggaggttgcggtgcactccagcctgggcgacagagggaggcctatctcaaaataaataaataaaggacacattcttatcagctgtagtcaccacgttcattacaccttagaacccgctaatctcataactgcacctttgttccctgtgaccctcaactcccggtcccctccagccctgacagccactgttcactctgcttctgtgagttccgctttttcacacgtcactcgagtgaggccatgtgctgtttgtctttctgtgcctggcttatctcacttaccacaaatgcccttcaggttcatcgtgtcctcacaaatggcgggcttgccctgccctgccctgccctgccctcccttcccttcccttctctctctctcctttctctctctctgtctctctctctctcccccccttcccttttcctcctgtggaataacactcctgtatgtgtgtgtacgcatgtgtgtgtatacgcgtgtgtgtacgcatgtgtgtgtatacgtgtgtgtacgcatgtgtgtgtatacgtgtgtgtgtacgcatgtgtgtgtatttcttcccttccctcccctccccttccctcccctccccttccctcccctccccttccctcccctccccttccctcccctccccttctttcccctccccttccctttccctccctgtggaataacactcgtgtgtgtgtgtgtgtgtgtgtgtgtgtgtgtgtatgcatgtgtgtgtatttctccccttcccttcctttccctcccctcctccctcccctcccttcccctccccttccttttcccttctgtggaataacgcttgtgtgtgtgtgtgtgtatatatgcatgtgtgtatatttctccctttcccttcctttccctcccctcctcccttccctcccctcctcggtcccttcccctccccttccctttccctccctgtgggataacactcgtgtgtgtgtgtgtgtgtgtgtgtatgcatgtgtgtgtatttcttccctcccctcccccctctcctcccctcccttccccacccttccctttccctcctgtggaataacactcctgtgtgtgtgtgcatgcatgtgtgtgtatatttctcacatattttcattcatgcatccgttgatggacacttgggttgattccgtgtcctggctgctgggacagtgctgcgatgaacacgagggtacagacgcctctcctacacgctaatttcaactctttggatatacacccagcagtgggattgctggatcaggtgggagctctatttccacatttttgaggaacctccctgccgtctcccatggtggctgtgccaacgacgttcccagggacagagtgcaacgggcccctttcctccatgtcctcgccaacactcgctatcttttgcgttttgatgacagtcatcccaataggtgccagttggtacctcctgtggtttttatttgattttcctgatgattagtgatgctggacgttatttcgtctacacttcggccacttacatgttttccttcgagacacgcagattcaggtcctttgcacgttttaaaattttttttgtttgtttttgttattgagttgaattccttctacaatttgcaaattaactcctcatcatatacatggattgcaaatacccccgcctccccctggggttttgccttttcactgcaaatactcccgcctccccatgggggttgccttttccctgccaatacccccacctccccatgggggttgccttttccctgcaaatacccccacctccccgtgggttctgccttttccctgccaatacccccgcctccccctgggggttgccttttcactctgttggtttcctttgcggaagctttctggtttgttgcactctcactgtctatttttgcttctgttgcctgtgcttgtggggccatattttaaaaaaatcattgcccggaccagcctcaagaagttttcctcctacgttttcttctaagagttttatggtgtcgggtcttaggtttgaatctttaatccgtgttgagttgattttcgtaggtggtgtcggatgaggccctttcatcctcctccacttttcccagcaccacctattgaggatgcccctttccccgtcgtgtgtccttggcgcctttgctgaaggtcagttggccgtaactgtgcatggggacccttcctggcccccctggtgccctgtgccccatatgtcccaccccctcccttactttttctccatggcatgaatcaccccagacctactatacatattttatcttatttatttttatttatttatttatttttgagatggagtctcactctgtcacccaggctggagtgcagtggcacgatctcggctcactgcaagctccgcctcccaggttcacgccattctcctgcctcagcctcccaagtagctgggattacgggcgcccgccaccatgcccggctaatttttttgtatttttagtggagacggagtttcaacatgttagccaggatggtctcgatctcctgacctcgtgatccacccgcctcagcctcccaaagtgctgggattataggcgtgagccatcgcgcccggcctattttttttttttcagacagagtttcactcttgtcacccaggctggagtgcagtggcatgatcttggctcactgcaacttccacctcccaggttcaagcgattctcctgcctcagcctcccgagtagctgggattacagtgtgcaccaccacacctggctaaatttttgtatttttttttttttactagagacagggtttcaacatgctggccaggatgatctcaaattcctgacctcagttgatccacccgcctcagcctcccaaagtgctgggattacaggcatgagccactgcacctagtgatgttagcttattttatttatttatttatttattttttgagatgaagtcttgttctactgcccaggctgaagtgcagtggtgcaatctcagctcaccacaacctccgcctcccgggttcaagtgattctccttcctcagccttcccagtagctgggactacaagcatgtaccaccatgcttggctaatttttgtatttttagtagagacggggtttcactatgttggccaggctggtctcgaactcctgacctcgtgatctgcctgtctcggcctcccaaagtgctgggattacaggtgtgagccactgcgcctggcctgtttataatttttaaatcttccttttttctgtggcttttttacctgtcacatttctaatgctgattgctatttcttttgtcaattcaacgcttgtctaccttgttctatttggtgaaaaacaaatttggggttttctcttcttctccccccactctctctgtctctctctttgtgtctctgtccttgtatgtctctgtctctgtgtctctttgtgtgtctctgtctctatgtctctttgtgtgtctctgtctctgtcctctgtctctgcgtgtctctgtgtctctgtctctgtgtctctcctctgtctctgtgtatctctgtctccatgtgtctgtctctgtgtctctccttctctctgtgtccctgtgtctctccttgtctctgtgtgtccctgtctctgtgtctctttgtctctgtctctccttctgtctctgtgtatctctgtctctctgtctctgtgtctcttctgtctctgtctctccatctctgtctctgtgtatctctgtctctgtctttgtgtgtctctgtctctccttctctgtctctccttctctgtctctgcctctccttctctgtctctgtgtctctccttctctctgtgtatctctctgtgtctctgtctctgtgtctctccttctctgtctctgtccatcctgccatcgcaccgtctactgaagtgctcactacgcgccccgcctcctctccgcgcgcccctcctctccgcgcgcccctcctcctctccgctcgcccctcctctccgcgcgcccctcctctccgcgcgcccctgctcctctccgcgcgccccgcctcctctccgcgcgcccctcctcctctccgctcgcccctcctctccgcgcgcccctcctcctctccgcgcgcccctcctcctctccgctcgcccctcctctccgctcgcccctcctctccgctcgcccctcctctccgcccgcccctcctcctctccgcgcgcccctcctcctctccgctcgcccctcctctccgctcgcccctcctctccgcgcgcccctgctcctctccgcgcgcccctcctctccgcgcgcccctcctcctctccgctcgcccctcctctccgcgcgcccctcctctccgcgcgcccctgctcctctccgcgcgcccctcctcctctccgcgcgcccctcctcctctccgcgcgcccctcctctccgcgcgccccgcctcctctccgcgcgccccctcctctccgcgcgcccctcctcctctccacgcgccccctcctctccgcgcgccccctcctctccgcgcgcccctgctcctctccgcgcgcccctcctctccgctcgcccctcctctccgctcgcccctcctctccgcgcgcccctcctcctctccgcgcgcccctcctctccgcgcgccccgcctcctctccgcgcgccccctcctctccgcgcgcccctcctcctctccgcgcgccccctcctctccgcgcgtcccctcctctccgcgcgcccctgctcctctccgcgcgcccctgctcctctccgcgcgcccctcctctccgctcgcccctcctctccgctcgcccctcctctccgcgcgcccctcctctccgctcgcccctcctctccgcgcgcccctgctcctctccgcgcgcccctcctctccacccacagtcaggatgcaggaggtttccaagtttgcatcctcactgttgctcttcctgctctgagaaaccctcctagcgaccaggctgactggcctcctctgctgtgagtgagggtcctggcctcctggcgtccctacggtggccacagccctcacagtcgcttcctcacctgggcccagaccgcgggctctcgggacccttcacggctgaacctccactgggcagctgtgcggagaccgagtttcctcctgcaattgcagacttccatctcccccggcagacattacacaccagcaagcgcccgccttcccccaccgcgttattaaagccacaaagcactttacacgttccctggagctgatggcccctccggggactagagcactgtgcgggggggcttcatcttgaaaaaaaatgcaaaaattagccgggcgtagtggcccgcgcctgtaatcccagctactcgggaggctgaggcaggagaatcgcttgaacacaggaggcagaggttgcagtgagccgagatcgcgccattgcactccagcctgggcaacagagcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgtctgcggtctcagcccccaccaccatctgagagatgggccaggcatggactcacagtgcccctggcaaactcagcccccactggcaccaccaacagtgtggcctcagcggtccccggaggtccaagtgacactgtcaggccccacacgcggtgctcggcaggccgggcccagccccgcccccacatggccaggtcacacttccagcccagatcctatgcctgggctcttgctcctggaaccctggcccctctgtgaagcccaccaggcccactaggggctcacagagagaccacctggctcagcctccaggatgcagggcagggcagtgtctgggccagtccctcacaccctcacattccccacgacgggccgtgtctcaaaacctgtaccctccccttggccaaggcccaccggctccaggctcacaccctatgcccaccagggttctgggccattttcagcaggggtcacagctcgcccacagacagccctgggaggccgggggccgcacacgatcagtagcctggggtttcttaagcacaaccgtctgtgcaggttcagcagcattttgggtgcatgtcctgtggtttatgctgagcagagaatgtggaagcacaggcgttagaggagaccgctggccaccgagccaggaggctgggtgctttccttccgcctttattcctgggacacacgtggaccttctgcgtggcccgtgtgccagtcagggaacagctcaagcttcagcacgcaccttcttatggagcttgacgtgtggaccaagtgaaagtcaccaggtgaaagtgatttgctgtttgaaaaatgcaaattaaccaaaaatcacagacaccaaaccagaatggtggtgtccgcctggagctagtggccaatgtgctcctgggcaccctgccacctccctgtggcccaggcgcagcccagagcaccatggccagcgtcactggggccgagcggccagcatgtgggagtgggcggtgcagcccactgggctaagcaggcctggcctatctcccaggagacacagggaccggcacaacctgttctgtggcctgaggccagataaggatggcctttgctatgtgggaagatggggtctgacacagccctggatacacctctcagaccccagtcttcttgggaggaccccaggcagagaacagcagcactgaccaggcacgtatggccacagcactgctccaggggtagggggcttccagtgtcctctggtcagtacaaccaggggacagagttgtcacaggaaacaaaagggacagcaagagccacgttcccaagcacccagagttcccggtcagaacaagagcaggggagaggccagcggggcttcctcaggcctcctgtccccacataccacggcccctggttacagagtagaaagtcaagcgggggctggctcaggtctgccgcgccgccccacccaccccagcacacccagcccagcacgcccctctgcaggtcctcagccctgccacagggctcccatctctatgggcagttaatcattaatgctgtctccagggctgcaggcacaccctgagccaggccagaccctggccctcctcagcccacaaccaccaccaccaccatttagggagtgcctgctgtgttcacagcacacacaggcccaggacaagcggggactcctcctcccctacaggagcacatataaatgtgcagatgctgggggcctgccccgggcacagaacggcctatgtgtcccacccagggtacacaaagggggcgggggcctgccccgggcacagaacagcctgtgtgtcccatccagggcacagaaaaggggcagggacctgccgggggcacaaaacaggtacagagacctgccccgggcacagggcaaggggtgcctgttcagacaggcggagagggtggtctgcctggggtcagaaggggctgcgagtgggggtctgccccaggggccagggctggggccgagagttggtcccagtgtgtgtggggtctggggtgaggtaacaggactcctgcaggcaggctgcacctccccggcaagtctacacctgtgtttggttgtttataccactgcagtgtcccgcgggcacaagccagcctctggggttacaagggcttcctccaactcctgagcgtcccatcctccagcatcccagagtaggaagagccctcaagacgcgggtgggggcagagggactgtgagcaaaggcggcagagccaagggcaggctgtgcctctgggctgggtcctggtggccacatctccctcggtgtcccgtgtgggtggcctcgcagggcagcgcccgctcactctaaggccggacaggcgtggcacccagtgctccttgctcttgctctgcctcaatggggagcctcaaggtccccatctgtggaatgggggcatccagccctcctcgtgggtcatttgaggagtaaatgagttgatgtctgtgaaaggcagctcagaacactgcctgatggagagaatgcttactgaaccagtcactactattgatataattatgaattatctgaactttggggaaaaaccaccatactttggcaaaaaatgtagacaaccaagagacacgtatgggatgatcacgaggttatgacttgtgcagaagccccgtactttcccaggcaggctccgaagggcagaggaagggacatgaaaccaccctggggtgctgtggctgtgttaacgccacgcagcagcagacttgtctcactatgacctgaggggccagctggtctaagccgaagtcaccaaaacccactgaacccactgcctgcaggctgggggcacgtgaccctgcccagagcaggtggacagccagtcagagccgctgcgggcaaaacacgtgggcctgggattggccctggatctcctgagtacagttcatctcctcactcagattcctgacacacgcatctggggcactttctacacatcgagctcttcccggcaccagaccccataggagacacacaggacagcacagtgtctgctctctttcagcttacaagttcttgtgggagacgaaaatggagagcaaagacattctaaaacagctttgcagagtggggatgacaaaaagaaggtgggcaacgtcgacgggggtggggggcaccacttcagaggagtctgaggtgacgtttttgcaaagacacaatggcaccaaacataaagcagacagagaacggcagggtacaagggctgacccgctcggagcagtgaggaagccgcggttagggacccaggaggtgcaggtgggtggcgacagctctggaaagtgggcatcctcgtggtctcagctgcagtgcaggagccgagcgcagggcctggcttgcagtattgctcagtacacgtacagtctgtgtcattatcaccactgagagggcagaagacagccccagggccatcccgtcccagcacagagcaatggcgtgtgccagccctggagccatctaataatgtgcaggacagaggatggccagcctgtgtgatgagcctggccaccacccaccccgtcctgggcccacaggagccccagctctgtccgtgcacttgggacacgaagccccagctctgactgtgcactcgggacacgatgcggcacctgttctggggccacttccctggccaccggccctgacccaaggctctctacagtccccagagtttggatgagaacttgaagaggacttgctgcttcaggggcctgcagtaggcatctccccttttcccaaagctcagcttctgagactgggggatcccaggccatgggctcccaagcccctggaaaagtgagaggggttggaaatggggtgattctgggagtcaaagtccagcagatgagggtcccccaaagtaagtgctgcacggggcacacctcgctgggcgggtctcggccctggtgcagggcaacttgctagcattcctgcccatgccagtcctggggagacagcgcctgccccaactctcagacagcatttaatttccttctctgctcagctgagttcatgtaagaggagcagtatttgctcagcaaatactgtccgtcagccagacaagcaatatttttggccaatctattaaccatgcagcaggcagcagtcaccaagaggggtcttgagattaaccctccttctccccttctcagcagagccctcgaagggaggagggaacgggatggcccgcggagtatccattttatcaccacctccctaagatccagcactgctccctagcacgtcctgaaccaggcagagcgatatgctggccacagaaacacaactgataaaaggccgacggtgctgtcagacagcccccaatttcgaagcgtagatttttttgcctctgcaacttaaaacgtccccaaacccacccgacgctgctgggtcttccagatgcgacggtctgggcgagcggtgggcacccagggtccctggaacgggtaccaagtggccggggcttccctcagggctgcccacggcgcgggcggtcgcaagcccaggggtcccgggatcgcccgacgcgtcaactccgggccccgttctcgcctcaacgcctgcgaagccgcacccgtccacctacctccagggcctccagggtgctgaagctggcgatggcgaagccgtcgatgacctcctcctcctgcgagctggactcgcggcggcggcggcgcgggggacgcgcggtgcggggcgcgggggcggcgcctcgggggggcgcgccgcggaggcccgcgttctccttgccggggctgggctcgggctcgtcgcccgacgacggactctgggcgcgggcgtcgcgggcggcctcccggcgccggccacggtcccgctgcgcgcgcgagcgccggctcgggcggaccttggcctccatggccgcgcgtgcgccccgtcgggccggtgaccttgacgccccgcgcctggctcgcagcaggcgggctccctcggctacgcggcgccgccgggctgagtgtgcgccgcgcgggctcgggccctgggcggcggcgggcggcgggccgggccgggcatgccgggcgcggggggcggctcagccccgggcccggcgcggcctgggacccccggcgcgggcggctgggcgcatcggcgggggcgggcccggcgctcagcgccctcggcgcccccccgggggcgcgccccatgcgcgcggcgcggcgatcgggccgagcgggcggggccgggcgggcgcggcaggcggcaggcggnaggcggccggctcctggcaccggctcgtggatgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggctaaactgggatggcctctgggagcctcggggaacaggtgtggactcccaggctacttgggaagaggcctgtatttaaacaagagcctcaaatgccacctgggtgaccctcgcccacatttcctggccttctgtccagggaggggaattcgggagcaggcgtgcatggagaaactactcggggtccgtttctgtcttcctaatgaggcttttaaaaatcaaaagggaggatgctggagggtgaaaccacggtttaacaaaacccggaatgggaagagggggagggggaccctgcccccaccctggggaggctttgacagggaaccagagagcgggctgggtggactggaggaggctgggtgaacaggaagtccccccaccccagtgagctactttcccaactgcctcagcccagcaaacagccagtggtgcctggaccacacccttcctgccctgcacaagaggccgccagtaggctctcccagaggcagggtaaagtggaccccgcagagtgggcgaggacccgttcccactaagggcaaccgagggcagggtcccaccactgtcttgggcaccctcccctccgccctccagcaaaccaccattcttctccgagggcctgtgcaggggtgtagccccgacctgaaacagggtgcccatgactgctggggctcggagtcgtcactcctcggggaggccctctggaccacccaatgcccactctctgtgacacctccccgttcgattttcttcagattatccttggctgatattctatttggccctgtgttcagggtctctctcccacttctaagagggtagtctatctcagccgctgcggggtcaccaacagagcctggacacaggaggcatctggcaaatacgcgctgcatgaatcaatgactccagtgcccacgcgcaaggggcccctgggctcagaaaaccccaccaggcgggcccctccgagctcggcctgtcctgggggtggaggaggaagttcgccccgcgcctgcctcgcaaccgcagccgcctccgtgcgcttcctgcccgcgccgccctccacactgcgctccgtgtctggcagcagcccccgcctcgctgggcgcgttcccgggggtctcggtggcgggagccgccttcttgtgggacttgggggcacgtggcgcggggcggggacgcggacagacccctcccgcatcctaggaggcctgggagggtccgcggggacgcggggagggggcaccgcctggccgaggaccctcccccggtcctccccgccccttccccgtcccttccacgctcgccgagggcaggacttcggttccgcgagaccggaggcccctcgtcctcctcggaagccgcccgcggccggggaccccagtcccgcagaggagggcggcgctgcccccgcctcccgcttggagagcgccgcccgcaggtgcccacggaggggccgcggcatcccagcgccctcccaggaaggagccgagcggatcaccgccggctgcagcggaggtcggggcgccggggaggggcgcggctagggggcgaggtcgaagggcgggcacctgcgggtggggcggggcctgaattagcgggagcgcccgggaggggcggggccggggcctgcgtgagcgggtcggggagggccggagctgcgggacggccaccggaatgggggcgggccgggcacggagccttgtgagcggggcgggccgcgtgtgcggggtggggcgcagccttatgagcgggacggggcaggggcgtggtcgggacgggcgcgcgggcgcccgcgcggccctcacttcctctggcgagcgcagccgggcggaagtgcgtcgagttgttatctagttcagtgatgaactagcccggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggaggtcatcatccccaaagccagcaaacatatgaagagatgctcgaaatcatcagtcatcagagaaatgcaaattaaagccaccacgatgatcccgtcccaccatctagctgccaagatgagaggccggatctgccaagtcctggcaggggtttgggagcatcccctggagggacggaaccctcgtccactgccccctgcccgaggaaggggtgaggcggcccttagggagagcagctggagccggggaagggctgggaagtcctcacccaggtccatgggggcaggtccaaggctgcgcaccgaggcgccatcatggaccccttctctgccggccgcctgcagttctggggctcaagcacagggtgccctgccagggaaggtgcggcaggagatccagcccctccaccaaagcctgcctggagagagaggagggcctgttcctcatctttcttctgatttacacaaaggcacgatgtgggccggcaggagacctgaacccggggtcccttcctggaaagtgcgtgggcagctcgtgaacccggtgtcccctcctggagaggacgtgggcagctcgtggacccgggtcccttcctggagaggacgtgggcagctcgtgaacccggtgtcccctcctggagagggcgtgggcagctcgtgaacccggtgtcccctcctggagaggacgtgggcagctcgtgaacccggtgtcccctcctggagaggacgtgggcagctcgtgaacccggggtcccttcctggagagggcgtgggcagctcgtgaacccggtgtcccctcctggagagcgcgtgggcagttcgtggacccgggtcccttcctggagaggacgtgggcagctcgtggacccgggtcccttcctggagacgacgtgggcagctcgtggacccgggtcccctcctggagagggcgtgggcagttcgtggacccgggtcccttcctggagaggacgtgggcagctcatgaacccggggtcccttcctggagagggcgtgggcagctcgtgaacccggtgtcccctcctggagaggacgtgggcagctcgtgaacccggggtcccttcctggagaggacgtgggcagttcgtggacccgggtcccttcctggagaggacgtgggcagctcgtggacccggggtcccttcctggagaggacgtgggcagctcgtgaacccggggtcccttcctggagaggacgtgggcagctcgtggacccgggtcccttcctggagaggacgtgggcagctcgtggacccgggtcccttcctggagacgacgtgggcagctcgtgaacccggggtcccttcctggagaggacgtgggcagctcgtgaacccggggtcccctcctggagaggacgtgggcagctcgtgaacccggggtcccttcctggagaggacgtgggcagctcgtgaacccggggtcccttcctggagaggacgtgggcagctcgtggacccgggtcccttcctggagaggacgtgggcagctcgtggacccgggtcccttcctggagacgacgtgggcagctcgtggacccgggtcccctcctggagagggcgtgggcagttcgtggacctgggtcccttcctggagaggacgtgggcagctcgtgaacccggtgtcccctcctggagaggacgtgggcagctcgtgaacccggggtcccttcctggaaagggcgtgggcagctcatgaacccggtgtcccctcctggagaggacgtgggcagctcgtgaacccggtgtcccctcctggagagggcgtgggcagctcgtgaacccggtgtcccctcctggagaggacgtgggcagctcgtggacccgggtcccttcctggagaggacgtgggcagctcgtggacccgggtcccttcctggagaggacgtgggcagctcgtggtggacgtgcactggttccgtcagggctggcatcatttgctgcaggaacaaacagccccaaaacggagccactcgcagccacacaggctcactgctcacccacgttaggatttgcggggctctggtccacttcatcccctgccgccaggccccaggcctgggcggcctccctctcaccgcgcctgggtgggtttgcccgtcctcagggctgtggcctggctgcgctcctggaagccggggccccgtgtatctccctgattccccggtgggcgtccagcagaggccggtcagggcaagaatgcccgaccctcagggtcctcctcagagtcgctgcgggatcacttaggcgcctccggaaacaacactgtctttgcactggaattttcaaaacaagactgcccttcccctccctccgcggtgcccttcccctccctccgcggtgaccccgccccctcctccgcggtgaccccgccccctcctccgcggtgaccccgccccttcctccgcggtgaccccgccccttcctccgcggtgaccccgccccctcctccgcggtgacccccgccccctcctccgcggtgaccccaccccttcctccgcaggagaccccgccccctcctccgcggtgacccccgccccctcctccgcggtgaccccaccccttcctccgcggtgaccccgccccctcctccgcggtgaccccgccccttcctccgcggtgaccccgcaccccccgcggtgcccctccccctccctccgcggagaccccgccccttcctccgcggtgaccccgcccccctcctccgcagagacctttgcatagtatccggggagacccgcggtgggggggcagaaaaacgtttttttttttggggaaggaaatacgtaaagcaatatatttaacccccccatttctcagccacctaatctaatacccccccttgtgtagtatatttggagcggggtggggaggtgggtagttgtgggcggtgtgttatgatgttgtgttatttgtggaaggttggcgaggtggagtggcaagtctgtggccactgaggtaggatgtttctattttacgtttattttgccctcaatggttgtggacgaggggtgtgttgtttagtgacctggacgtggaggggatatgtgtgttggtgcgaccttgtagggagcggtatagtgggttttttgtggtggttgcgctccattagaattaattttacattagtttgtcttcgtctaactcagtccgtgttggttttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgccggtcatcactgctccaccaggctgtgtgacaccgcagtgtggtcaggctgcaaattggcccttggttctgcagggacttggagacctctgcggcgtgcagggggtggacgctgacccggggccaggcccacccaagcaaaccgcagcagctgcagcagggctggggagggaagctcaggggtaggagccgatctgatctgtgcgttccagggcttcccctggaggaggcactcggggtgagggggcctgcagagaggcccagagctggggaggccagtggagccgggagccacctggagggaggaggaaggtgcggccgggtcagcgttgggaggggtgtagctcagcctaggggccggtggtaggaggggtgcagcccagcctgggggctggtggggaagctgcatcccatgaggggccggaagcactgagggcagctcagggctgggttgtttccaacaggccaggtgtcatggggtgaatgtgtctgaggaaggagagggcaggctggggagaactggacagtgatggaagctggggggactccagccgtcctggcctctgggggctcctgccagggcgcagggtgcggggacagcctggtctgcatagctgcgagtctgaggacctcttcaggaagacttgtggggtcagaggctgcacggtccgtgaggggggcggcagcgtgaggttcgggatcacaggacaagggccgtggggtgtccggcatgggcattggagaccgcgatggagtcaggttctgctggacatggaccagaagtccccagttcagttctgagcacgtgggtgaggggactcctggggggccgccaggggctccgaggagatgtgggctcgggagctgtgatggctgggctgtgtccccacaaatccacatgctgaagtcccacccccacgacctcaggatgtgactgcataaaggggtctttaatgagggtgtcaaggtaaagcgaggttgttggggtggaccctgatccagtcccatgggtgacacaatacgaagaggcgatcagggaggaaaaggccccggagagcggctttgagagtgacgaccgcccgtgatgaccggcctgtgataactggctggtgataactggctcgtgatgaccggcccatgatgactggcccgtgataactggctcgtgatgaccacccgtgatgaccgcccgtgatgaccggcccgtgataactggctggtgataactggctcgtgatgaccacccgtgatgaccgcccgtgatgaccggccgtgataactggctggtgataactggctcgtgatgaccagcccgtgaaggacaaggaagaggtaaggatgcagacaggcacagggggccaccaggtgaacgcacagaggagacaccgactgccggccaaggagggaggcacaggatgaacctgccctgccggccccagggtggagacttccagcctccggggtgggcgacgggtgccccagcctccggggtgggcgacgggtgcgtgtggtttgagccgctggcctgtgtcgtttgttgtggtggcctgaagagacctgcacggtagctgagtgtggtggacacgccaaagccgcaggcaggagacctgcagtgaggctggcaggaccatgtggcggcaatggccaccccaagcctcaggggcttcctgcagggatggctgctcagatgccggggcctgcagtgctgatgagggtgtgcctgggccacatcgccatggaggacgggaggggcctgttcgtttctagagggacacgccggccacccggatgcagataccacgtcctcacggatgcgcacacgttgcttagacaccatcacgtgagccttttgagctttgaaggttgagaacatattcctaagaacacacatcagcgccatttagagcttctaaggggttaccgcggaggaaggggcggggccaccgcggaggaggggggcggggacaccgcggagggagggggcggggtcaccgcggagggagggggaggggcaccgcggagggagggggagggtccaccgcgggggggggagggttctccgcggagggagggggagggttcaccggggagagagggggcgggggggtcaccgcggaggaagggggcggggtcaccgcggaggaaggggtggggtcaccgcggaggagggggcggggtcaccgcggaggaaggggcggggtcaccgcggagggggggcggggtcaccgcggaggaaggggtggggtcaccgcggaggagggggcggggtcaccgcggaggaaggggtggggtctctcgcggagggggggcgggtcaccgcggaggaaggggcggggtcaccgcggaggaggggggcggggtcacgcggaccgaaggggcggggtcaccgcggaaggaaggggaagggcacgccgaaggaaggggaaggttcaccccggggggggaaggaaaccgccgaaggaaggggaagggtctacggggaaaaaaggggccggggggtcccgccgaagaaaggggccgggtcacgccgaagaaagggttgggtcacgccgaagaaggggccggggcacgccgaagaaagggccggggcacaccgaaggggggccggggcacaccgaagaaagggttgggtcacaccgaagaaggggccgggtcacaccgaagaaagggttggggcacaccgaagggggggcggtcaacccgaagaaagagccggggtcacacgaagaagggggccgggttaaccccgaagaaagggccggggtaacggcgaaggaacgggaagggcacaccgggggttccggggtaaccccggagaaagggccggggtcaacaccgaagaacagggcggggtaactacgaaggaaaggttggggtcaacacggagaagggggcgggggtcacccggagaaaggggcggggtcacaacgaatgaagggttggggtcacacgaagaacgggccgggggtcacacggagaatggggcgggttcacaccgtagtagaggccagggtcacgcggatgaaggggcggggtcactacggagaaagggccagt

SEQ ID NO: 716 - DNA, 173233 bp, Homo sapiens
  misc_feature (1)...(173233): n = A,T,C or G
tttctttaatagtctgtaacaagagggatggctgggcccgggggctcacgccggtaatcccagtactttgggaggccgaaccaggtaagtcacatgaggacaggagttggagaccagcctggccaacacagtgaaaccccatctccaccaaaaattacaaaaattagccaggtgtggtggcccatgcctatagtcccagctactcgggaggctgaggcatgggaattgcttgaacccaggagatggaggttgcagtgagccaagatcgtgccactgcactccagcctgggcagcagagtgagaccctgcctcaaaaaaataaataaacaaaagaaaacacacacacaaaagacatgcaacaccagtggatatcaaaagcattttgcttagtggaggggaaaagccaatttcaaaaggtcacataccatatagttccatgtatataatattctcaaaatgataagacaacagagatggaaaagaggttaatggtttccctgatttcaggatggaggaggggagggaggtgggtgtgacatgaagaagctgcatgaggcccatcttggcagtaatggaatagttctccatcttgattgcagtggtggttacaggaatccctgcatgtgatgatacgtcacacaacgaatacaaacattgtgttgatgtcaatttgctgggtttgacattccactatagctgtgtaagatgtgagcattgagggggactgagtaaaggacacaccagacgcctctgtcctatctttacaacttcctgtgaatctgtaattacttccaaattaaaagtctcaaaaatggttatacatacacacatgcctctacgcatacgaaatagatgtatacaaaatatatgcacaacaatatgtttcagtcagaactgttcatagaattttctatgatgataggaaggttcttttttgtagacagggtcttgccctgttgcccaggctggagtaccatggcacggtctccgctcactgcggcctcaacctccctgactcaagcgatcgtcccacctgagcttcccgagaagctgggactacaggcatgcagcgctacccccggctgatttttttgttgacacagggttttgccctgttgcccaggctgatctcgaactccttggctcaaagcaaccttcccgctttggcctcccgaagtgctgggattacaggtgtgagccaccgcaccctgtgggaaggttctatacattcaccgtccaatacaatagccactatttctgggcagcccttgagcacgtcaaatgaggtcagtaggaccaaagtactgaatgttttatttcatttcattttaattcatttaaatttatttatttatctattggagacagtgtctctgtcacccaggctgcagtaccagtggggtgatcatggctcactgcagcctcaaactcctggcctcaagcaatcctcccacctcagcctcccaaagtgctggcaatacaggcgtgagccactgctcccagcataattaatttaaatttaaatagccacatgtggttcttggataccatgttgggtgatacaggtcttgctgtacatttatggagcgatatgcaagaagcttgtaactgtggttgtctctggaaaaggagtttcgggctttaagaggagtggagttttacattttacttacatcctttgaagtgtttaccgggtatttaatttttttgaatcaatgaaaaaagtaataatactcagcaaagaccatgatgtatgatggagaccaagggctcctttgggacctgggtgaacagcctaacctgggtgcctctggcttcattcctaaccccaaagcatcagatctcagcagaggtgacactcacccatgtcatcctccacagagcgtctccacagggaaggggacgatgctgaactacagctctgacctggacctgattctcttcctgagctgcttctccagcgtccaagaccaggcacagctgcgagacagtatcatcagcttcattgaagagaattggttcactgtagcaagagcctggcctacaatatcactgtggtccggcacagggagggtacaagggcccctgactccctgtccctccaggtccagtccaggaagagcagcggagtcatttggatggataagctcccggctttcgatgctctgggtaaagacagcgacaggtcgggtccagagaaactagtcagggccgctttgccaacctggcctcgggaggcttgagaaagtggaatccagtgggagagtggaggttgccctttttcagggagacaggactggagcgataccttggagattaagtcctcccataaatgcatgtgttaccatattccatcatggcctggggaaataaatgggacttccaaatgatggattcccacccaacccaaggaggtgatttctctctaatcctttgggattagaaaggttgcttgcagggtgttgggccctgtttattttttatttttatttattttttattttttgaggcaaggtctcgctctgttgcccaggctggagtgcagtggcacagtctctgctcattgcaaccttcatctcccaggttcaagtgattcttctgcctcagcctcccgagtagctgggactacaggcatgcgccaccacgcccggctaatttttgtatttttagtagagacgaagtttcaccacgttggtcaggttggtctcaaactcctgacatcaggtgatctgcccacctcggcctcccagagtgctgggattacaagtgtgagccaccgcgcccggcctccagcattttttaagagaaaaaaatggaaataaccttcattgtctaaggataccgtacaatgttagggatagccattttgtttgtttgttgttgccatactgtgctatactattctcttttttgttttttgagacaggatctccctctgtcccccaggctggagtggtgcagtggtgccatcacagctcattgcagccttgacctgggctcagataagcctcctgcctcacctttctgtgtggctggaaccacaggcatgtgccaccacatcaagctaatttttttatggtttgtagagatgggatgcagggggtatcactctgttgctcaagcagtcctaccaactcggtctcccaaagtgctgggattacaggtgcgagccaccacgcctagcctctcctgcctctcttgaaatctatgtgcgtacggtgcacacagagcttacataagtggagtcatatcatgcatactggttttgtagtctacctttcaaaaaaatgcatttgtttgggacttctcaactagaacttttgggagctatgtattaatgtaatttgcacattttcccattgagctgtctgtcttccttatcagttttaagaactctttgtaacttgtagatatttaccattatttttcttttttcttttttttttttttgagacggagtctcactttgtcgcccaggctagagtgcagtggctggagtgcagtggcacaatctcagatcactgcaacccctgtctcccgggttcaagcaaccctccctccttggcctcccaaagtgctgggataacaggcacacctggtctgaggatatgatcttgagtgaagcaacctcccattgtctgagggcaatgctctggcagggactcaactaggagctgttagcagcaacactcccaacagctgggaaatgagtgccccagtcctgaaggggcatctggtggcaagtgccatcatcctcatccactgcacttcaaacctgtgtgctctattgtttgtgagttatatctcaactgaataatctgggaaaaagaatgactcagccaggcacggtggctcacacctgtaatcccagcactttgggaggccgaggcgggtggatcacctgaggtcaggagtttgagaccagcccagccaatgtggcaaaaacccatacctactaaaagtacaaaaaaaaaacaacaaaaaaaggccgtggtggcatgcacctctagtcctagctactagggaaactgaggcaggagaatcacttgaacccgggaggcagaggttgcagtgagctgagattgtaccactgcactccagcctgggcaacagagcaagactccatctcaaaaaaaaaaaaaataaagaatggctcccagatttctagccactgctaacagtgaaccctgctcttctttctgttcacactcatctcattaaaattccaattcgagatttgtcttctcattagaataatagctcacattcattgagcaccaactatgtgtcaggtgctgggctgagtactttccatctattccttcttcggagcaccacagtaggcttaggatgtaggtcctattatcatcctcattttccaggtggggaaactgagacacaaatagtttagatgacttccacattcacacaatgaatacacttggatttgaatccagacactctggctccaaagctcatgctgcgactactttgctttgctgtaaactcaccaggaatggaggaccgtcttattcagcgctgtctcccagtgcctggcacagtggctaacacataataggagctccgtaaatacatgttgaatgaatggatgaattcaaggaggactgaatgaggtattggatgaggtctggaacaacacgacacaggtgaaattctgcacccactgcctaacacacagtgctcactaaatgcaacagctaccagctgttattagctccttccactgccccctccaaattctccctgcatatcctcgtgttggagtagagggaattctaaagagttgtattctttccagtcctggaagttccctcactcttagttctataccacggccaacatggcaaaaacagaatgcatgctgtggcagaaattgctattttccctcaatatcctttctccctttcttccatagcaatagaatttttagttaggcacattgccaaaggctaaagactacatttcccagcctcccttgcagctgggtgtgaccatgtgattaagttctgaccattggcgtttttcatattttatgcataaatttgcatgtttatccctgacaacatttgccatttgcctgttggtttcagaatccccaggagctatctccctcctgctttagagtcaggaaggaggatggagaaaatgttgtgatattaggcattgagacaatttttgtgcaagtttctgtcctttgggtaggttgaaaactggatgcagctttattccgtggtgctccagatatcacaaggagaaagtccctaagacccagaagtccaactgagctgttttgccagaatgcaaggagatgaattatggtaatgatcagggacgggcctccacagttttcctacttttaaacagggaggcggtcacaattctgtggaattctaggggcctatagaaaacaggctgatatgagttagcaagagcccagtatcactggggagaccaggaggctaccagtgaatttcattcagctccaagaagagattcagagaaggaagtcttaaggtttcaaggaggaaggaccttgggctactgacccatttcttctacaccctggtttacttgcctttctatccagcccagaccccatggtcaagcctgccagtcactccctagtggatgccttcaattttctgcccatttatccttccagtccattcactcctggaacataaggacattttgggttgcaagtgacagacaccccattcaaaatagtttatgcaaaaataagtagaatgggctggctgcggtggctcatacctacaatcccagcactttgggaggccaaggcaggaaaatcacttgaggccaggagtttgagaccagcctgggcaacacagagatctcatatctacaaaaaatataaaagttaggtaggtgtggtaagcgcacatctatagtcctagccactcgggaggctgaggtaggaggatcacataagcccaggtattggaggttacagtgagctatgattgtgccactacaccccagcctgggtgaaagagtgagaccctgactctaaaaatacaaatacaaattcaaaataaatagcatataatggcccgtaagagtccaggggaagctaacattaggtacaactggaccgtgttagtcagggttctccatggaaacagaaccagtagggtatatgtgtagataaagaagaggggatttattaggggaattgactgcattagtctggtctcacactgctataaagaaacacctgagactgggtaatttacgaagaaaagaggtttaattggctcacacttctgcagcctgtacaggaagcattgcaacttccgcttctggggaagcctcaggaaacttacaatcatggctggagcaggagcaagagagagaagggggaggtccttcataatttttttttttttttttgatacagagtcttgctctgtcacccaggctggagtgcagtgtcatgatctttgctcactgcaacctccaccacctgggttcaagcaattctcctgcctcagcctctctagtagctgggattacaggtgcccaccaccaagcccagctcacttttgtattttagtggagacaaggtttcaccatgttggccaggctggtcttgaacttctgacctcaagcaattcacctgccagcctcctgcacactttttaaacaaccagatctcacaagaactcactctgcagtatcaaggggagatggtgctaaaccattcatgagaactccacccccataatccagtcacctcccaccagctcccacctccaacactggggattacagtttaacatcagatttgggcagagacacaggtccaaaccaaatcattggctcatatgattacggaggcttagaagttccaaaatatggcgtcaacaagctggagacccagaggagccagtggtgtaaggctcagagtccgaagatctgagaacctggagctctgatgtctgatggcaggagaagatgaatgtcccagctcccaaggaggatggcaaattcatcacccttccttcacattttgttctgtccaggctctcagtggattggacggtgcccacctacattagtgagggcagatcttcatccctcagtgtactcattcaaatgctaatctcctctggaaatagccttacaggcacacccagcgataatgttttactctctgggcatcctgatacctaaaattaactgtcatgtggatccaggagtccagatgatgccagagggggtgccagctggtttatgtgccaggccaactctccctgacaatcacacacacagacctgcatagcacttccgttacaccgacccatttccgcagagcagcacaaagactacagggaagctagaagcagacgtggcggggatgcctgcagctgcaagaagatgcctgggaacagacacagaaactctcgctcccagataagcaaaacacagcagcacaaaggcagctgtttgaataaattcattggagagtctaaggcagcaatccggaccaagctgtaaaggagataagacagaaataatcacacaacagacaggccttaaaggtactggggttctccgccgggcccggtggctcacacctgtaatcccagcactttgggagcctgaggtgggtggatcacctgaggtcaggagttcaagaccagcctgaccaatatggtgagaccctatctctactaaaaatacaaaaattagccaggcatggtggtgtgcacctgtggtcccggcaactcaagaggctgagacaagagaatttcttgaacctgggaggcagaggttgcagtgaagtgaaatcatgccactgtactccagcctgggcaagagagcaagactccatctcaaaaaacaaaaggtaccggggttctcacagcttaatggaacttagcaagtcttttttttttttttttttggcctctgaccttctagttgaaacaaaattagttaccaatagacttaggcgaatgccatacggcacataggcacataacctcaacctatataagcactaagaaaatggtaacactttgatttggtctggtggaattatctccctgtatcttgttacagcaataaattcccttcttttctagtttctctgcttctcgttattgggcctcgagaaaatgcagccggacccggcttggttctgggcatagtgaatcactccacaacatccatttttctgttcaatgattctgtgacttggctgagcagttttcctggtctgatctggctcacctgccacaggagatctacaccagctccacccacgtgtctggcagttggttcaatatcagctgggaaggctgggcgtggtggctcatgcttgtaatctcagcactttgggaggccgaggtgggtggatcacctgaggtcaggagtttgagaccagcctggccaacatggtggaaccccgtctctactaaaaacacaaaaaattagccggatgtggtggcgggcgcctgtactcccagctactcgggaggctgaggcaggagaatcacttgaaccaaggagctggaggttgctatgagctgagatcatgccactacactccagcctgggcaataagagtgaaactccgtctaaagaaaaaacaaacaaactatatatgtattttatatatatatatattatatatatagtgatatatatattatatatagtgatatatatattatatatagtgatatatatattatatatagtgatatatataatatatagtgatatatataatatatagtgataatataaatatatagtgatatatataatatatagtgatatatattatatatagtgatatatataatatatataatatatagtgatatatatagtgtgtgtgtatatgtatatatatgtatatgtgtatatgtatatatatgtgtatgtgtatatatatatatatatgtgtgtgtgtgtgtgtgtgtatatatatatcagctgagaaaatagggctgccttcaccgtaggtttctccttacccaataggccaacctgagcttgtgcatgtggtcactgggctctgacaggagcaagagaaagagcaagtccccctaggccggcactttttaagcatctgcttgcatcgcgtttgctaatgtctcactggccaaaacaagtcacatggccaagccttgatttgaaggaaatagagaaataaactccacctcttgctgggaggagctgcaaagccagccttgtagaggagtgtgtatacagggaggagaggaaattggcagcattattctatgcattgttagcctttttttttttttttttttttctttgagacggagtctcgctctgttgcccatgctggagtgcagtggtgcgatctcggttcactgcaaactccgcctcccggttcaagcaattctcccatctcagcctccctagttgctgggattacaggcacccgccactgcgctctgttaattttttgtatttttagtagagacagggtttcaccatttggccaggctgaactcgaactcctgacctctcaggtgatctgcccatctcagcctcccaaagtgctgggattacaggcatgagccaccacacccagcctgtgagccattttcttctataatctctctccatgaataggaaacttggccctgctttctatcaaggcattctccgccacctcataagacacatctgtgggtgcctactcacccattaggatgcatgagcaaacctgcaagttcaagggagttaacacccaatggagcaacccataaccaaggggaaggccagaaccagtggcccctcttctacctctcagatggacaattttttctttttttaaacagggtctcactcccttgcccaggctggagtacagtggagtgatcagggctcactgcagccttgacttcccacattcaggagatcctcctatctcagccctgtctgaggtagcaagaccccatctctacaaacaattttctgaaaattaaccaggcatggtgcctgtagctctacctactcaggaggctgaggtgggaggatcacttgagcctaggagttcgacaccagcttgggcaacatagtgagaccctgtctcaacaacaacaacaaaaaacaatttaaaattagccaggtgtggtggcttgtgcctgtagtcccagctactcaggaggctgaggtgggaggatcacttaagcccaagaggtcgaggttatagtgagttgtgatcatgccactgcactccagcctgggcgaatgagcaagacaacatcaaaaaaaaaaggaagagaaaagagagagagagagatgacagaaagaaagagaaagaaaggaaggaaggaaggaagaaagaaagaaagaaagaaagaaagaaagaaagagaaagaaagaaagaagaaagaaagaaagaaagaaaaagagaaagagttcctcagattggctttctctgcttcctaatcccccacacttaccccttgagatcatttcccagaacaaaccaccttcatgcaaccccttgtctcatgctctgcattgaggggaatccaagctaagacaacactcatctttgtgtctctttctcctgctcaaaacctagctcagccccttcctatccactggctcttctccctccctgcagatgcctgctcaactgggtggtattttaacaaaccataaaaccaacacattactgatttcatgttcccttttgaaatcctcaaatgtcatccaacatattaatgatcaaataattgaaagctatgtaaccctcagagatttcacgaagtcgaataaaaaaccaataggttaaggtctgaatgtttattgtttgaataacttctatattgccttgaagttcattgtcagtcatcgtaaccatatggcaaatgtttggagtcttaaccggttgttgacttagctttgtgaaattgtcactgctctttaaatcctcataatatggtattgctgaaggatcaggtactaccaaacactggaaatataagaacttttataatttatgtaattaaaatatgtgatgctttccacttggggttagccagtttgaaaagttaaattggaatgtgtcatgatggacaaactccttgaaagaatcatctgcacttctggtctccatgcccccgaccccacccagcctaatctggcttcagctccctcctctcgcctaaaactgtgcccaccttgatcaccagtcgttttcttgagtacttttcaggtctgtatttcttaacttttcagaagcattcagcaatgtgggtgacttttttttaactctggttatgcccacctctttggccaccccagcaggtaccgcctaaatttctcttcctctgctcatcacttaaatttggggcttggccaggcatagcagttcatgcctgcaatctcagcactttgggatgctgaggtgggaggattgcttgagccggggttcgaggctgcagtgagctatgattgcaccactgctctccagcctgggagatggaacgagactctgtctctacattagttcattttggtgtgattcattcttccccaaggtaccagtgaccacgtgtatactgagggaaatcaaatatgtctttacatggagcaggtcactcgcttctcatccttgggtactaccaaatcattatccaaaatgcacccctcgaactccccacagccatacccactcctccttctctccttgggaatggtggctccaacagttactcaaggacacaagccagagagctgggagtcatccctgtcttctccttgcccctcacctatagtcaacaagaagccctgcccacccttcttccaaaatagacctagaatccaacccctcttctccacctgcactgcttccagccttgtcttgggcctcactgcttatcacctgcacccctgcgaagtgtcctaatgcatttccctgcatctgcccttgccctctgcggttcgtcctcaccatggaagcagccagaccaatcttaactccactacatgccactcccctaaatttgccactgccctcaggacaaaaagcagattcacctggcactcttttaacccagtggatcatttccatttcttcttcttcttcttctccttttttttttttttttttttttgagacagggtctcactctgtcacccaggctggagtgcagtagcatgatcatggctcactgcagccgcgacctccctggactgaggtgatcctcctacctcagcctcctgagtagctgggactatgggcactcaccatcatacctggctaatttttgtatttttttgtagagatggggttttgccatgttgcccaggctgatcttgaattcctgggctcaagcgatcctcccatcttgactttcaaagtgctgggatttcaggtgtgagccaccatgcccatcccatttcctctttcttaaaacaatatcttcacttggccttcaaaccatcactcctgatttctcttccacctcactagctacttcttttccttcttctttgctggactcgtgcaactccctaaactccgaataatattaagtgctctggggctcagtcctgggtctttttctcttcctgctgtgtcatcactcccttggtgatctcattcagtgtcatggctttaaacatccctatgccggtgacccccacattttatctcaagtccagacctcctccctgtaatacagactcgcatatccaactccccaccacatatctccacctgggtctctgacagacaccccaaacttcagttccaaaactgagttccttcctcatctccatgcccagcctatcccacctcagttaagggcagttcaacctttctgttgctaaggccaaaagccccggacttagaccttgactctgatctttctctctcatcatactctacccattagcaagacctgtcagccttggagtcaaaatatatccagcggaatgacatgatgtccagattcacttccaaataacacagtagggaatctagggatgggggtagaattgaaaccagactgtctataagttgatcattgttgaaactggtgatggtacatggaggttcattgtattattccactttgtttgaaatgttccaaaatcagaaaaattaaaacatactatttcactgctaccactctgatccaagtcaactgacctcttgcctggactgttgcagtagcctcctaaccatacttctgcctccactttcacctccactccaccctctgcttctaatttaatttcctcccagcagccaatgtgattaattccattaaaatgaaagaccgtgtcactcctccactcaaaactctccaatgtatggtgtcagactcctacagaacaacaaaaaatgctccccagtggttccccatttcattcagagtaaagccaactcctaacagtcgtcttcaagatcctatccactcctgctccttgtttatggaataaatctttttaaaaagatcttatatcctggctgggtgcggtggctcacgcctgtaatcccagcactttgggaggccgaggcgggtggatcgcctgaggtcaggagttagagaccagcctggccaacatggtgaaacaccgtctctactaaaagtacaaaaatcagctaggtgtggcggtgggcaccttgaatcccagctgctcaggaggctgaggcaggagaatcgcttgaacctgggaggtggaggttgcagtgagccgagattgtgccattgcactctagcctgggcaacaattgtgaaactccatctcaaaaaaaaaaaaaaaaaggatcctgtatctatttgccttgccaccctttactacttaaaccgcattcccttccactctctgctcttgatcactccgttccaggcacactgatgttccttatacttgccaccgggcagtaccaccacagggtcctcgtactttccactccttctgccatgaagaatcttcttccttctgttacacacgtggctcactctaccttcttttttttttttttttttgagacggagtctcgctggagttcagtggtgcaatcttggctcactgcaagctttgcctcctgggttcacgccattctcctgcctcagcgtcccgaatagctgggactacaggtgcctgccaccacgcccggctaattttttgtacttttagtagagatggggtttcaccgtattaaccaggatggtctcgatctcctgaccttgtgatccacccgtcttggcctcccaaactcttcaccttcttatgtctttgctcagatgtctccttttcagggaggccttccctaatcaccttatgtaagactgaaacctaaatacatgcccccaacacacacacacacacacacacacacacacacacacacacacacaacctcttaatcccttctcttgctttgtttttctgcttagcacttatcaccgtcttctttactataattttacctatttatcctatttgttgtttgtctccactaccagaaagaaaactatctgcaggtagggatttttcactactgtttgttcactgttgtatccacagcacctgcctggcacagagtaggtgcccagtaagtatctgttgaatgagtgaacgaatgagtgaatagcactccaagattcaatcctgcccacctgtccaggtacatttctaacctctcccctgctcaccctttcatcccaaggcacacagcacacttgagtccctggcatatcctagcattatttatacttctcagcctctatgctgtaccctcatcctcctggctggagtgccagtcttttttattttttatttggagacagagtctcatgctgtcacccaggctggagtgcagtggcaccatgatagttcactgcagcctgaaactcctagactcaagtggtcctcccacctcagcctcccaagtagctggggctacaggtggacaccaccacacctagctattttttaaaaaactttttgtttttaaaacaaaaactggagttttaaactccaggccaccactgcctctcacctgcaccactgtgcagtgtcctgaccatctccctacatctgttcttgcccttgcaatcatcctcaccacagaagcagagaagttacaagtgtggcaaagggcagaccggaattcaaagccaatgtggagtggggagttggatacatgagtctggatttcagggaagaggtatggatttaagatacaaatgtgggagtcactgggtatggtggctcacgcctgtaatcccagcactttgggaggccgaggagggcagatcaggagttcaagaccagcctgggcaacatggtgaaacactgtccctactaaaaatacaaaaagttagccaggcgcggtggcgggctcctgtaatcccagctccttgggaggctgaggcacaagaatcgcctgaacctgggaggcagaggttgcagtgagccgagattgtgtcactgaactccagcctgggcgagacagtgagactccatctcaaaaataaacaaataaataaaaataaaattaaaatgtggaagttgccagagtaaaaacatttaaacgctggctgaaatcaccaagggagtaagtctagaacaagaagagaaaaggacccaggactaagccctggagcacttaatattattcagagtttgggaagttgcaggtgtccagctatgttgcccaggctggtcttgaactcctggcctcaagtgatcctctcaccttggcctcccaaagtgctgggactacaagcatgagccaccatgcccagcccggatccccagtctttaagattcctctcaagcaggtgtctgctaacaccaaatgaaactcatctgccggcttcatgttttcatgcttttttcctacttaactcatcgcactggacttttgcagtctcttttttctgtgtctcctccaccgttctgggagtccccttggaacaggaacctcatcttattttgtcttcttggctcaatgcatgaacttcttggttcagtgcgtgaatcataatacctgttaaacccactctatgggccgggcgcggtggctcacgctgtaatcctagcactgtgggaggccgaggtgggcggatcatttgaggtcaggagtttgagaccagcctgaccaaaatggtgagacccccgtctctactaaaaatacaaaaaaaaaattagccgggcgtggtggcacatgtctgtagtcccagctactagggaggctgaggcaggagaatcgcttgaacccgtgaggcagaggttgtagtgagctgagattgcaccactgcactccagcctgggcaacagagcaagacccggccaaaaaaaaaaaaaaacaaaaaaacaaaaaaacccactctatgaatagtgagggtcaaagaggttagagtctggcacaggtagactagaattcccagtctgttctcttgggctccagattctcactccaccacctgaacactagtgagtcccttccgttcccaagcctcaatttccttagacagatgtaagcagttgaattgactaacaactatccaaccccaacctactgggcaagttgcctcctttggggtcaaacactatccaacttcagtttcccaacgtcataaaggagaactctaaaagttgagaatcgaaactgatgacagattgactagacggccagcctgttaaggtggccccagatattccagcctcagcccagagtcctcctgtgcccctactgcagcaagggtgtctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtaagactgggctcctccagcccccacgcaagacaaaacccagtatcagagtccacgtccctggggatgctggggacccctgtcctccttatccctagcccatgctgatgacatctcagaataccccatcccacctagctgtctacaccccactgcaccactgccttgagtagaatgagtctagtaataatagctcacatttgggggctcactggactaacctcttaacatacactatctctaattcttgcactctgtgagataggtactattctttgcccagtttacagattagcaaatggaggctcagaaccaatacaatgcgaggtccttggttggatcctagtgtgaatgaaccatctgtaaaatatagtttggggacaactggcctagatatcagatagtacatatatctgatatgggaaatcattgttgattttgttaggtgtaacagtagttttgtggttatcagaaggttgtcttttgtttggacacgaacactgaagtattttagggacaaagttccttggtgcctataatttactttaacgtggcttagattaagcacatgtagccaggaatttagacttgttgaatcaactagttgggtatatgagtgttagttgtatcatctatttttctatgtgttttaactttttgataataaaatgactttttttttttttagagacagggtctcgctctgtcacccaggctggagtgcagtggcacaatcaccactcactgtagcctcaatctccctgagctcaggtgatcctcagcctcctaaatagcttgggattacaggcatgcaccaccatgctcagctaatttttgtattttttgtagagatagggtttcaccaatgttgcccatgctggtctcgaactcctgggatcaagaatatgcccaccttggcctcccaaagtgctgggattacaggtgtgagccaccatgtctggccggccaataaaatgatttttgtttttgtttttttttttttgagacagagtcttgctctgtcaccaggctggagtgcagtggcacgatctcagctcactgcaacctctgcctcccaggttcaagcaattcccctgcctcagcctcccaagtagctgggacgacagcgcccaccaccacgcccggctaattttttgtattttagtagagacagggtttcaccgtgttggctaggatggtctcgatctcctgacctcatgatctgccctcctcggcctcccaaagtgctgggattacagtgagccactgcactcggcctaaaatgattttttaatggaggctcagagaggtgaggtgacttgcccaaggtcacacagtgttgaagctgggatttgaacttgactcaagggacccaagcccccctcactgagattttcccccaagcccttcctccagctgtttcatgccaccgcctgtgctagctaagatcaaaattcaagagggtcggagctagaaagactttggagaatcagacagtctcaccaatgactcacttaaaaaattaagtaaaccgaggcacagagagggtgagagataccccaaggtcacacagcgagttggtggcaaaggcaagactagaattaggacccctgactcccagcccagtgctcaagttctctctctaggggcaaccaactcacagagggatctagaagccctgggcccctatccgttctttgcacctatccccagcatatgaagcctgaggccatacaatttataagtgagaaaccacaaattttgatattagacagactcttcgcttcttcctttaccagctgtgtggttttgaccttcccactcttctttctcaaacccacattcttttcatctgtgattggggcatcatcatcatctctccctcaccaagccagtggtgcaatgcaggctgaatgattcatgcacgataaatgctcagaaacagaagcatcattataattcttgccaagctttcttctgggcctgggactcaagtctgactctggcagaccctcctagaccaccccctccccaacaaacttgagaataaagtggagggaataaggaatgtctggtaagaggaggatgctacaagaataagtttattgtgtgtgtgtgtgttccaccacgcctggctaatctttgcatttttagtagagacggggttccatcatgttggccaggctggtctcgaactcctgacctcaagtgatccacccacctcggcctccccaaatgctgggattacaggtgtgaaccaccacgcccggccaagaatgagtttttacggcaggaaatgctatttacctaagcctcaaatacttcctgcacatcatagccacttttcctcttgaaaccactaaatggtagcaatccccagtgagccatgactaatgaggaataatatatcttatttagagtctaaaccctcccgttccccaccctctgaaaatctagtgagcggagctggtccacataagggaatgctcgtcttcaaatgaattgtgcttaaataggtttaaaactgaagcaaatcaggaagcctgttctggatgtgttcttttctctctgcctggatcttaccagtgggaaaggcagaaagggaagtctacgccaggcacagtggctcacgcctgtaatcccagcactttgggaggccaaggtgggaggattgcttgagcccaggaattcgagaccagcctgggcaaaatggtgagacccccgactctacaaaaatatatataaaaaattagctgggcatggcggtgcatgcctgtagttccagctactccggaggctgaggtgggaggattgcttaagcccaggaggtcgaggcttcagtgagtgaagatcgtgccattgcactccagcctgggcaacagagcaagaccctgtctcaaaaagaaagggaagtctagactggccttcggggggaatgtgtccttcattcacacacagggtgccatctccaaccctctcccagggggtggaggtgctgggtctgaatgcccatggtcccttggaagcagggcctggctcacagccttgggtcacgaggaagaaagaggcggaagaaccatcccctacttgagttctggctctttctctgactctgctgccttctggctgggagaccatggcaagctcctcactgcctcagtcttctcatctgtacattggagataattctcctagtacccacctcaatacaggaagtgaaggcgtttttttttgttgttttgttttgtttagatggagtctcgctgtgtcgcccaggctggagtgtagtggcgagatctcagctcaccacaacctctgcctcctgggttcaagcgattctcctgccttagcttccccagtagctcggattacaggtgcacacaaccacacctggctaatttttgtatttttagtagagatgtgctttcaccatgttggccaggctgatctcgaactcctgacctcatgatccgcccaccttggcctcccaaagtgctgagattacaggcatgagccatcatgcctggctgggaagtaaagattaaaaggaataatatgtatacagggctcttatgggtgccagacacagggcgtgctcatgtcatccagcatccgtgctcatgtcacacagggcatgttatatcatccggcaacagctggaatctgattcttgtgcagtgactccaaccaccaagaaaagtagccttctgggggtctgatgcctccctagcaattccacctcccaacacagaatgagaaggagaggaggccagagagttgtggcgctttgcataccagaggcaccagggcctggagagctcatctagaatctcaaaacatcgaaaaatcccttctcgacctccttccattactaacaggaaaactgaccccccggcagcagaagagattgtctaagtcagctggataatgagaagaaagagaaatgtattgctgacttcctgtgtgccaggcaccccaccaaacgcttggcatacattatttcatctgatcctcccagtagcccagtgactcttgttccaacattactttcattttacagatgagggtctcaggagtcagaatgtttacccagctaagaaacagggaagagtcaagatctttttcaggctgctccatttcacagcctatggctcttaaatccaccaggcaaacttgctccttgctttataatgtcatgaaattattcagccccaccaccacccccagaatcctcaaacaaccctatggagtagatgctaccattcctctggagtaggccttactctgtgggtaagaagactgggtctcagaagcaatgcagtgtagtagataagaagctgggcatttggggaggccaagggggcaaatcgcttgagtccaggagttcgagaccagcctgggcgacatgccaaaacccagtcactacaaaaaatacaaaaattagccaggcatggtggcgcaggcctgtagtcctagctacttgggagactgaggtgggaggattgcttgagccaagatcatgccactgcagcccagcctgggcaacgggagtgaaaccctgtgtaaaaaaaaaaaaagagtctgggctctgagggctgcaaactgcgagacctgagacaaatgactaatgaggagaaagacaaatgtgttgctgacttcctgtgtgccaggcaccccaccaaacccttggcatacattatttcatctgatcctcccagtagcccagtgactcatattctgccattgctttcattttagagatgaaggtcttaggagtcagaacatttacctagctaagaaacagggaagtgtcaagatctttttcaggctgccccatttctccatcccatgtctcgagatcctccagacatctcagttttctcacctgtaaagtgtgggtattagtactacccacaacccatccctcagcgggtggtgagcattcagtgagacagtgcatgtgaagtgccgcaggggttgcctggctcatggcagtgggcctcagggtgacggggctctgtgttctgcaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctgggtaaggggaggggaagctcacccgactcacacacttgcccaccccaggagacttcccagtgtctcacctttactcatggccacgtgcacacacccacatttattcatttcatctgtgtcctatgcttggggctgggttattgcagtgcacaggattaactcaactctggctatcatattgctcaacttggaatacagaaattgaccaaagaattgcagagataaatacatgattgcagcctgggcgcggtggctcacgcctgtaatcccagcactttgggaggccaaggcaggtggatcatgaggtcaggagttgaagaccagcctggccaagatggtgaaataccatctctactaaaaatacaaaaaattagctgggtgtggtggtgggcgcctgtaatcccagctactcaggagggtgaggcagagaatcacttgaacccaggaggcggaggttgcagtgagtcaagatcgcgccattgcactccagcctgggcaacagagcaagactccgtctcaaaaaaacaaaaaacaaaaaaacaaacaaaaaaacatgattgcaaatggtgtaaatgctcagagaaaaagaatggggtggcctgggtaaccacagaaagggtgctcaggaagtgactttctggggaaacaacattcaggaggctctgacacccagtgaggggaaggagctaaaagtgggagtgggggtctgtcactgcattttatagaagcagatcctaagacatggatgtgaggatacgcagtttatttgggtattcctcccaggaaacaccggtagggaagtatggaactgagatgggaaaggcaagaattcaatacaacgtgcgtccatgggcaagtcaccaccctgagcttcatgtcctgggagaactcacagtcccattatggagcgaacctcttcgggatcccaagtgggacgctggcgtgcttactcaccagcttcccagccgtcactggttgggggctgctttgggagcactaactcactggcccctgttgtttgtcctcgggcagagtcctaggtgtttgaagtaaaacctacatgctgcaagcccagatcctagaggtttcatctcatgtgctaactcctatcagctgtagtggctggctgcgtggagttgctctttggagaaggtataagagacaggatctgattttagcaaggaagagagtgctgggatgtctcagtgatgtgtaccatggaactggttcctggttctccctatgagtttatatatatatatattttttgagacggagtctcgctctgtcgcccaggctggagtgcagtgccgtgatctcggctcactgcaacctccacctccagggttcaagtgattctccagcctcagcctcccgagtagctgggattacagcccgccaccatgccatgcctggctaatttttctatttttagtagagataggatttcaccatgttggccaggctgatttcaaactcctaacctcaggtgatccgcccacctcggcctcccaaagtgctgggattacaggcttaagccaccacacccggcctccctatgagtattgaaagagatacaaaacagatattaaagaaaatgagggacattgaggacatccagggaggggtctgatgcatggaaagcccaatgttggttctccagagtaagaatttcacaaaaaggacaattagacaaggcaaacctttggtttctgaagatatgaggtctcaagtgtccctggagggatacttccaatgtaaaggcaggctctccccaaaatactacttaccaccctctggcttcctcaatccccaatctcttcctttgctccttcactcctcagggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggtgagggggctgccaggatggcaggggcaaggagagggaagagggtgaggaggaaaggcagggcctgattttcatctcaggaagctgcagccaggggaaatggaagcaggtagagagggagagaatgctagtcttttgaaatgtaaagtgaaaccgtcagtgaagaaggtggaaaaggaggagaggaggaggaagaggagaaagaaacagagaaggaaggagaaaaataggtgctctacagtatttcagtaaactagttatttttattttattttattatttttttttgagacaggatcttgctttgttgcccaggctgtagtgcggtggtgcaatcaccactcactgtagcctccacctccctggatcaagacctccctggctcaagtgatcctcccaccttagcctcctaagtaactgggactacaggcatgcacaaccatgcccagctaattttttttatttttcttttgtagagacagggtctcactatgttgaccagcctggtttcgaagtggtctcaagcgatcctcccaccttggcctcccaaagtgctgggattacaggcacgagccaccacacccaccccacatgttcttgttacccttcaattacagtctaggcctggcagatgtcagcttcgccgggtactgtggccattcgtcacagcaggttaaggactaacaaggggaaggatttctttaattccaccccaggagtcgaaaagagggcatgtgtgagtgtaaacagccctcagggacatttctcaggcagcagctcagtcagttttggaaacaaaatcttcctccgagataacggaaactccaactgcaaaacagaactcagagacaaaaatcatttattatatagaacttgcagagaagttacaagggaatcagacagcagaaggaaagatttgatccaataaaaataaaataggctgggcatgatggctcacgcctgtaatcccagcattttgggaggccgaggtgggcagatcatgagatcaggagatcgagaccatcctggctaacacagtgaaaccccatctctactaaaaatacaaaaaaatagccaggcgtggtggcgggcgcctgtagtcccagctactcgggaggctgaggcaggagaatggtgtgaacccaggaggcggagcttgcagtgagccgagatcgcgccactgtactccagcctgggcaagagagcaagactctgtctcaaaaaataaaataaaatataacagggatttaaagaaaaaacaattaccggccaaatgtggtagctcacgcctgtaatttcagcactttaggaggctgaggtaggaggatcacttgagcccaagggttcaagaccagcctgagcaacatagtgaaaccccgtctctacaaaaaatacaaaaatacaaaaattagctgggggtggtgatgggttcctgtagtctcagctgctcaggaggctgaggaggaaggatcacttgagccccggaggtgaagtaagttgagctgggtattttttttatctattcactaaggcttacatcttacagattacaggcatcctacattttatatatcatctaagttttaagaatgtaacatttcactaatattgaagaaaataagttatattaccatgagtttaaatttctaacaaaattataatgttattagttatggtttacaaaattgagtgttaaggatgaatttgcaaaaagttacaaaacaaattaattaacttataatttttttttttttgagacagagtcttgctctgtcgcccaggctggaatgcagtggcgcaatctcagctcactgcaagctccgcctcccgggttcatgccattctcctgcctcaacctcccgagtagctgggactacaggtgcccgccaccatgcacagctaattttttatatttttagtagagacggggtttcaccgtgttagccaggatggtctcgatctcctgaccttgtgatccacctgccttggcctcccaaagtgctgggattacaggcgtgagccactgagcccagccttataaatacattttaattcaaaattgaatttctaaggtcaaggataaagtttttttgttagtaagtcagtgacctataggaaaggcccaaggtttcatttatttgggagatgagaattatacaagatgattctgtgtttgtttcaaggccaaagtgttatagcttttttttttctcctctgactttgggatgggagctaatattcatatatgatggccataggaaaatatgtcagttttacttccacaaatcaaactactgaatatttgaccaaaatttttcactttctggctaaatatcaatgtatcagtgaaattctttttttttttttttttttttttctgagacaagttctcactcttgcccaggctggagtgcagtggcatgatcttggttcactgcaacctcctcctcctgggttcaagcgattctcccgcctcagcctcccaagtagctgggattacaggcacctgccaccacacctggctaatttttgtatttttagtagagacggggtttcaccatgttggccaagctggtctcgaactcctggcctcaagtgatccacccgcctcggcctcccaaggtgctgggattacgggcgggaggcactgcgcccggcctcagtgagattcttaacacaggaagtgaccactgtcagttaagatgcttccttttgcaagtaagagaaaaacacaaaaaccaactcaaactggcttaaacaataaagggaattatcagcttatgtaggaaaacccctaaacagtagggggggcgggcggggggggcgggtttcaggcactggtgagggcactggctctgtttctctggaattctctcagcttctcattcctctatatgtcagcttggtcctttggcttgtttccctcttggtggcaaaatggccacaactattcctgccctcatattcacacatgggaggacttctcttctttcaaccactgaacaaaagaactaggctttactctagttgagccaacttagatcgcatgccttctcttgaagcaatcacttgcaagggggaaaggtttatgctgataggactgtgccagtcagggcccatcctggagctgcgggtgggggtcaaccccttccaaacatcatggctactatgcaatggggaaggaaagaatgtctgctagagaggcaaccccaatcttcactacagaatctcacctattaccattttttccctctatctaaggaaacctttcctttcttttaagaaacatttctcagcagctcaatacattaaaatagatttaaatgggactgcttaggctagaatgtttgtgaccgagcgcaatctgctcatacctgttcataagttcattccaggagttacatctgttgagcatatattgaagcccaatggactaactcagccctttaattctaaaatggtgaaacctatgtctagagatggaatgtgacatggccaaggtcacacagccagtaggcagcagagccaggactagaacttggatttctcagcttctggtccaacgccatccttacacagaatcttagggtctctctctctctgtcttcccatctctttcaacagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggtactggaccactgtttgcccaccaaatcttacagaaaaaaagagagacgggctagtgtaacgtggcatagagttttatggattggctgtattaagcagtaaggctgccaccatagttgagcatcgacctcccacaccaacacagctggcatctcaagttggtggcttatcaaagtcactggggggccatggggcgggtagaagcctgttccttgtttcctaagccaccctccaccttagcttggccttcttgctctctgaagaccatttcagtgctttgtaggagctagcatgggaaaatggaaagaatcttggagactcaagtttaaatcccagctcagccattttcctactgctatgagcctcaatcccttatccataagacaggagtaaactggaacctacgacataggattgatgtaagggttggagaaaatctgtgttaaggatccacaatatctagcatctggcagatgctgagtaaatgcttatattggagcatgtgctgtcagcgtcccattcatatcctctcggcctttaccgttctagggaaggttggttccacttccagctgtcagcacctgcatccctttgccagcagacccactctgagaagagccctccaccagatctggtgggagttggtggataaataccacagctccctcacccaaaagatggaaggaatctgggtctcattgcgtaactttttttttttttttttaagacagagttttgctctgtcacccagggtggagtgcagtggcgcaatctccactcattgcaacctctgcctcctgggttcgagtgattcccctccctcaggcttctgagtagctgagattacaggcgcctacaacccacacccagctgatttttgtatttttgtagagacagtgctttgccatgttggccaggctggtctcaaactcctgacctcaggtgatgcgcctgccttggcctcccaaagtactgggcttacaggcgtgagccaccgcactgggccccattccatactctttcctaaagatcgcctccagtggaccacagtagtaattacttcaatacccactctttgttgtctgccttcccttatctgtctcactgtctcactcccttatttgtgcttcctgggatcactttccaaataagccaaatccttatctggggatctgcttcaggggaagcccaacccagacaactctctgtgttagaagctctgggcctgtgtaagcaacatcacagtatttagtgttctgttatgtagtattgggtctcttttgtaaggaagaaaagccaggtctgctcatgaaaagaggatttattataaccatggccagaaaaatcgagaaagcatcaggacctgagactccctctctctctctgtcactctctctcatgaactacagcacttttcccctcagcctctgcttctctctccacacctgtccggctcccctctgcctcccaggtataagggatctccatcatccccatgtccaaaccccagagagaaccagtctgattcctggtcacgggacacagaccccatgtgttgggtcacctgccagccaacagaatgagccactttagatcagtgaccccaccccataggacagcctggcactttcaggcaggactgttttagggagcagtcagggttgggaggagccagcctggagcccaaagtccagttcattccagtagcctgtgtcacattcgattacacagatgaagtcgcagctccctcccaagccctggagtacaaagggctgggttttttttgtttgtttttgggttttgtttttttttttttaatggagtcttgctctgtcacctaggctggagttcagtggcacgatcttggctcactgcaaccaccacctcctgggttcaagctatcctcccacctcagccacccaagtaactgggactacaggcgcctgccgccatgccctaatttttgtatttttagtagagacacggtttcaccatgttggccagcctggtcttgaactcctgacctcaagtgatctgcccacctcggccccacaaaatgctgggattataggcgtgagccactgcgccccactcaaagagctggtgttaatcatggacttgcagtcaccccaagttaataagcaagcccaagatccccttcaagccaatattctttaaaatatttattcaatatttatagaaaggagagacttttgggggcagcccaacctctgctctgttgaggaggtagatgggtaagagcccccatctactggctgtaagaacttagggcaatctaggccgggcaccggtggctcatgcctgtaatcccagcactttgggaggccaaggcaggtggatcacgaggtcaggagttcaagaccagcctggccaagatggtgaaaccccatctctactaaaaatacaaaaattagctgggcgtggtggcgggtacctgtaatcccagctactcaggaggccgaggcagagaattggctgaacccgggaggtggaagttgcagtgagccgagattgcaccactgcccttcagcctgggcgacagagcgagactctgtctcaaaaaaaaaaaaaaaaaaaaaaaaaggaacttagggaggtctgtaaaaaggggacaaccacaacaataaacaataaaaataacagtccctaccttatagaattgctgtaagattaaaataggttaatctgcataggatttggccttgtgcttcaataaatgtcagtagttggtggcagtggtgtttctactatccaaagtaattcagcagctctaaccttaaacttaaacttgcaaaacctgctccgaaggtacagggccccccctgcctgaaagggcatctgttattactccagcatgcctcttggggcctcattctccccctaaattccttgcaaacacttaaggcactatcccaaagaagaagaatttttttttttttgagacagtctcactcggtcacccaggctggagggtggtggcatgatcttggctcactgcaacctccacctcctgggttcaagcaatgctcctgcctcagccttctgagtaactgggatgacaggtgcgtaccaccacacctggctaattttttgtatttttagtagagacagggtttcaccacgttggccaggctggtcttgaactcctgacctcaagtgatcctcccgcctcagcctcccaaagtgctgggattacaggcgtgagccactgtgcctggcccagataggaattcttggaaatagcattgtctccatcctgttactctcctgcggtgttttggggccctcttgaacatccccgggatgtggatatcacaattctcagtggctggacgaaataattgccgagaaggtttttttctggcttgaaggccttcaaaccattatgagcctgggcacccttttcctgtgttacaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaaggtaatggctcctctctgggctgtcaagggcttgaaggtcagaacgacagataaactactcagtatttactcattcagttctgtgttgatggagaacagaactttagagtcaccgtttaagggccagctgcaccacccatgggctccgtgaacttggacaaattctttggctctcagagccttgggtttcttaccttcaaattcttgttctcctttcctttctttttcccataatttactggagaatcagttctgtgttcctgatcattctttgcgtgagttgggtccagccaagtcagctcaatcagccattctgtgccagtgctgttctcagggatggggtaggggatgtgggctgggggacaacacaggcacagaaataagacatgaccacgacgctcggccaggtgcggtggttcacgcctgtaatcccagcactttgggaggccaagacaggtggatcacttgaggtcaggagttcaagaccagcccggccaacatggaaaaaacccatctctactaaaaaaatacaaaattaggcgggcgtggtggcaggtgcctataatccctgctactccggaggcagaggcaggtgaatcgcttgaacccgggagctgggggctgcagtgagctgagatcgtgccattgcactccagcctggacagcaagagggaaactctgcctcaaaaaaaaaagaaaaaaagaaaaaaaaaagacaccaccctcactctcagagaactcaccctatgttgtcaggaagcaaatccatgaaacaaacttacacaaaactgctagaattaccagagaagacaagatactctgaaaacaaacaaacaaacaaaaaatactaagtcatattattatatgatgccaaacctatagtataggcagagatcacaaaaatctattttattaacatcacactttctagtgtgcaaagctcttgtccaaggtctgtctcagttgatcctcataagcaattctgtaaagtaagaaggtcgagtgttatcactatctttattattattatcatcattactattattgccattttacagaagagaaaactgaggctcagagaggttaattaactaagggcactctgctaagaggcagcagaaccaggggctctgggggtctggaagcagaataaatgttaactgaagtcaccagagaagattcctttaaaaagttaggagttgaaatgagccctaaaggccggggggagatatagacactcagaacagaggacaaaggatgatgaggggtaaaggatgggaggctgggatgagcaagatgtgtacaggacaggagactgaactgcttggagcagaaggcagaagcagaatcagaggctccagtaaggtacatagagtataaacggggggacccgctggccaaatgaggaggcccacccatgggctggaaaatatacgcctctggatttttcctgaatataaaagccattgtaggctgggggcagtggcgcacgcctgtaatcacagcactttgaggggctgaggcgggtggatcccttgagcccaacagttcaagaccagcctaggcaacatggtgaaaccccgtctctactaaaaatacaaaacttggccaggtgcggtggctcacatctgtaatcccagcactttgggaggccgaggtgggcagatcacgaggtcaagagatcgaaaccatcctggccaacatggtaaaacctcatctctactaaaaatacaaaaattagctgggtgtggtggcatgtgcctgtagtcccagctactagggaggctgaggcaggagaatcgcttgaacctgggaggcggaggttgcagtgagccaagatcgtgccactgcactctagcctggcaacagagtgagattccatctgaaaaaaaaaaaaaaaaaaaagaacaaaacttagccagatgtggtggcacgcacctgtggtcccagctactcaggaaactgaggcgggaggatcgcttcagcttgggaggtcaaggcgcagtgagttaagattgcaccactgcactgcagcctgaggtgacagggcaaggccctgtctcaaaaaacaaaacaaacacacacaacattgtgcaaatattttttatcttggctagtcagaaaacttggcaatgccaggcttatatttctttttctttttctttttttgttttccttttgagacagagtctccctttgttgcccaggctggagtgcagtggtgcgatctcagctcactgcaacctccacctcctgtgttcaagagattctcccacttcagccttccgagtagctgggactacaggcatacgccaccacacccggctaatttttgcattttttggtagagataggttttgccatgttggccaggctggtctcaaactcctgacctcaagtgatctgcccgccttggcctcccaaagtgctgggaatacaggcgtgagccactgcacccagccaaggcttatatttcttctggaaagaatcagctagaggcctgaccctcgccagcattttccaggtgctctccagccacctggggctctcaggccctggagtgtagcctctggaggtggtgagaacacagactctggagtctgaccaacctcacttcacatatctgccctgctccttactacctatgtgattggtgttcagtaaattacctaaccctgctcagtttcctcatcaataacatgggggtaacagtagaaccaaccaactaatagagatgctctgagaataaaatgcattaagggtatggaaggtgctcagcatacagcctggaaagtgcttaccactccctaaacatttgctgctgccgctgctgctgctactattgtaaagataaggacagatgaagggaacatttgcacatcagacaaagaagtgtggacttaacacctctccttctccctctcccttccagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggtgtggttgtgcacatttgtagtctcaggcactcaagaagctgaggcagaagaatcacttgagcccaggaggctgaagctgcagtgagctgtgatcacaccgctacactcctgcccaggccacagagcaagaccctgtgtctaaaaactaaaacataaaaataagtaaatccgtttaaaaaaaggattatcccagccctgccagggggaggatgaggaggggtgtgaggactaaatatacaaataaatagtgtggtcacatgacgcacagcaacagaattcggacccacagccttctgcagcaatcaaccccaaaccatcaggacttgggcgataactggcagcatctctaactccccaccctactcccatcctgcttcctatttatgaccaacccaagaaacccaaataagctccccagaccaatcacatggttagccccacttctggtgagtgcacttccagcttccccataccaacagcctcaatcacggcatccctgaagccttcccattttcctgcctgtctttaaatctctgtcaaaagcgagagatgggtggctggttcctttgctatagcaagttgggaataaatcgcctttgttagttctcatttgggggctgtttatttccacagggcctaatgctgtcctaatggttattgcttgatcatttgagcttctcaactctaagaaatgaggactggggaaactgaggcaaaaagagacaaagaatgggagattgaggatgatgcagtgtaaaaaaaaatcacctcaactcctaaaacccatacacaaacagtacataatagtcaggaaactgtaggaaagtaatagcatctttattatcaaaggacgtcatgtgatcaggtttactccaagcaataaaaagtttccttttgcccccctgttttgcctagttttctggtgggctactctcctaccatagcatagaaaatgcacactgcaattggttatcaacagcctctggtcaatttagcaatcataatctgtgtatctcccacctctgtttgccttcagggacagaaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaatgtcttagtccatctgggctgctaaaacaaaataccatacactggatggctcatgaacaataaccatttatttcttacagctctggaggctgggaagtccaagtcaagacactggcagatttggtgtctggtgaggacctcttcctgattcacagatggcagcttctcactaagtcttcacatggtagaagaggcaaaggtgtctctaggatcgcttctttttttttttttttttttttttgagatggagtctcgctctgtcacccaggctagagtgcattggcatgatctcagctccctgcaacctctgcctccgaggttcaagcgattctcctgcctcagcctcccgagtagctgggactacaggcacctaccactgtgcccagctaattttttttttatttttagtagagacggggtttcaccatcttggccaggctagtctcgaactcctgaccttgtgatccacctgtcttggcctcccacagtgctgggattacagttgtgagccaccatgcctggcctctggggtctcttttatgaaggcattgatccagttcatgagggctcaggacccattatgtaattgaaagattctccgtggggcctgaaagcttaagagaatgaatgacccctccctcccctccctccttgggcccggtcccaaggcgcaaggccactcgcgccagcagcatgtgtcagcaagatagcagaagcgggaagagagcgggccagaagacacctaccccctgaagaccgagagagacgtcatccgggtacaatgtagcggttacaacagactgagaaacttcctgtttacaggagactacaaaacccctgccccgtcctcatttggtgctgacgccattttaagcctcagcccacctgcacacacactgcctcatgttgtctgttggccacgctcttggggttcgaaccaacacaagaccctttcactaattacttcccagaggtcccacctcctaataccatcaccttgggagtaaggactttttggaaattatcagtatcaaaatggagtcacttatgtcaaaccctaacaaatgcctgtcacaaaaattatctcaagaagttcctaaaatccgcagtattatagataaaccacttgcataagaatatttgcctaacagtgggtgtctccacaataagctaaagccaactcctgcaacaggctcctgtgatcaacggtacttgttttaaagaagcttatgtggactttgtcttttctcgttgccacaacctcttttaatgtgcctatagtccactatagcatgcatatctcaaattgcaattccttgcaattctggaataaacgctttattttggagagtcagtctctctgttatttattttatggtgtcaattttaacatatgaattttggaggaacacattcagaccatatcagtcaccttcctcttctttgaaatagaaaaagctcaaggccagagagtttattttagtaaagttttgacatacctgtcttcaaagataaaacatgaaacagcattccacacacaaaagtaaagtgattttgttcatccttcactgtgaggtattttaaccacagagattctaattttttggtcttggatgggtcctgggagtcagtattgcctggctaatttttgtatttttagtagagatggggtttcaccatgttggtcaggctagtctcgaactcctgacctcatgatctgcccgcctcggcctcacaaagtgttgggattacagatgtgagccaccgtgcccggacaggattctgcatttctcttttttttttttcgagacagagtctcagtctgttgcccaggctggagtgcagtggcacgatcttggctcacctcaacctccacctcccaggttcaagtgattttcctgcctcagcctcctgagtagctgggactacaggtgcgtgccaccatgcccagctaatttttgtatttttagtagagatggggtttcactatgttggccaggctggtctcgaactcctgaccttgtgatctgcctgcctcagccccccaaagtgttgggattacaggcgtgagccaccgtgcccagcctggattctgcatttctaacgagctcccaggtgttaccaatgctgctggctcatggactacactcttaagtagtaaggccctaggctattaaaggaaatacagattcctggattccacctatcagagattctgattctgttagtattttctgtgagacccaaaagtctgcagtttaaccagctctctaaggtgtttcttaggcccagctggactgggaaattactagaataaatgacatggaatcaaaacctgggaactaatcctgggtctgtcattaactccttaggagattcccatcccctctggagatctgtcatcaagaaatgattggagaagttaatctcttaggcccttctagctcttgcctttgagaaccgcccacctccccattcccacctggtatccccaacccagtacagttcatggccaatggcggtccaagtcttggaactacaatccccacaatgcctcgcgcctctcctctcacgtgacgtcatgaaggaggcttgataacggcggtgttctccacaatcctttgcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccggtagggtactatgtttggggagactggctgaggggcgtgggatcttcccctggagcctgagaggatggatggtgaggagagagtcactgggactcggcttccttccccgagagacctccagggactgggtgtagtgcagattgaaagcatgggcaggtgcagtagggagggtatttcattattccagtcggggaagctgaggtacccaaatgtcttttgattctgcctccttgggtctatcctcactgccccacactgggaaggctgccgtctcttcgagataactgcaacagccccctcccggtattctcgcacccagcctttccccacctccaacacattctcccaccctggaggttgttgccaagagcagtgcccagcacatcactctgaccgtgactccctagtgccctgggaataaatacagagccccgcaacatcaaggggcctaatcatggatagaacccaagggttcttgaatttggaatgaaaacatgttgcatctttgctttctattcatctctgactgaattttagcatctctttccgtcttgcaagcactaagccacagtagttctggcaatgccgttactttatcccaacagaagtcacagattttcatatctcattacaatctttgcagatacagatatcaatatatcattttattgataaaaagatattggggaaaaaagtcatttacactcatccctgatttaaaatgtgccactctaatttttagacccatctctatatctaagatgtaagaagcacatacatcacaagtttggttgtttactatcatgataattaaatttcggtatcattggttttctttgtaatcctgtatgttgcatttcatgcatttaaaacattgctctgagaagagaaccgggcttcaccaggctgttagagaaggctatggcaaagcaaggttaagaaccgctggatttgtttaaaaggacttacaagccctttggtgatccattgccttcctctcccttccttccctcctgccatactgcacttcctgtaggtagcttccagaccatagtctgcccctctcaccccctagtaccataaccacagttttctctgcaagttctatttacagatctgcctttccatctcattagcggtgggaacttgagcaaagtacttaaatctcactgtacctaaatttcctcatctgtacagtgcgggtagtgatagtacccaccccataaggttgagaagtaactgagataatgcaatctacagtgcttggcacatcttaaaggcccaatacatggtggcaaatatgtggttggtctttccacatggactgctttcctcctcctgcctaattctcgctcttttttttttcaaaactaggactcagtctgttaccgaggctgacacaatcatggctcactgcaacctcgacctccccctactcagatgatcctcccacctcagcctcccaagtagctgagactacagatgtatagtcccagctactttttgtattttttgtagagatggggttttgccatgttgcccaggctggtctcgaactcctgggctcaagtgatcctcccttctcaaccttcaaagtgctgagattacaggtgtgagccactgtgctcggcttctagttttttttgtttgtttgtttgttttttggggttttttttttttttttgcattttttttttttgagatggagtttcactcttgttgcccaggctgcagtgcaatggcacgatctcagctcactgcaacctctgcctcctgggttcaagtgattctcctgcctcagcctccctagtagctgggattacaggcgcctgccaccacgcccagctaattttttgtatttttagtacagacagggtttcaccgtgttggccaggctggtctcaaactccagacctcaggcaatccacctgcctcggccttccaaagtgctgggattacaggtgtgagccaccgcgcctggtctctttttttctttttgagacgcagtctcgctctgttaccaaggctggagtgcaatggcgcgatcttggctccctgcaacctccgcctcccaagctcaagcaattctcctgcctcagcctcctaagtagctgggattacaggtgcccaccaccaggcccagctaatttttttttatatttttattagagacagggtttcaccgtgttggccaggctggtctcgaacttatgacctcaggtgatccgcccaccttggcctcccaaagtgctgagattacaggcatgagccaccacacccagcctagattacattcttgagtgcgtctagtaatagccaccaggagttgagaattttctttttgcccctgttctaaacactttgtatttgttgtctgttttcatcttcccagcaatgccacaagagggtgtattagccccattttacagaaaactgattctcataatggtaaaataacttggccaaggttgtccaatttgtgagtggcagaaccaggcgtaaacccaggcctacctgactcccaagtccatgctcttcattgctgctgtgccactctgccatggacaagtgtctattgtggtcaaaactcccaccctttggtccatgactgtggaaatataggtcactattttatttatgtaacctctagagacagctcttaaatccagtgatgaactcgtcactcaaaccactttaattttagggtagcatctactttgacttatttttctgacaattaattcaaaccaagacactatggcaggatctggggatacagaggtaaaaagaggcagaccacgtattcaagtagcttacaaatccaggaaggggatgggtatggaaacagcgtccacaacactgactccagaaggttggtaatcgtattcccattttatagatgagaaaaacaaaggctcagggagagaaagtgacttgcccggcatcacacagcttggtggcagagccaggactcaactgaactgtctccctctgtaatactgtttctgttccctgacggtacctcaccttcatcacactgtagtcatgatggaagagatgctcttcttccaagtgattatgtgctgaagacgaaagaccaggtctttaaagactgtccatccaggcccccacattacccacctccaggagcatggggcgtgtttagcattctgtgttgtgctctggagtacagtgacacagaccacaaggtactaggacacagatgcaatgtgtatgggtgatgacataaacacagcagtgcccccatggagctgtttcttacaccatggccctccactgggcccggagctaccaagtgtccactttgttcagttggccccttaaatatacaagcacgttttgtcttgttagttaagtcagaaacctcagagctaactttcactcatttctcacgccctgtagtcagtccatcagtgaatcctattgactccatctttttttttttttttttttttttttagacggagtcttgctctgtcaccaggctggagtgcagtggcgtgatcttggctcactgcaacctccgcctcctgggttcgagcgattctcctgcctcagcttctcaagtagctgggactacaggtgtgcaccaccacacccagctaatttttgtattttttagtagagatggggtttcaccatgttgaccaggatggtctcgatctcttgacctcgtgatccgcctgcctcagcctcccaaagtgctgggattacaggcgtgagccaccgcgcccggccttgactccatcttaaaagtgcatctatctggagttcacccacttctcaccacatcaattactgcagcagactccgtgttcctgcctttgccccaacagtctcacgctgcacagcagccaaagatgttctgtcaaaacccaggtcagtttatgtcccttctctgctcatttccagagctcctcctcctcaaagtccaggtcctcccattggcccacgtcagggcccttcatgatctggcccctctgagttctccatctctgctgctcccggtttactgggcaggctctggtcacactgacctccttgctggttctaaacacacaaagcaggctccagtctcagggcctttgcagatgctttccctctgcctggaaggctgtgtcccacatgtccacttggttcactccctctcctctctcaaatctctgttcaaatgttgccttatcagtgaagccctctctgcccacctttatgttaacaatccccagcccaacactccccacctctctcgcctactttgtttccgtttttttccatacacttagcattatccaacttgacattttgtttacgtatgtgtgtttatcatctctctccaccaactagaatgtaagctcctgcagacagtgatagtcgagtaagttgctcagcaatgacaacacctggttaataaaaggcattcagtatctggtttgagggaatgaccaaaaggccgggcatccccaccgttttggcttgaaaaatgtgatccacaaaagagccatcttctctctcttccacggcacttagcacacagccaggcaggcattaaactgtgcagtcaaatcacacttagacctgcctgttcagcacagcgtggtggttaagagggggctcaggagtcagatggcctgggcccccagcccaaccctgtcacttattaggtatttgactctggccaagttattttacatatctttgacgtttcttctgcaaaatgggataattgtaatccctccaatcgggttgttgggaagattcactgagttatatgtgttatatatattttaagttacatatataactattttaagttttatgtatatataactaagttatatatataactattttaagttttatatatataactaagttatatatatattttaagttatataactaagatatatatatatataatgtacttacataaaatatgtaactatattatatacatatataactaaattatatgtaactatttgaagttatgggtatataactattttaagttatatataaatataatatatatgagttacatgtgtatgtatatatatgagttatatgtattttaagctgctgaaaatagtgcctggcacgcatttgttgttgctgtcattgtttcctctataaatgccctaattttcatttttccacaggtgctgcaaatagccagttgtcaacctcccaaccgagcctcaggtactatgcactttgggttcaagtttcacttattcaacaaatactgatcccctgcgtgtgccagatgctaggcttcacgcctggcatttccaggtgaacaagacacacatggtccctgtgctcatggggacagcttctgagcgggcaggaagtgaggtctctttgtgtgtgtcgtaggcataaggtgaatgagcatgaacaagatggcaacgagcttcagaccacccctgaattccgagcccacgtagccaagaagctgggagccctgctggacaggtaaacaaaggtggagtttctcctctcttgcccttgttaatatgaacagcaatggctcacattggctgggagctcacggtgtccaggctggcacggtggcaggcacctggcatatgtcatctccctgcatttataaagaacattatcatgtgggtcctgttgttacctttatcctccaggtgaggaaacaggctgtcagcaaggagacaggtgtgcctgaagtcacatcatcatcgcagctaccatttactgagcaactgtttgtggccaggctctgtgctaagtgcttgatgtccattttctcatttaatccttctgatgaccctgagaggtagggactgttatcattcccactgtacagatgggtaactgaggctcagagaggcaaagtcatttgcccaggggacaccgctattaagtgacaaagccaggattcagaacccaggagggaacagaattgggcctcaaacccaagtgcgtctgactccaagcccacatttttttgttttgttttgttttttgagacagagtctcactctgtcgcccatgctggcgtgcagtggcacgcacaatcttggctcactgcagcctccacctcctggattcaagcgattctcatgcctcagcctcccaagtagctggacttaacgggcacctgccaccataccaggctaatttttgtatttttagtagagacggggtttcaccgtgttgaccaggctgatctcgaactcctgacctcgagtgatccacctgccttggcctcccaaagtgctgggattacaagcgtgagccactgtgccgggccaagcccatgttcttaacccctgcattatcctgcaaccatgagagtaagagaggaacatcgagaagctcattcccgccacaagagggcaaggaaggaccgtgttcctatttcttgggtgccttctgtatgctagacactgtgccaggtctctatcttacattctcagcacaggttgataacccagtcggtaaggattcaggttggcattcctaaagtaggtgtcaaggatacaacctgtttgagtccatatgggctgctataacaaaataacataaactgggtagcttataaacaaaataaatgtatttctcacattttggaggctgagaagtccaagatcaaggcaccagcagattcagtgtctggggagagccctcttcccagtacagatggcgccttcctactgtgtcctcacatagtggcatgggcgaggggtctctctcagaccttttttataggagcagcaatttcattcatcaaggctccaccctcccgacctaatcacctctcaaaggcccccatctcctaatcctaataccttgggttgaggatttctctttttcttttctctttttggagacagagtctccctctggagcacagtggcgtgatctcggctcacaacaacctccagttcctgggttcaagcgattttcatgcctcagcctcctgagtagctggggttacaggtgcgcacccaccacgcttggctaattttttgtattttttgtattttcagtagaaatgggttttcattatgttggccaggctggtctcgaactcctgacttcaagtgatccaccggctcggcctcccagagtgctgggattgcaggtgtaaggcaccatgcccagctggggtgaggatttcaccataagaatttggggaggacacaaacatttggattctagcactagcccaaagcgtggctttagaaaaaaggaggtccaacagcaaagaagcgtgagaaacactgcaatctacatacctccacgtgtccttgcagactgcaagccagagtagtatattcaaggctctgagaattcctgtagtgaagagacctgtgtaactgtttagcccagcattttccaaacttgtttggccacagtgcctttgtttcatggaaaaccagtcaacaacctgcggaacaggtctggggatacactggtctagatctgttcctgactggcagagccctggcagggttttgaaagggagatgaggcaggatttggggccattgtcattccattcaaagtagatatcaaaaaggacaaatgagccttcccaaagtgtgaaccagctattcttctgagacagaatgatgggccagagccccgcagcctgaatcccacagggttcccctcaattggagaaagtagaggaggtgtttaggaaggcagctgcatttcagcctgtgggagcagttttcctttgtgactctctggcttcaggctgaacagggcctgcttggcattgcactgagtcacagagatgtttctgcagtagaaatgccagtcagccatggttagaatattccctgcagcattttcatgtttctccaaagaaatctaaatgataccttaggccaggcgtggcagctcatgcctctgatcccagcactttgggaggctgaagcgggtggatcatttgaggacaggagttcgagaccagcctggccaacatggtgagaccccatctctactaaaaatgcaaaaattagctgggcatggtggcgtgcacctgttatcccagctacttgggaggctgaggtaggagaatcgtttgaacccaggatgcagaggttgcagtgagctgagatcgtgccactgcactccagcctgggtgacagagtgagatcccatctcaaaaaaaaaaaaggaaatgtaaatgatactgcatttggtccctagtgttaggtcagtgtctctcaaccttggcgctactgacatctttgactagcatttgtcgtgggggtctatccttcttcttcccattataggatgtttaccaacatccctggcctctacctactagatgatagtagcactcaccccaccagttgtgacatccaaaaatgtctccagacattgccaaatgcccctgatggccaccattgaaccactgtgtggggtcaagaacaggtgcctgggtggcatcatctctactccctctccccgggttgcttttcctgaacagggcttggggggcacctttggcatacaggaagggaggttagggaaagcacccagggcattgctgcgtctgcctcgagggcattgctgagagccttgttctctgctgtgcacagtggcatctccatctgcactcaccagacacatgcttcctggccttgtgcctctagagaaatgtggtttatttttatgttagagagcctgtgaaggctgaagcttttcttgatgacagtcatcatctgcatcgtcatcatagctaccatttgctgagcagctacttgtggctaggccgtgtgccacaagtgcttgatatccattttccccttcaatccttgtgacaaccttaagaggtagggaccttcatcgttcccactgcacaggtggataacagagactcagagagataaagtcatttgcttaagggacatagctaataagtgacaaaaccgggattcaaaacccaggtctctgaagtctgaatgaggtccatgaattggatcaatttgcatttcctagttgtgatgttgtactatagcgaggcacaatgttaccattgcgagaaaatggatggagggtctatggaacatctgcattatttgttgctactgcatgtctacaattatctccaatttcttttaattaaaaaaaaaaatttaaaaacaggtctgccctgctccagaagctgtcctctgaaccagttttctagattggtcatatttcccttttcatgcttgctgctaggaagctcagagcaaaatgtatgccctctctctaacaagtgtataggacttcctgactacacttctaggtctttctgttcctcttgcccttatatctctttgtcctatttgaaattgcattcattttgttaaattcttttctttttttggagatggagtcttgctctgtcacccaggctggagtgcagtggcgcagtctcagttcactgcaagctccgcctcccaggttcacgccattctcctgcctcagcctcccgagtagctgggactacaggcgcccgccaccatgcccggctaattttttgtatttttagtagagatggggtttcaccgtgttagccagaatggtctcgatctcctggcctcatgatctgcctgccttggcctcccaaagtgctaggattacaggcgtgagccaccatgcctggcctcatcttgttttactatgtctttaaaacttcttcaacacttactggaataaagtgggctttaaagaaatgaagcactgcagttcgcgtggcagaggctggtcagcatgttataaccagaccatcagccctcttactaggccagcacgctttcgcttttgcatttacaatcacataccccatcccctccacttgaaaaagaattttgtttttgtcgttatccaaaaatctcatcttaaatcaaccgtctcgtctccctgtagcttcattaccatctcagaagcagcaaaggagccagcaaaagctaaggtacagaaagtcgctttggaggatgatggtgagtggttatacttaatagaagctatcatttattaagcacctaatgtgtgtctggaggtgggcgaaacagttttggtatattcttttttttttttctttttttgagataggaactctctctgccacctaggctggagtgcagtggagcaattatagctcaatgcagcctcaacctcccggacccaagcagtcctcccacctcagcttcctgagtagctgggaccacagacacacaccaccacccctggctaattatttatgttttttagagacaggatctcgctatgttgcccaggctggtcttgaactcctggcctcaagccatctgcccaccttagccttccaaagttctgggactacaggcgtgcaccaccacacctggctaatttttgtatttttttttagagacagggttctgtcatgttgcccaggctggtcttaaactcctggcctcaagctatcctcccgcctcagactaccaaagtactggggttacaggcatgggccacctcaccattctttcatctgctcagcccctgtggtgaggcaggtattatgattgaaccccatgtacagacaaggagactgaggccctgagaaacgaagtcatttgcctgaggcggcctcgtctgtgtcaccctgagcaggagcactttactgctgccctccacagcctcgcccatctgcgtctgtcctgtaccaacacatttgccactttgaaggctgccttaggtcaggagctcaagtgctgacttccagaagcctctgagggcttgctgagctgatgtggctgctggctcctgctccagcgcgccctccactggctccatcaggcatcagcatgacccttggcagatgcagaatcactttgtagttagacgactgattcctgggtctttgcctctggaccaggagctcctgagggcagaggcggggcagcttcagcacctggcacctgggaggaggggctggcatctgggggtgctgactctgctcctttgttttttttgtttgtttgcttggttgggtttttttgttattgtttcttttttaaatttttttattttgtgtcttcttaaaattttttttttgtttctctttatcttttctttctttcgttttcctttttaaaatttttttcttttttgtttctttattttttatttttttatgtttctttttgttttgttttgtttttgtttgactctgccccattgaatcttaggtttccgccttttcttcacatctgtccctggaggccgtgagaaggaagagtctccccaaccccgccgaaagcgacagccctccagctccaggtgagaactcacacctctcctcacgtcccctccttttttctcctcttctgtcttggtgggttccctggaatagccaagcagactccagtcaggaccaggccaaggcagtggccctgtcaggcagctggagaaatcatgagctcagcgggagggaaagccctcttggcggcagctttggatgtttactgcttttgagcacctgtcttgggccagacacctcacttgatcatagttgcctcctgggacatccctgggaggcctggactctgttaagatccccgttttagagatgatacagtcagagaggttaagtcacttaaggaggtcacaaggctgctacgcccagaagccagtattggaagccaggttggcctcactcccaagcctgaactcactacctgcctctctctgcggccaccttctggtgacctggaccaagggaggacagcgagaggcagctctggggctgtgtcctgactccagctaacccagggtaccctctcgttgcagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaaaaaaaagaaaaagaaaaagaaaagaagtagaagctcatggccagggatggtggctcacacctgtaatcccagcactttgggaggccgaggcaggtggatcacttgagccgagttccagaccagcctaggcaacatggtgaaacctcgtctctataaaaaaaagaatacaaaaattagttgggcatggtagtgagcgcctgtgaggctgcttgtgaggctgaggtgggaggatccctttagtccaggagttcaaggctgcagtgagctgtataatgccactgcagtccagcctgggtgacagtgagaccctgtctccaaaacaaaatttttttaaaaagtagaagcttgaggttaagatgaaatctggctttgtcattagagtctcagcagagcaagaaaagcagagatgtggggtgtgagagcgtgggtgctggagcctgtctcctcttcgcaggcctctggcctgccccagcctcccgctacctgcccaaaccccatctgaatgatttgtggacaagcaagaagtttccaccgcatttctccttgactttactaaaagttaaataaacgtgccactcgccccggctggctacaagctgcagggggtgccgggtcaccccaggccttttcctgaatcccagggtagacgcggtacactgaaggccaggttctcagcagcaggcccagggatgtgggaccatgcttgtcctgggttcacaggctcctttgtccctcctggcagtgctcaggacctcagactcctcagggtggctgcgaactgccctcagccagccaggcccccaggcttctgagtgttagtcctgtccacacaggtagctcctgtgccctggggtcacctctttcttctcctgggcacctcagcttggccagttccccggccctgctcagctgctcgggccttgctgccttgtgagctcagctactcctgccccaaacaagggcagggtctgcagggcgctcgagacagaggagctgccccaccaggacctggacttggcacgggttgcgaggctcccacaggagtaaggacgacttcccagccccgaagtagccttcccagtagaggcaggaggccaggctggcctcagaggcatgatgctcttgggaacaaatacaggaaagctggaggtcatggggcctgggagagggaatcgctggggatgggaagccaggagagccctgcctgccttccctgttagcttcggcctccctgggctcaggcgttagagccccaggctctggcacagagtagccacccaggaaatgcctgtgtgagtaggtgatggggtcagtacaaatggcatgtgggtcactagctggaaggagttggggcaggaaggagtggcccggtgggtacattggtgacagaacaaggccacgctgatccagggcctctcagagctcagcaggtcacagctacacaggcctgtgtcctgagaagtgtggctgccagagtggtgtagcggtcccagggctctccataggcccaggctgggggtgcccaagtcataggccgcccccttcagttccaagtaagaagactgtatcccacgaagcagcgacagtccctcctacatctgccatgaacaggctttgctcctagctctccacgaccccctcctgtgcaccccgagcagcctccacgggttggggcgcctcagagccctccctttctgatgcatcagagcagagtggggagcgaggcacagctgtccaggaagggccacggttgctcggcaggctcaggtcctccaggcagggctggctgctgccctcatcaccccccaagcaggcagtacaggccccagggcccaggtgccgtggttactgggaggaagaggccatctgggtggagatgaaggtctcgatgacgctgtggttggatggcagcaggtggctctggccattgctggagtctgagctctggtacagcaccaggctgctggaggacactgcagaggcaaacaaggctgctagccacccaccaggcacccacacccaccccacctgcctgtccctaggggtactcaggatggggaggcagggccacacctcctggatcacagcagataacaggaaccccaaagtcacacctctaccctcggttcttcaaagggagcctcccagccagggtccacggccgcccatggagtggcctgagtacatcttagtgtgaacactggagaagccccggtgagatgccgaggtaggtagttgtacgtgttggcttggctaggctgagtcaaacactaatctaggcgctgctgtgaatgcaggtgctttgtagatgtggttaatgccacaatcagttggctttgagtgaaggagattaccctgaaaatatgggtgggcctcctacatcagtggaaggccgtaagagcaaaaaccggtttcccagagaaggaattctgcctcaaggctgcagaattcactccccagagctgccagcaacagatttcaggcctgccagccccccgcagacacgggccaagtccttcaaataaatctgttggttctgtgttcctggagaaccctgactgatggcaatggttaagagaatgggctttgaggtgggacctgggttcgagtcctggccctgccatctggtagctgtgggagatgaggcaagtccctcccctccttgagtgtccactttctcatctgtaaaatgggggtggtcatggacacgcctcatggggtgaatgccaggacacagaatggcctcagtggctgtcatgacagctgccagggccgggtccaggaaccttatagaaagggggcagcttgcaaaaaggcaggctgcaaagcccacccacctgactccaaagtgcccactcctgacaatggcatcatagattacaaactcaggtgaccgccccaccgccaggggtcattggagccgatgtgagtggatgcagtgaggcctggtgcactgttatatgggaatatgaatttttccaattttccaaaagatgccagaaatctggatttctatgtgaaaattcctgattttgaaatgttggcaacaaattcaaagaatgttcaaccctgagccaagccaaaccaaacacatgcaagagtcgcttctggctcacagacctggtccttatcgttactctccactgcctctaacaattacttcatcattttcctcagtccagtccctgagatgttcttgtaaggtgggccccatcttcctggggtcgcctgtgcctcttgggcttcatggaagcccaccccacccctccacgcctgccagtgcttcctcacagcagccctaggcctgctgcatgcacagccccacagtgacggacagcaacagaaggggtgggaccaacatggaagggggcagggacagtaagggagggggtggagccagggcctctcacctgtggggctggcgctgagccggtgggccggctgcaggtgctggatgctggcagggtcctggctggggacgtggagggtggtggcctgagatgccggcgtgtgaagcccggactcactggaggcctcagtgtctgaggtgaagacctgggggagcagagcagcctcctgagcccgggggatgtgggggtgaggggctctgtcacaggccaagggagggccagcaggcctggaccttacctgcttggtgggcgtgaggctggccagggcgctcaggttggtggtgtcggtgatgagcatagtctgcgggagcaggcccgtgtgggtgtactgggccacctcgggcttgtggctgtagagggctggccgcaggggagagaggggcagacgtggcagacgtgcctgacagccctagtcccaggcctcaagactggggaaaggggggcatggggcctgctgaacagccagactgggcagcagttggagatccagggctgattttcaaaactggaggctccagataaagggacagaccctctccccattacagggaactgctcagctgcgcttgatgcaggggagcctggaggaggccagaaaccaactccagctcctcttgtcacctggagacagcaggtatgaaagggaacgggaggtgcaggtgcagggctactgtactaagcacgggtgctacgtactaagcgcaggtgctactgtactaaatgcaggcgctatgtactaagcacaggtgctactatactaaacacaggtgctatgtactaagcacaggtgctactgtactaaactcaggtgctgtgtagtaagttcaggtggcccctgtcaaagagcaaggcagaggacagcagtacttccatctccaggccacctttccaaatataaccccatgttttgcctacagcacctccacccacccctcaggagacacatagaccctacaagagacacacagacactaggaaaacgcacataaaccacatattctcacagtgactcagataaaaatgtaacacacacacacgcatacactctcaaccatgtacacacagacatacacaggccccaaatctcttaacccagtcccaaattccaaaaaggtctgaaaccaaaagatttccttaagattggcactagagctcatttggtggcgaaacccagcctgaacctggtatgaggttatgagtgtttaaactgccttgtggaaatcctatctttggctgcagaaatagcagtgctttgatcacagggggctgtctcaaaccctgctgggagtgttatgtgatagctggcatatccaccaaattacttttctttttcttttttttttttttggcagagtactcactctgttgcccaggctggagtgcagtgcagtggcacaatctcagctcactgcaacctccgcctcccaggttcaagcgattctgcctcagcctcccaagtagctgggactacaggcacgtgcctccacgcctggctaatttttgtacttttagtagagacggggtttcaccgtgttggccaggctggtcttgaactcctgacctcaagtgatctgcccacctcggccttccaaagtgctgggattacaggcatgagccaccacgcctggccccagattacctttctaaaatctgaatagattttagaaattcatatggccctaagagtttcagagaaacacaggcatgcacacaaatgcatgcacaaccgatacacacccagacacgcactagggatctgctcacacaagcagtcgtgcacacacacagatacgtgcattcacatgggaacacactggcctgcagacaccctcaatcacggaaacacacttgtcccagagacacatgcagactgcaatgcctgccaggcacccctttcccctgcatccattgacagccaacctctatcatcatctcctgctgtgtggggcacagggcgctcaccgtgggggctctgcagctgagccatggtggccatgaaggggctctgggtcacatggctctgcacaggtggcatgagcggctgctggtaggaggggtgcagcggctgggagaactggacgggctgcagggtggtcaggctgctgcccatgctgttgatgaccggcacactctgtgcctgcgtggaggccaggcctggagtggaaggggagggaatcagctgggccccccagttatatcccacccctgcccaagacctcccaagggcaccacctctccttcccagagcccgtggtttggaggagggggcagggtggtcaggaaacagccctccactgggacctgccactaatttaagtggctctggcaagtcattccccctctctgagcctttagctctttgtctaggctagtgggagaggcaggcggtgacttgttcaaaagttgtcaaactgcggttccctggagccctggggttccacagcagtgcaaaggccatggggtcagttctctgctcccctctcctagcagctccttatctatcttatgtactgggcttctgcataattgtacctgcaaataagggctttctgggcttaatttttcttcataaaacaaaaacttagaaaacatcagtcccccttaccctgctgtaatttgcccatagacccttcaccttctgaggtaccacagaattgatgtattatgcttagtgcctgcctccctgcttgagttgctgagattttggtctgtttggttcacccaggtatcactgatgtagcacagtgactggtccagagtaggcactggataaatacatgttgtatgaatgaatgaatgagtcccagtggctcttccaactcctggattctgcgttgccccatgacctccaacccagtgcccacctatccccaccagcttaccgatgacaaagggtggaggcacctgtgttggtgaacgtaggacccagggaggcaggctcaccaggcccgatggtcatgaccccaaggaagtgaggccatgatgaggttctggggctgctggttgaggcctggggatgtctgctccaagctgtgcagtgctgtcagggtgctgacaggggggagggggcccccagctgctgagacctacgaggggaagccaagctgtgtccggggggccggggtccccacagggcctccctagggactgctccagaatctccctgccaaggaaagatgaggttgggttttccttacaagcaaggacactcaccagcttggcttctgtactcagcaggctgtggctgggctccaggcccgtgggggacacttggtggaggggtgtagacactgtcactaagggaccgccgctgcttgagggtacttctgcagtctcactggtcgcaggctgtccatagcgcacacctggagagggaagcagtgtcctgcctcagcaccccacttccctgccctcccctgcctccacagccctcagcacttcaaactccattggtttgcttaggccagctgcctgtctgcctttatgcagccagcaaatctgcctttgtttctaccttttgccaagccctgggtcagctgctcccagttccttgaaggctgggactgcatttattagctccattcctcccactgcctagtgctatacctgacatgcagtaggtgctcagtagaagacaactgaactgaatttaactgaatttagttgaattgaaatgaattgaattgatacaatctgaaatgaatgaattgaattgaattaacccaaatcaacttaggttgagttgagtggaatgatatgaagtggagtggatggtgtggagtagagtagatggaattgagtggaatgagtgggatcaagtggaatgggtacagtcgagtggagtggtaaagggtggagaggacgggtggggaggaatagagtggagtggaatggtatagggtggagtggatggaatggtgaggaatagtgtggcgtggagtggaatgaatggagtggctagagtggaatggatggagttgtgtgaacacagtggagtggaatggtatggagtggagtgagtgggttggagtggagtgaatggagtagactggaatggtggagtatgtgaatagagtggagtggaatggtatagagtggagtgagtggatgaagtagagtggaatggatgaaatgtggagtcatgtggagtgaatggagttgagtggatgggacagatagaataaaatggtatgtagtggagaggagtggagagaagagtgggtagagtggatggagtggagtctaatggagctggttggagtgcagtggatggaatgggtggagtggagtggatggagcagagttgaatgaagtagagggagtggagtagatggagttgagtgagtggagtggatggagtggagctgaatggagtggatggagtaagtggatggaatagagtatggagtggatggagtagagttgaatgtagtagatggagtggagtggatggagccaggtatggagtggatggagtggagttgaatgtagtggatgggatgaagttggatggaatggatggagtggaatgaatggagtggagttgaatgtagtagatgggatgaagttggatggaatggatggaggggagtggatggagtagagttgaatgtagtagatggagtacagtggatggagtggagttgaatgtactggatgggatgaagttggagggaatggatggagtggagtggatggagtggagttgaatgtagtagatgggatgaagttggatgcaatggatggagtggagtggatggagtagagttgaatgtagtagatgggatgaagttggatggaatggatggagtggagtggatggatggggtagagttgaaggtagtagatggagtagagtggatggagtggagttgaatgtagtggatgggatgaagttggacggagtggagtggatggagtggagttgagtggagtgaatggagtagagtggatggagtggagtcgaaggtagtggatggagtggatggaatggggttaattgtggtggatggagtgaatagagtggaaaggagtagagtgaatggaatgagatagagtggaatggatgaatgaacagagtgaagtagagtgataaggagtggcatgaatggaatggaaccaaactgaagtgcaaagaggtttaggtgactgctgtcactgggacagtcctccccaaccctcccaccttcccacgtgtcccttgtccccacataccacttaccgtggaccttactgggggagagggcaggtggaggcaggccaggggagctgtgagcgggcagcgcaggtcccgggcctggccctggggggggcccgctgtacgtgtccatggccagcttgtgccggaaggcttcttctttgcgccggttggcaaaccagttgtagacacgcacctccgtgacgaggttggagcccagcccctgtgcctgtgatggggacacccctctctggatgcattccgccctgcagaaatagccacccatgagcctccaggccaggctcagaggaaccctgtcctgggcatgaaggggagggttctgagaagctgagctctgccggagggtttgaggctggcagatctgggttccaatgccaggtctgctgtgtgaccttgggcaattgacagtctgtctgacctcagtctctccattcataaagtgagcaaaagagccataggattgtagagagaatcgaattgggtgagcatccatggaaggggttgcttggtgtccagggtgcaggggggctgcgaggaatgggcttaggttcaagtattctcaattttctgggccaggctaagccaatatcaggagttctcggcaactggacagccttttacaggacctagagtcaccttccccttccctggccttgccgcagcccagaccaaaccagcactgtttcccgcccgccgttgtacctattgcactcctccactagcgtctctcgctcctccttgctagggttcttctgcctctcataggcctggaacaggatctgctgggatgctgggccccacttgaaacggttcctccgccccttcttggttggtagctcatcacctgtgggctcttcaatcagccctccctgccctgcatgggtgaactctgcaggcacagaaagccgtgagtggggtactggccactctcaccttcccacgtccattcccctgaccttgcccttgattctttctcattgccatggcgctgaaccagaggagcttacagctagaacttagaaatcatctaatctactgatgacaaacacacagcacacatgccatcactttcttaacctgtgttcaaggcaaacatcactaatcaatccctgaatgctttcctaccaacccaagatatgatctcaccatccttctcagtacaagactgcaggtaagcattagcatttgttctgatttggcacatttactatccccattgtacagatgaggaagctgaggctcagagagcttacatatttttccagagtcacgcagtagagcaaaaatttgagccatatgtcctcagtgtattcagaattatattcagctttccagacttgaaaatcaggcttaaaatgcaaatgttagctagaggaagagacccagccagccttcatcagctggtaccactttactggaaactggtctaccagcttatccctgagcaggccaccaaaggactgggacacacaagtgctaggacagcactttatgagaagagaggaaggtagattctgaatcaggggcgcagcagcagcagcagggccctcaccatctcagtgccaagaaacagcagcgggcataagtggctaggactacacacctgctgcaccacacctggctcatttattcgtattttttggagagatggggtctccttctgttgcccaggctggtcttgaactcttaggctcaagtgatcctcccacttttgcctcccaaatgtgctgggattacaggtgggtacaaccacaccaggctgggagctggtaatattctattttttatctgtattggtgtgttcactttgtgaaaattcattgaactgtatgctttggatttgggcactttttatgttagacttcatttaaaagtttctgttatagcagacacagtgatgtgtgcctgccattccagctacttaagaggctgaggcagggatcacttgagcccggaagttcaaaactagcctgggcaacatggcaagacctcatctcaaaaaataaaataaataaaagtttacattatcaagtataaaaagagtcattcaactgaaagtagctgaaaagaagagctcttttccttccaaggttgctaagctggtaggatggcagcccagggcttccagaacccatctttgcctatatgaggagagcctgtctgagaatgaagccaacaaaaaagaaaagagtcaagaaatgctgtgtgaacctcatttgagccccttgatctagccatgcctgaagcagccctggactcctcacattgcttcagtcaattcattcccttttctgtttaaatccatttgagttggggttctgtcccctgttactgaaagagtcctaatactacagtcatatattgactctgcatctcaaattctccaatttctccttaaaagttaaaaatcccccagggaaagctatttgggccacagtttgcatctctattctcagctctaggctgaagtccttgatgacatttctaactgttagaaattttttaatgcattttatcgaatattgtaaaatttcgtctagtgatggttttaggagaacactatttctctcagaaactaaatctagttctaacagattttcagaataaatctttgtttcttctcatacaaattaaaatagtattaaaatgtactgtttttccaagtgtgtattacagcacagtagagtgtgaacaccccaataattgggatgaggggtagctatagagtaaggactagagttgtctattgcatgcatgcatgcatgcatacatacatacatacatacatacatacatacatacatacatttatttgacagagtctccctctgtcacccaggctggagtgcagtggcgtgatcttggctcactgcaacctctgcctcctgggttcaagcgattcccttgccttggcctcccaagtagctgggattacaggcatgcgccactatgtccagctaatttttgtatttttagttaagatggggtttcaccatgttgaccaggctggtctcagactcctgccctcaagtgagccacctgccttggcctcccaaagtgctgggattacaggcatgagccactgcgcccggcctgcatacattttttttttcaacagtgatttttactgctggtggaagtgtacattgatataacttctttggaaggaactatgccaatatgtacccaagattttaaagcagctactctgtgttccagcagtccacttctaggaatttatcctacagacacagtcacatgtgaacatgcacttatataaagaaggatgttttttgctgcagttggttgtattcgcagattgcaaaatccctaaaagtccttcagtaggtggccagttaaacaaataacagccagcagcccttataaagaatgagatccatcaatctctcagtgccaatatgaaaagatatacaggatttattgccaagagacaaaacacaacatgtaaaatagtgtgtctagtatgttcccattaatcagaaaaagagcaagaaaataacatatctattgctactatatgcagaaaatctctctggaaggatacacaagagtctgggaattccagtggctgctttagggtaaaggcatctaatttttcttataaactctgtttttcttctttttttttaaccaaatgtgtattgcctttctttctttctctcgttctttttctttcttttcttttccttccttccttccttcctccctttcctacctttcctccctttcctacctttcctccctttcctatctttcctccctttcctatctttcctccctttcctatcatctttcctttctttcttttttagaggaggaaccttgccatgttgtccaggttggagccgaacccctgggggctcaaacagtcctcccacctcagcctcctcagtagctgagattatggcacaccaccatgcctggctatttccttttttaaaaacctggataattaaggccaggcgcggtggctcacgcctataatcccagcgctttgggaggccaaggcgggcggatcacgaggtcaggagatcgagaccatggtgaaaccccgactctactaaaaatacaaaaaattagctgggcgtggtggcgggcacctgtagtcccagctactcgggaggctgaggcaggagaatggcatgaacccggaaggcggagcttgcagtgagccgagatcacgccactgcactccagcctgggcaacagagtgagactctgtctcaaaaaaataaaaaaataataaaaaaaaattaacctggataattaataaaagaaatgtcaaaaaatgtcacacatagatggaggttggaaggtgacagtgcccttgggatttggtggggtatgaggcctggagaagaaaacccaccattccctgagtaatagggctcccagagcttcctgagtttgcagtggaggatttcctgaccgtagaccttgcctctgagcctttactgatgctgttccttctgcctgaaacacccttccctgcgtctccatgggtcaaaattcaactcccactttaagacctagtctaaaggtcatattctaaaggtcatatttgcaatgtgaggcttcctgatacctctgccttcctgaggaagaacaggttactccccagtcgacagtcagctcagcaccctgaaatgctttgtgtaatactctgcactggaccaggcaccccaaaaatgcatgataaatagtggccattattgttgttgttgtggctgctgttgtcccattctaatacatgactcgctggatcataatgagcttttctcccactttcccacttaaccatgggctctgagaaagcagggacccaggccgggtatggtggctcacgcctgtaatcccagcactttgggaggctgaggtgggtggatcacctgaggtcaggagttcgagaccagcctggccaacatggtgaaacccccgtctctactaaaactacaaaaaattagccaggcatggtggtgggcacctgtgatcccagctattccggaggctgaggcaggagaattgcttgaacctgggaggaggaggtcacagtgagctgaggtcgcaccactgaactccagcctgggcaataagagcaaaactctatctaaaaaaagaaaaagaaagcagggacccatttcattcatctttggatgttcaggaccaagtctactcccgtcccacagagtgcctggcgcagaataggtaataaatgcaggttgaatcccactgacttcctttccatctacctgtctgtgtaatggggatggtgaagcttccagcccccacctatgagttaggggagagtcctgggccctcccagggaagatgcggggtagggtcattacttacgctgcgccacctctcgctgcttgcggacgtaccaggtgtacagggcggcccgcttctgcgtcttcatgggagtgcccttgttgaggtgttgggacaggtgggactggttgaggccagtggtatcgaccacctcccgctgtgggatgttgtgctgctgcaggtaggacttgaccatcttcgccacacgccacgggtcctccctgggagagggcaaggacgggatctgctcagcaagggctgtctctccccataggtggggctgcggtcctgggtgctggaaccttgtcaaccctgagggtggggactgtgcatgaaagcagttatggagcccaggggcctacacatagactcagggacggtgaggtatggtcatttatgccaggacacagggacacagacacatggtcatgaggacagagacttgtagacgcacacacatgacaaacgtggacacaggcctatggatacagacactggaacagataaaggtttagaaacatggatacacagacacacaacacagatgaagatatgtggatggatggatgggtgaatggatgaatggatgaatgggtggatggacggatggatggatgggtgggtggatggatggatgggcgaatgggtggatggatggatgaattggtggatagatggatggactggtggatggatggtagggtagagtggatggacagatagatgggtggatggatgatggatggatggatggttggatgaatggatggatggattggtgggtgggtgggtggatggatgatggatggatggatggttggatgaatggatggatggattggtgggtgggtgggtagatggatgatggatggatggatggttggatgaatggatggatggattggtgggtgggtgggtggatggatgatggatggatggatggttggatgaatggatggatggattggtgggtgggtgggtggatggatgatggatggatggatggttggatgaatggatggatggattggtgggtgggtgggtagatggatgatggatggatggacgaaggagacctgctggaaaaaggaaagcattaaatctgaaaacaaggaaagaaatatggattctccaattttacacctactccagcctgggtgacagaacaagaccctgtctcaaaaaaaagaaaagaaaagaaaaaaagtgcatttactgccagtgattagggtgcaaacacgtagatagatagatagatagatagatagatagatagatagatagatagatcaactttgtgactttttgccctaaaggctgtcttagaactgaatcctttcaggtgggtgggactctgcttgtcctgtgaccttggacaaggaataaaatgatgcaaattctgtgggcctcagtggcttctctctctctgtatatatatatatgtgtatatatatatatatatatttttaaaaatgcttcctgaaaatctgcacccttggctgtggccaggcctgtttccctgcagcaccagaacaggaggctggtttttcttttctttttcttttttttttttttttttgagatggagtctcactctgtcacccaggctcgagtgcagtggcgcgatctcggctcactgcaagttccacctcctgggttcatgccgttctcctgcctcagcctcccaagtagctgggcctacaggcacccgccaccacgcccggctaatttttttgtatttttagtagagacggggtttcaccgtgttagccaggatggtctcgatctcctgatcttgtgatctgcctgcctcggcctcccaaagtgctgggattactggcgtgagccaccgcgcccggccgcggctggtttttcaacagagtctcaggtgacagggttgacattcagaggcctcatagtaccaaaaatgcatgtgaacactggaatcctactctgtgggttgagattctcccaccagagagactcaaagggacctgatgccacctgtgagtcatgtctctgctgtgggtctccctgtgggggaacagaagggatcagactgcctgagccatataaattttctctcctcctctcctgctctgtctcaatccctgcctctttctctctccctctcctgaacttatattaccaatatgtcacagataggctgggtgcagtgactcacacctgtaatcccagcactttgggaggccaaggtgggcgggtcttttgaggttaggagttcaagaccagcctggccaacatggagaaaaccatctctacgaaaaaaataataaaaataaaaaataagtcagatattgtggcaggtgcctgtaatcccggctactcgggaggctgaggcaggaggattgcttgaacccgggaggcagaggttgcagtgagccgagatcgcgccactgcattccagcctgggcaacagagtgagactccgtctcaaaaaacaaacaaacaaacaaaaagttacagataaatacagctcaatacagcagcactgaaacaggcagactgggatttgaacttgggtctgcgtgattccaaagcctgtgctttcccctgcctcgctgagcaattcgcttctagaatttgtggcttttaatattggcacaggtgacaaatggcacaagtagaaggcaattccttgccacgttgcttgccatagcaaaagattggaagccaccaaggagcccagcaaaaggatactgattaactaaatggaggtgcatctgttcaatgcaaccactgaaaaaaccccgctgaggaagctctgtgtgcccaggtggagcagagtttatctggtgtgtctgctgtgctgctacttatgaataatttgaagtgaggtaaaagaggatttctacatatttgtgcacgtgtaaaataccggagggcacgcaaggaactggggactctggttccttccagaggagaacggggtgctggggatgggagtgagaaggacagttttctctgttgtccttgtgtactttgtaaattacataatatatactatatatgcatacatgatatttatttttatttagtttttttttttgagacaaagccttgctctgtggccaggctggagtgcagtggcgcgagctcagctcactgcaacctctgattcccaggttcaagcgattctcctgcctcagcctcccgagtagctgggattacaggtgtgcgctaccacacccagctaatttttatatttttagtagagacagggtttcaccatgttggccaggctggtctcaaactcccgacttcaggtgatccatctgccttggcctcccaaagtgctgggattacaggtgtgagccaccgtgcccagccaatatttatttttatttatttatttttctttttagaggctacttgctctgtctcccaggctggagcacagtggcgtgatcatagctcactgtagcctcaaactcctgggctcaattggttctcccacctcggactcccaagtacttgggaccacaggcacatgccaacatgcccagctaatttttgtactttttcttcttttttctattttttttttttcatagagacagggtcttgctatgttggccaggctggtctcaaactcctgggctcaagcgatcctcccaccttggcatatataatatttaaaactgaattgtaaactgggtatggtggctcatggtggtaatcccagctctttgaaaggccgaggtgggaggatcacttgagccctgcagttcaagaccagcctggacaacatagtgagactctgtctctataaaaaaaaaaataaattagccaggcatggtggtgcacacctgtagtcccagctcctcaggaggctaaggtgggaggattccttgggcccaggagtttgagaccagcctggacaacatagtgggaccctgtttctacaaaaaatagaaaaattagctaagtgtggtggcacaagcctgtagtcccagctacttagaaggctgagacaagaggatctcttgagcccgagaggtcggggctgcaatgagctgtgatcgcgccactgcactccagccttggcgacagagtgaaatcctgtctcaaaaaaaaaaaaaaaaaagtctgagaactcatgtttcttgaggatttactgtgagccaggcaccgtgctgaggactggccacttacatcttataaccctaggaagtagacggtgtgcccattttgcagaggagaaaactgaggctcagaaaggtgcagtcacttgtgcaaggtgatctagttgggactcaaaaatatttcatgttgccaggaccaccccacccccgcaggcctctccccagcttctctctctcccttctttccggggctcctaggatcctctctccttcatctccctgctttgctgagtgccagtcagagctcagaaggaagggcagtacaaagtccagcctggtgctctgtggcaaacatgtttatctgatcctagagccaggctgcctgatgcctcccctcccccatctgcagccatcaccctcctgtgccatgtcctcctgtgtcctcccttcctccctccttcccttctctctcccacaaagagaatagggtcagtcttcctctcacctcttgagagcctctcctgggctcaaaccaaagattttctatgtgcccctgtccatctgattccatgtctgtctgtttctttctctctctctctctctcattctcattctctcatgccaggtcaaatttaagctgaacttgaaaataaaacaaaggccagccaccctgcacaaatacatgtgcaacccttagaaaccgaagacaggcttttgaatgtgaaaatggaaagcaaactgttaaagtgagctgatacgaacgttccacttttaaacaattcctagtagagttgggcaaaaaatccacaacaaaaaagtgaattttaaatgccagttaggagtcagagaaccaagagggcatgtctttcccttttctgggagaagccacctgtgccacttttttctagaacctactgaatcgatgtctctctctccctaccccccactcccttgctatcactctctctcttctgtctctctgtgtgtctcttacacaaacacacacacacacacacacacacacacacacagagtcttcaagggcctgactatttttgagggcagattctccaactgtcctagctcagaactaagaggccaaggctgggcgtggtggctcatgcctgtaatccccacactttgggaggccgaggcgggtggatcacatgaggtcaggagttagagaccaccctggccaacacagtgaaaccctgtctctactaaaaatacaaaaattagctgggtgtggtgtcgtatgcctgtggtcccagctactcaggaggctgaggcaggaggatcacttgaacccgggaggcggaggttgcaatgagccaagactgcgccactgcactccacccccagcaacagagtgagactccatctcaaaaaaaaaaaaagaaagaaagaaaaaggaaagaactaagaggacaagtctccaggcatctcctgctttgactctaatgggtttgagagtcaaaccaatgtgggttcaaatcccaccactgtgacctagccacgcgtgctcttgcatgacccacatctgccctgtaacgtggggtaaatccacccctacctcacactgctactgggaaaattaaatgagcttcaaatagggaggatgaacttagggcaatgcctggtgcacagtaagtgctgaatttgtggaataatattgtcatcatcatcatcttaacaatgcagccctggagacccttggccccacacagcagagcccaggagaagtgaagacccgcccacatcttcctcctctctctcctaccctttccagggtcaatcggatgtccaaggctttgagcctcttgccctctggcccctggggtttcagggcatgcaaggttgtggtattcatctccacatctggaggggagctgacttctcagtgtgggggctttagacctggccttgattctttgcttaacctccgtgtgcctcagtttccgcatctgtgaaatggggctaatgatatttcagacttcagagatggggaggaggaaaaaatgagcttagcgcattttgtaagccctttgtgaactccaaagcactgtatggaagtgagttgatggtcaacttaaacagcaggaatgactggggaggggaaagtgtgacctcgaggttgctgtatggagcgtgaggtaggaggacccaggtccaagtcctggcttgccttcagtcatttggaagagtttcgttcggtaaggcactgcctctctcagccttaatttgctcatctgtaaaatgggatcactaataataactgctgtatattgcagttactacatgtttactctacaagtgccatgccatttaaccctgtggacaagggctattgtcatctctaccctgcagacgaaactgaggctcagaagtataaaatcacctgctcaagctagaaaggggcagagctaggattaggatgcaggcagtctggcttttgttggggacgtcagatcctctgtcccccccccctcctgccgtggctactgttttcctgagtctcagtgccctgatgctgcctgatgggcaggatcagaatacttcaagattggggtttgaaggctgagggcagtggctctgagtgcctgtaatcccagcactttgggaggccgaggcgggcggatcacctgaggtcaggagtttgagaccagcctggccaacatagtgaaaccccatctctactaaaatacaaaaaatcagccaggcgtggtggtgcatgcctgtaatcccagctactcgggaggctgaggcaggagaatggcgtgaacccaggaggcagagcttgcagtgagccgagatcgcgccatgcactccagccgggccgacagagtgagactccgtctcaaaaataacaacaacaacaacaaaaaagaaacacgctggggtttgagctgatcagggacagaaaggacccgggaggacacccaggaaggaactctgggtcccagtttctcccttggccacgtctcaggctgctgggccctgaccaacagggcagcagatatcttcagggcctcagacaatcccagtcactcactcattcctgctgtgcatcagccactgggcaggatgtgggtacaagtggtaaataaggcaacacgggccttgtccttgaagagcttctattttcatggcaggagatagaaaacaaacaaatcagatgatcacaagtcttgacagggaaccagagaaagtgaacaacagtagtggaagagagtgacgggggtggggcccccttttggatggagcaatcagggagctgaaggagaaggaatcggccatgggaagatctggaaagaggttctgagcagcaggaagagcacgtgcaaaggccctggggtgggaattggcttggggtactgaggaacagcaaagccaaaatgactgcagcaaaggccgagaggaagagaaagacctgggaagagatccaggaatttggtggggtggagggaggggaacgaaaccaaggcagggagtttggactttattccttggccagggagggaaactgaggcagaaggagaggaacagactttcccaaggtcactcagggagctaagggggagatctgaagaaagagctcaggttcctgctgtggccaccaacatggggcaccccagggaggcctgggacccaggacccaccccggcttcttcccagacactgacttctcccgggaaacagcttctactagacattctgcctctgtaccgtcttcccagcctcaacctccccaatggcccaggccttcaataggggtcccccgcccctctctccctggctcctttcctgaccctgacgctggaggccccacttttttcactcagggcgttttccgatcccttttgttacctgaacaataagtaacccaggtagttagttataaactctgcaggaacaaggagctggttgataatttatagcaacatctcaaatttaaatggaaagtaaatagcatgctgttagcattaaagaaaacccaatcggggcaggcgggaagcactccagcctccttgcaagcttggggcgcctcattctctcccgtgccccttctcccagctgggtctgagcccccgcccccctggctcctccgttctgcttctcccagcttctctgtccatctcccccaatggcctctctctacactctctgcctcagcttccaggtctctgctggtccctaggaagcactttgacctctgcttccccttcaaatgctgtggatcaagcctccccaaccccaccatcccaccaaagggggctgctgaccgagagagctcactcagccaggtaagaaagcatcccctgcccccaccctcaccccaaagcccccagtcccatctggggccctgggcaggtcaggcccagccccaccccgtcaggttgccttcgccctgggtctgggatgcctgactctttgcccctcccctgcagctctggagtcctttgccctcctcttcctgccaagtcagggggccctgactgctcccctgccccctgtccaggccctcgggaggctccctgaggcctctgggaaagcaggaatccaccagccctcccccaccccagctgggatcaggaccttggacagaaaagagatgggcccctttggagcatctttggggctcggtctctctctgactccctggccaccccctgcaggcctctggtccccggtcatagcaattgagagcaccgaacagagtaggtttggggcctcagtttggtgaacttagtctagctccttcccggctctaagccccagtttccccatttgtgaagcagagtcaccaatagcttctgcccaggactcctcaccatgaagggaaattattcctgtgaaacctcagcacagcgcccaggaagtagtgaacctcctcaagcaggcgctgtagggtggaggtcagggagccgctggggaggggtggcccctgtagcccccaggccatccttccttctcccccacacccccatcccccacccccactaggtgggaggtgggttggcccagatctttccaggccaccattcctacaagttaatgatcacagaccttatcagagccttttgccatttataaatttataaaacaaaagagaaataataaagcacatgggtaattagtaactaggtcagctctgctgaggagaggggaggcatcgagctcaggacccacccagttctccaggagacggggagtccgccagcggatggggatgtagaacgggcagcctctaatggcgcctgctggtgaggtggggtgcctgtggccatacaggaaaggggagcagctcccacctcgaggctctgtctgcctcaggtaagaaagacctgggcttccctggctaaacgcatgagtccctaggaggccaggaaagcccccaaaccccagcttcgggccctcctccctggcagtgcttcctgggccccggagcctacccactgaggactcagtgcaggagttagggtctggagagtataaatgatcagagtggctaaaaatttccaccacctcccagttctccaggcatttgagttgtgaactcacctgctttttctcccatcttggacccccctgggaaatgtcccccttgcccaaggactgggctaaaggcctgggctcatgggatttgggactctgcagaggagcagttcaggggctggaggctcaaacctccaagcaaggacccctgggctctcatgggccctgtcccccttcccagcaactaggctaaaggctgaaggtcatggggactcaactcagaaggggggctcgttaggagctgaggggggcccctctaggctctcctgggagcggggacggggcagggctccttactgcagaagggtctccaccacggctttctggtgggccgcctcctcagggctgaggttctccagctctttgaggatgggtggcgtgaagtcttccccatcgtcgtccgtctcgtcctcggagccccgagtctcccccagcccattgggcagctcagccagctcccctcgaccgccgccgcaggactcccccttgtccagggggccttctccagccaggaggtagggccccggctcacccagtgcctggatcagtgcctctttgctcagccctgactcgagcagggccgccaggagctccgtctgcagctggctcagtttagaaaccatggctcggctgccacagggccacgcggcccgggtccaccacgctagccgcctcccccaccgcgtgggttgcgtttgcctgccggccggcagacacaaaccaaactccttgcacccactgcccccccaaaaccccactagccaagccctgtgggcacccccaacccccaaccctggccccagcggcccgtgaatcagggcccctgcctgttctgtttacattggagctggggaaattctccaaggttcatatttatccgtgtgcttagcgaagggactgaactttggacttcagccctgcaaagtgcaggcctcatggcagcggagagggacagggagctatggcctgcgatgggagtgggcagaggggagggtgggggaggcgcaggtgaggggccctgagcagctgggatggaaggtgctgggagccagggaggccatcaggagagcagcgttgggtcccacccccgaaagaaccttgtaggggcatcatgctgagacaggagagccaaaaatgcttgctgcttacgagagcggcagcagcagggagctctagacagctgggctagctcttctcaagggcagaggatgctcacggccattttggggcccttccatccattttgggacccttccaccccactcccggcctgacaccaggcctccctgtaggaaaaaatatgttaagattaccatgtgccaagaacagtgctggctctgtgagggcgaattcacttcattgcattctgctaccaactgtgagcagttacagagattatccccattttatagaggaggaaatcgaggctctgagcggttaagtaacttgtccagggtcatacagccagcaaggcagaaaacatgcaaggtgagactgagttgggatgagtgtgacacttgcctcaggtgcaaatttatttttttattttttgagctatgttctcactttgtcacccaggctggagtgctgtggcgcgatcatggcttactgcagccttgacttcctgggttcaggtgatcctcccgcctcagccacccaagtacccaagtagctggcactacaggcacgcaccacgacacccagctgattttgtgtgtgtgtgttgtgtgtgtttgggttgtgtgtgtgtgtgtttttgagacagagtctcactctgtcacccaggcttggagtgcagtggagcaatcttggctcactgcaacctccgcctcccaggttcaagcgattcccctgcctcagcctccggagtagctgggattacaggcacataccactacacccggctaatttttttgtattctttattgagttggggtttcaccatgttggccaggctggtcttgaactcttgacctcaagtgattcgtccgcctcggcctcccaaagtgctgggattacaggtgtgagccactgtgcccggccttgtgtgtgtattttttgtggagacagggtcttgccatgctgcccaggttggtctcaaactcctggactcaagccatccgcccacctcagcctcccaaagtgttaggattacaggcgtgcgccaccatgcctggcagcccaggtgcaaattttaagggaatgccaaaaaacccagtcatcaaggtaaataacatttttatgcaatatgtttttaaaattaaaatgaatgcaaaaccccaaagaattaaaaacagatgtctatacaaaaacttgtgcgtgaatgctcatagcagcattattcacaagagccaaaaagtggaaaaaacataaatattcatcacctgatgaatatataaacaaaatatggcttgaccatgcaatggtatagacatatatatttttttctttctttttttttttttttgagatgggggtctcgctctgttgcccaggctggagtgcagtggtgcaatcttggctcactgcaacctccgcctcccgggttcaagcaattctcctgcctgagcctcccgagtatctggaactacaggtatgtaccaccacgcccagctaatttttgtatttttggtagagatggggttttaccatgttggccagactagtctcgaactcctgaccttaggtgatgccctcgccttggccccccaaagtgctgggattacaggcatgagccaccgcatccagccaatgcaatggtatattatttggtcatataaaggaatggagttccagtacatgccacaacatgcatgagccttgaaaacatgatgctaagtgaaaaagtggtcactaaagactacatagtgtgtgagtccatttatctgaaatgtccagaacaggcaaatccatagagacaggaagtggatttgtggttgtcagggcctgggtgggagaagggaatggggagtggccactccatggtgctgggtttctttaggatgataaaaatgttctacaattgattgtggtgatatcggacaactctgtgactttattaaaacccaatgaattgcacattttaaaagggcgagtttgatggtatgtaaatcaataaaaatattgttgtagctttattgagatatacttaccatacaattcacccatttcatgtgtgcaattctgattttttttttcatttttatttatttttattttttgagacagggtttggctctgttgcccaagctagagtgcaatggcatgatctgggctcactgcaacctccgcctcctgggctcaaatcatccttctacctcagcctcccgagtagctgggactacaggtgtgcaccactgcacccagctaattttttttttttttttttttgtatttttggtagagacggagtttcaccatgttgcccaggctggtctcaaactcctggactcaagagatcctcccatctcagccccacaaagtgctgggattacaggtgtgagccaccatgcccggcctcaaaaaatattttttaactaatgtaaaataatctgtgctgaacaaaatagcaaacatctaaatacaggccctgtggccaggcacagtggctcatgcctgtaatcccagtactttgggaggccgaggtgggtggatcacctgaggtcaggaatttgagaccagcctggctaacatgatgaaaccccatttctactaaaaatttaaaaagctgggcatggtgatgcacgcaggaggctgagacaggagaatcacttgaacccaggaggcggaggttgcagtgagccgagatcacgccattgcactccagtttgggcaacaagagcaaaactctgtctcaaaaaaaaaaaaaaaaaaaaaaacaggccctgccctcacccaccagccacatgtggctaccaagcacttgaaagatggctaatgtcacttcttgaaatgataatttttaaaaaatatattgagttaaatttttaaattaagaaaattttggccgggcgtggtggctaacgcctgtaatcccagcacttttgggaggccaaggtgggtagatcacctgaggtcaggagttcgagaccaccctgaccaatatggtgaaaccccatctgtaataaaaatacaaaaattaacctcaggaggctgaggcaggaaaatcacttgaacctgggaggcggaggtggcagtgaaccaagatcatgccactgcactctggcctgggtgatacagcaagacactgtctcaaaaaaaaaaaaaaaaaaaaaaaagacaatttaaaagttaacatttaggccgggcgcggtggctcacgcctgtaatctcagcactttgggaggccgaggtgggcggatcacaaggtcaggagattgagaccatcctgcctaacatggtgaaaccccgtctctactaaaaatacaagaaattagcctggcgtggtggcgggcgcctgtagtcccagctacttaggaggctgaggcaggagaatggcgtgaacccaggatgcggagcttgcagtgagccgagatcgcgccactgtactccagcctgggcgacagagcgagactccctctcaaaaaaaaaaaaaaaaaaaaaaagttaacatttagaataattttaaattagatttaattaaaatattatttatatattatacaaatataatgttatatttagtttaaaataatttggtttaaattaaaattttatttataaaaataactttttattttaaaaattaaagaaaataacttcacctgttccattttactttttatttttttaagagccagattcttactctgtcacccaggctggcatgatcatagctcacttcagcctagaactcctggcttcaagcaatcctcccacctcagcatcccaagtagctggaactacaggtacgcaccatcatgcccagcttcatttatatatttatcttttttgtttgttttttgagacagggtctccttctgtcgcccgagctggagtgcagtggcacaatcttggcaaactgcaacctatgcttctggggctcccgtgatcctcccacctcagcctctccaatagctgggactacaagcgtgtgccaccatgcctcgctaatttttgtattttttagtagagacaagagtttgccacattgcccaggctggtctcaaactcctgagcccaagccatctgcccacctcgtcctcccaaggtgctgggattacaggggtgagccactgcaccctgcctatttatttacttttcttagagatgggggtcttgctttgttgcccaggctggtctcgaactcctgggctcaagcaatcctctcacctcagcctcccaaagtgttgggattacaggcatgagccatctcacctggccagtaatgtatttcactccaagaacaactcatgaattaggaactgttataatcccccttctgcaggggaggaaagagaggctcagagaggttaaatgactgctcagagtccctcagagctgggctttaagtccacctgaggcaggcggacgggctgtgcaggacaagttggcagcccccgccttaaggagagtggtaccctctttcctccagtgcatttatgttttatttttatttttgagacagagcctcactttgtcacccaggctggagtacagtggtgcgatctcagctcactgtaacctctgcctcctgggttcgagcaatcctcctaccttagcctcctgagtagctgggactacaggcacacaccaccatgcctggctaatttttgtatttttggtagagacagggtttcaccatgtttgccaggctggtctcaaactcctggcctcaaaagatccacccacctcggcctcccaaactgttgggattataggcgtgagccaccgtgcccggccaagtgcatttttttgtaaacccccgtgcaagttgctttgaggttgagcagcttactgctggggacagcattctcaagtccaggctaaacagggaagatgctgtgtgctgtccctttgtggctttgaggttctcctgcttattctctttgctgcctgcagctgcctcttggtgactttccctttccagggagccagaggaaccaaggagtgttggccctgactcctgcccccagcatgtaaactcattaactgctgggtcctcaggcagttaggtggctgagcatttgagtctgggacggcaggtggatttggttggagagggaatgacagagattggggaggagcctccagagtctaaagagataggtacacaagcagaaagttccagcccccagcctgcctttcccccatgctcaggggacaaagctgaattaactcgaggtcaggaatggcatttgcatttgcattcttgagagtcactgcaaataagagctgtagtcatggtgagtggttaaggcaatggactagagaaccactgagaaaaaaagcgaacagtggctgggcgcagtggctcatgcctgtcatcccagcactttgggagaccgaagtgggtggatcacttgaggtcaggagttcgagaccagcctggccaacatggtgaaaacccgtctctactaaaaatacaaaaattagccaggcttgtcagtgggcacctataatcccagctagtcggaaggctgaggcaggagaatcacttgaacccagaaggcagaggttgcagtgagctgagatcatgacactgcactccagcctgggtgacagagagaaactccgtctcaaaaaaaaaagaaaaagaaaaaaaaaaaaaggaacagccggacatggtagctcatacctgtaatcccagcgctttgggagaccgaggcaggtggatcacctgaggtcaggagttccagatcagcctggccaacatggtaaaaccccatctctactaaaaatacaaaaattagctggatgtggtggcgcacacctgtagtcccagatactcaggaggctgaggcaggagaatagcttgaacccgggaggcggaggttgcagtgagcagagatcacgccactgcactccagcctgggcgatagagtaacaatccgtctcaaaaaaatctgaaaattaaaaattaaaaagtgaacagttgtttagtaagtgcagtaggtaggccaagataactattaagtatgtcctaacaaggtagctgcttgaaaaaaataatgcacataaattaaaaaaaaaaaaactattttcactcattcttaacttctcgtatggatgtactaacgggaggcctgtgcctgttgggctgtccacagctactcaaaccttgagattagattggacgctatctaatctcatttcctgttacacaataacttctgcatggcacttgcttttaatcatgacaactgccatacactcagctttacaaaatcatgtcattgtggaaaggaagttccctccatctaacattcaaatttaactatcctgagctggtagtttgcaaggtgtccaacagatgtcactgtgtttccttcgcaaattctctaaaatagtctgctgtgtcccggggcatagtagatattcaagaaatggtggctatgagttttatcacaattctctcctactgggtgagcagctgtttgcaagactaaaattcgggcgaggcacaggcttccccttggtcttagcagctagcacaagacgagtgtcccttcagccagtctcagagctctttggcaattcaactgacccttgtccttcagtccagacaatgccccagggcccacctgcattcaaactcggactgttctccttcccacccctattatcttttcaactttatggacagtacatgcaattttctcattcattttctcatttaacatctaacagcttcatgatatccccattttacagataaggaaaccaaggctttaagaggatagggaccctaatcggctaaggcagaattaggatttgaacccagatccccatgacgccagaatctaagccttgaccaaatatgtgttactattacttttgttgttgttgttgttctgggtaactccaaccctctgctcgttggccttgtcacctcagtgctgattttgcagatgaagagactaaggttccgaggtgctagagcacagtggttaggaacacacactctagagccagagtgcctgggtttgagcctcgttctgccgtttactagccgtatggccttgggcaacttgcttaacttctctttgcctcagttcctcttctcttgggttgttaggagaatgaatgaggtgatatccacagtgtccaacaccctgcaagcggccaggtgtggtggatcacacctgcaatcccagcactttgggaggccgaggcaggtggatcatttgaggtcaggagttcgagaccagtctggccaacatggcgaaacctcatttctactaaaaatacaaaaattagccgggcgtggtggcaaacaactgtaatccgagctactagggaggctgaggcagaagaatcgcttgaacccaggagacagaggttgcagtgagccaagattgcaccactgcactccagcctgggcgacagagtgagaccctgcctcaaaaactaaaaataaaaaatgaacagtgtccaacaccttgaaagcattccgcatgactgaacgatcactgttacgtgattaccaacatgacgaccccacttctcttggccaaactgagttctcttctcttgtaaaaacttctgcatatgaagtcacccattccatttgactctttagccctcatcctggcattcaagggcatggacgactcaaccccactctctagccagcctgacctctccattcccttctctggcgtagaggccactcccaccacctgcccttaccccctgcccacttttgtcagcctgtactgtgttgaagctcccaggagagacaactgcagtcatcactttccactgtgttcagtgatgtcagttcggcccagctggaggtactcacatcatggaaacagaccatcagatttggtgtgtgtgtgttttattttgctttttcagagagccagctgttaaacactagccaacaccccattgatgctgttccttctacctgaaacacctcgcattgccggtgagctctaaagacaaaaggacctgggtctgcatttcccaaaggcaagactctggtatcacctgcatattattttcccatatttgagcaccactgccttttgcattatttacttagcagttttgctcctgtcaactcacttttttaaaactaaacttattttaaaaagaaaagttttggccgggagcggtggctcatgcctgtaatcccagcactttgggaggccgaggtgggcagatcacctgaggtcgggagttcgagaccagcctgaccaacatggagaaactccgtctctactaaaaatacaaaattagctgggcgtggtggcgcatgcctgtaatcctagctactcgggaggctgtggcaggagaattgcttgaacccaggaggcgggggttgcagtgagtcgagatcgccccattgtactccagcctggggaacaagaacgaaactccgtctcaaaaaaaaaaaaaaaaaagaaaaagaaaagaaaagctttatataattttaatactcaaaaaaacagtatcccggccaggcacagtggctcacacctgtaatcccagcaatttgggaggccaggcaggaggatcacttgaggctaggggttcaagaccacttgaggctagggccaacatggtgagaccccgtctctactaaaaatacaaaaattagccaggcatagtggcacgtgcctgtaatcccaactactcgggtggctgaggaacaaaaatcacctgaatccaggaggcggaggttgctgcgagccgagatcgtgccactgcacttcagcctgggtgacggagtgagactctgtctcaaaaaaagaaaaagaaaaagagtatcccttgccataaatagcaagcagtcattcagacatggaaatgaggcattcacacttgttcttgtttcacactaaggccctaagcctaaggagggtttctctatgttgaaaggaaattaggcagtgttcagaggggtgttaaagatagactagcaactaattgaaactttctcctcaatgtaagcactttagaagggactgaaaagagaatgttctccctacatgtaccatatcacctacaattacctcgtgtaccactattttgcaaataaatgccagaggcaagagtacattttgatgctttagcctagcactcaaagccctcctcgatttgaatctttccagcctcatcttgcacagcccctccatacccagacctcacccactctatttgccatctccagaacatacccctaactttctcacctctgtgcctttgtgcaagctgctccctctacctggaaacctccatttgtcaagctgctgctgtcttcaagatctacctggtcagaatctcctgctgtcctcttctgccacccacagcaatgtgagccttcactggctggccttccctactcactggagcagagctacggcatcagaatgccctggagcaggggttagaaacacagatttctgagtctacactcgaagatttttttttctttctttctttttttttgttttccaatttttctaattttagagatggggtctcaccacgttgcccaggctggtctcaagctcctggactcaggtcatcctaccacctaggccttctaaagtgttaggatgagccctgaaccttgtaacatgaacatttattagttatatctggaaaaaaatataaagttatttttatttgggtgatactgccttcaaaaaaaaaaaacaaaaaaaaacaggaggccgagcacagtggctcatgcctgtaatcccagtgctttgggaggctgaggcaggcggatcacttgagaccaggagttcaagaccagcctggccaacatagtgaaaccccgcttctattaaaaatacaaaaatgggccaggcacggtggctcatacctgtaatcccagcactttgggaggccgaggcgagtgaatcacgaggtcaagagatcaagaccatcctggtaaacatggagaaaccctgtctctactaaaaatacaaaaattagctgggcacggtgtcacgtgcctgtagtcccagctactagagaagctgagtcagcggaatcgcttgaacccaggaggtagaggttgcagtgagctgagattgcaccactgcactccagcctgggcgacagagtgagactctgtctcaaaaaaaaaaaaaaaaaaaattagccaagtgtggtggcacatgcctgtaatcccaattaatcgggaggctgaggcagaagaattgcttgaacctgggaggtggaggtttcagtgagccaagatcgcaccactgccctccagcctgggcaatagagcaagactccatctcacaaaataaaaagccaaaaaaagctctcgacagttctgttccccgcctgaggtgtttgtctcaggatcccggcctggctgtgggccacagatggcaaaaaccaaggtccgtctattactgggcatccagggtttcataatctctacgacctccatgcctggaactccacacattgcgcatgccccagaaacgcttgcccaacggaccccaatccaccatttctgaatgcatttttcatgacttgctgaatgtgtcttgttaatccaattagattgtaaactccgggagtgcagggacaacgttgaccttcctattactcccctcacccccgcccagctctggtctgggcacacagtgaccctcaagggtagcacaaagacttgaggcaagaaaaacacctgtagaaggaaaaggctggatactgggagcgcctctgtctgctttgctgccatcctcttcttcaacaacaaaggacacgctaattctatgcagcaaaagtttccaaacacgttagcctaagaatttcgagtcatgcaaaaaataaattcccagagtcacagggttaaaaaaaatcagattccagggccccatccttgttgttcctgagtcagactccccagtcaaactgccagagaacctcttctttgaacaaacacttcaggcaactttcccaggataaagcaagtttcagaaactctcacacagcttcttaggtatctcagatatggctcttgccctccagatgtttacaaatgaaaacaagaaatctggttccaacaagcaaaagcccagagagacctcaaacacaaagatgcaaatcaaaattagtagagaaataaatgagccgggacgttgtacttcggtcgcgggggctggctgaggtcactacctgcacagccgactgttggaagttctgcggtataccagctgaatggccttgaacaagtcccatctccactcggagcctccgtttccgcatctgtagaatggggatatgtgggcctaactcacagcgttgtgagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctccaaagtggtgccaccataggcggcttggtttaagcaacagcttggtggtcacagaaaccaaatagtagtaaagtaccaaggtgagctggcaacctccatgggccaagaagcatgtcccagatgaggagcagggctcctggtgggactcaggaaggggccgaggtaagaatagggggtcagcaattgctgatggagtctccacagcccagctgcagggctgagacaagccaggactagagaggtacacttagaaatccctaatttctggcttttggaaagaccttgtaatagatcaccgatttttgtctgcctaccctccccacttccttttccatttggtctggtcacagaatcttccttcctaaggaaaatccactggatgtggttcacgtagggctcacacggctccctcgtcttctccctacttcctgctacgggagccagcacatgacccaggctggccaatgggatgacaccttggccctggccacagtgattggttcagggatggatctgtaactcacatctgatcaatcagagtctttcctgggactttcttagcagagctatcaggaaagacttgtttgctcctctgaggttgttaaaagaagagaatgtgaggatatcttgtacatacagagttgttcaagaaggaagccaaatagaagcaaatggagccaggatgtagggagacggatccgtcctgatgacacagtttgaactcttatcttcatccacgtccgaggacagcaccatctcttcaactggccagttacatgatccaataaattcccctttgaggctttgtggttaacgcaagttgggtttctgtcacttactgcccaaacgatcctggctgacacagacctgcttagcatcctatctacacagacctccaacacaaactcctcttgtagctgcatccctgcctttgaatccagatctgaattggttgtgagaatagaagaagctgaacagcctcttggttaatttccgccataaccagtccctgctttgtatcccattttcaataaccgaggccctgtctccttatcctggctcttagtccttgcagccccagtagggacagctggccagaacctgtcacttgctgctgtatcctgaacattgctcgagcctgtctggatttccacctgtggtccacaccagtcctacttgatgcaaaatacattccccaattcctatgccccatgggtctacccatttcacagatggctaagtcatggttacacgaacttaaggcttcacagagcaacttaaggcagcatttcccaaactgtgtactgtgagactccatttggccatttagtgagacgttaatagatagtccattaaccaagaggaaaaaagcaaagctggtgatagttttttcttccattttatattttaaaatacaaactgtagagaaacttttatatgaaggttatcttctaaagttggcacttaagatgaaaatcatggctcatcaaaattgccttttaaacacttaaattgtccacaaagcatagcaaacacctcccacttcccagtgggtctgctggaaccaattttgcctccagatctagaacaagttgctgtttttacagttttgctccaggtgaaggtgaaggagttgacttattttaggggtcatgtggctgaaaaatatgtacctagattaataagtagagcagcaagatgctcgctaaaaagcacgtgggaacagagattgacggagggaacaccagatgccagtatcccatctcacacctactccagcgaacccggttgctgaatcattgcattatttatattgttctctctctctccatgtccccatggaacatgtataactgaatttgagggagttaaatacatgtaagttatgatttcaccatgtgaaagaaaaatatttatcattacaaggtgttctcatagtaatctgtttttagaaattttattattatacaataatctgaagaaattgaaggctgggcatggtgacccacacctgtaatcccagcactttgggaggccaaggcgggtggattgcttgagctcaggagttcaagaccagcctggacaactatggtgaaaccctgtctctaccaaaaatacaaaaaattagctgggcgtggtggtgtacacctgtggtcccagctactcgggaggttgaggtgggaggattgcttgggcctgggaggtataggttgcagtgagctgagatcacaccactgcactacagcctaggtgacagagtgagactcaactcaaaaaaaaaaaaaaaaaagaaagaaagaaagaaaaggaattgtaggccagacaaagtggctcatgcctataatcccagcactttgggaggccaaagcaggaggatcacttgagtccaggagtttgagactagcctgagcaacatagggagacccccatctccacaaaaaaaaataaaaaattagtcagacatcatggcgtgtgcctatggtcccagctacttgggaggatgaggcgggaggatcacttgagcctgagaagttgaggctgtggcgagctgtgataatgacactgcactccagcctagggcaacacaatgagaccctgtctctaaaaaagaaataaaaagattgtatgctgggcccaagaatgtcaggaagtcccatcacctgctacatgaaattgtgacatacaatctacgtattaatgcagaagggggcatttactaattatgctctttaccattggtcctatgatagctggtttaagtgatatgtcttattttagatttcagcacatatatataaatatataaaatacatataaatatatataaatatataaaaaatataaatatataaaaatatataagagatggcaaaaccccatctctactaaaaatactatatatatatatatatatttttttttttttttttttttgagacagagtcttgctctgtggctcaggctggagtgcagtggtgcaatcttggctcactgcaacctccacctcctgggttcaagtgattctcctgtctcagcctcccgagtagctgggattacaggcacccaccaccatgcccggctaatttttgtatttttagcacagatggagtttccaccacgttggccaggctggtctcaaactcttgacctcaagtgacctgcccgccttggcctcccaaagtgctggaattacaggcatgggccaccatgccggacccagcatatatgtttatcattcaatatttgttgaacagtaaacatatgaatcgaataataataatcctaataatagcattattaataataagaactaacacttaatcagggattactatatgccatatatttctcaaacagctttgcatttattagttcatttaatattcctatcaacaattctccccattttacagatgatgaaaccaaggctcaaagaggtgaaggatttttgaatccacgtttccagatttcaaatcctgaacttggacgtggttactttgagggtcagagcagaggatatagataaaaatacatacatgtattttatatacatatatactattatataatcaaaaaaattattactattattattattttgagatggagtcttgctctgtcacccaggctggagtgcagtggcttgatcttggctcactgcaacctccgcctccgggttcaagcgattctcctgcctcagcctccctagtagctgggattacaggtgtgcaccaccactccccactaatttttgtatttttagtagagatggggtttcaccatattggccaggctggtctcaaactcctgacttcgtgatccacccgccttggcctcccaaagtgttgggattacaggtgtgagccaccactcccagacttaaaaagattatttttaaaaatagatactagttatggagctcttatcctatgtcagtcatcatgataagggctgttcatgccttttttttttggttaattgccacaaccctatgaacagatgcagaaactgaggctcagagaagttaatgacttggcccagaagacatagccagtactatgaaataagttaccctaactcttagtaaactacactgccactctatagatacaaattgccttcatcatcattatcaatcagcacagagaataagaggcactcaccatcagggaaattcaaatcacaaccacaatgaactaccacttcacacccactagcatggctataataaaaaagacagacaatcagccgggcgtggcggctcatgcctgtaatcccagcactttgggaggccaaggtgggcggatcacttgaggtcaggagtttgagaccagcctggcctacatggcgaaacctcatctctactaaaaatacaaaaattagtgaggagtggtgacgcacacctgtaatcccagctactcatgaggctgaggcaggagaatcgcttgaaccggggaggtggaggttgcagtgagccaagattgcgccactgcactccagcctgggcaacagagcaagacttcatctcaaagacaaaaacaaaatgacaacaacaaaacccaaaaagacagacgataacaagcgttggtgaggatgtggagaaattggatccctcatactctgctgataggaatgtaaaaaactgcagctgctgtgaaattcagctccacattccccccaaaggtgaaacatagttaacatatgacctagcaatttttactcttaggtacatattcgagagaaaggagaatatatatccacataaaaccttgtacacaaatgttcatgtggcattattcatgatagccaaaaaagagaaacaaccccaatgtccatcaatggatgaatggatagaaaaaagtggtctatccatgcaatggagtactactcagccgtaaaaaggaatgaagtatcagccgggtgcaatggctcacgcctgtaatcctgacactttgggaggccgaggcaggcagatcacttgagtccaggagtttgagaccagcctggacaaaatagtgagaccccgtctctttaaaaaaaaaaattgaatgaagtatcaacacatgctacaacatggatgagcattgaaaacacgctaagtgccacaaaggaccacatattatgtgattccatttatatgaaatgtccagaatcggcaaatccatagaggcagaaaggaaattgatgggtgggaaggaggaggaacagtgttggaaatgatggtgaaggagtgtgggattccttttgagtcgattaaaatattctaaaattgattgtggggatggttgcacaactctgggaataatctgaaaatcattaaatggtaccctttaaatgggtcaattgtatggtgtataaattatatctcagtaagtttcttttagaagaaacaaaaaccaaaaagcagggccttcctgacgttggtgaggacctaaagttataacacattttcaagcctggtcctattcctcccaagcatggtgactcagatgccagcatgatcaccaggcgtgccctgagatcctcgcctcctccctggggatccagggtgttgccctgcgctttcctaccttccccaggcacgccctgccctgcgcgccctggcgggcctgaagtagagcagaaaggaatcccgcttgtcctgtggcttctctctgctgcagcctggcaccgtttcctcttgcctgctgctgcttcctccctcccgcccagctggctgtgagagcacgtctcagattcgaaaaccatgtgagattcagaatgtgcacctgaagctgcccgctggggctttctgtgctgtcggccactgcagagatctgggtcctccccagatcccacttaccaaacgtaggaaaagatgatcacgtggaagaaccacttaatggtgccataattcatgctctggatccgagtgactttgttcgtctcatactggaaaacatcactgcagctgcagcaggccggcatggtgacagcctccctccctgcgcggagctggaccagagctctactcttcctgacagggccacagcaagccccctcccagtaactgcaaaatgaaacgtactggtttttagcaggagtctttaacttcaagctcctccaatgactgcagagttggggcgggccctggcagtggccccacatgtggctgtgataaacaagaagcgccaagtcctacgggcctggctggcagatgacctcaccccagctggcctcccccagatgcctacacaaagatggtgttcagaggatgggcatttttagaattctcccttttcccccctttcctttcacttttttggtctcatgtctcttgggagaaaggggcagccttgcaaatgtcacaagactgggagcttccattatgcctcagaaaaggactgagatctttccattgcctgaagccccactcagagattgattcattcatttctacaaccctttattcagcccctgatgtataggagctctgggtaaatgaagatctccccctcttcttccaccgccccttataatactctggtctgcagttggtgggggaaatcagatttgcaggggtaggggtggtgggggtggaggggctttatttttctgccagatctttcatgcttgaccctctgagttactctccaccctcctctgcaccccggcaggtcgatctatgacctagaccaatcagccaaagatcaccagggacacagtggcagtccaacaaagttaggtttgttgacctattcagtgagggacaccacccaccagaagagctacgcacatcaccaaacaaaggaaaacagcaatttattataggattccgaggaaagtggagttgagataaaatctaaatgaagtcatgttttgatggactcaaagcaaaacaggtttgtacaaagcagtcaacttcagtctggattgcaaagaggacccagggccctgtttcctaggaagcaacatagctaagatacatgtcaaatgtgtccagaaaatctttatctgaagctctgctcctgagttgtaaattgaggctgcttctctgtgtcaagatgacttaaatcttccaggcaaaattggaatatttcagtcttagtcatgtaatttcaaacagcaaagtttctgaaggtctctgattttaaaggacaatgtttcagcagtcactcaaagatgcagggttgtattatcactttacagctacagagaattattgttccctgttatctttacagctggcttgatccctttctgttattccagcctgctaagtggccgggtagattttcagtttttcagtctaaactaattgtactttctcacacatacaaactgcatcagggttcccctcaccttctggcttccagttcaggagactggagagcagtgaggatggacgtgactccctggccctgcccttctcagttgcatataggcagggcttctgggcaccactccctcctttagtcctgggagtggtaagggctccccactcttaccagccccaggaagctcactatctcctattgctttttcttaactctgtccacacctttgtaaatggttccatcattagttaccccacttgagtatgccattgctttcctgccgggaatctgagtgatacggtcatcttcatctgtaaaaagaggagattcacaggtaaagcctgatgcttagaacataggctctaggggactaatggcctggcttccgatcctggcttcacatcttaccagctctgtgaccctggacagctctgtttatgctattcattcactcattcccaagagcaccaggaatagtagatatggcagtgaacaggcagacaagtcaaatgtccatcagctgatggatggatacacaaaagcacgaaagcccatacaagggaatattattcagccataaaaaggaatgaaacactgacccatgctccaacatggatgaaccttgaaaacactacgcttaagtgaaagaggccagacacaaaaggatacatcttttacgactccatttataggaaatgtccagaataggcaaatcacttcagtgttgctcttgctaccactcaaagacatctattttcttgtctttctttctttctcttttctttctttctttttttttttttttttttttttttgtttttttgagatggagtctccccctgttgcccaggctgtagtgcagtggcaagactttgggtcactgcaacccctgcctcctgggttcaagcgattcttgtgcctcagcctcatgagtatctgcaattacagccatgcgcacgctcagctgatttttgtgtttttagtagagatggggtttcaccatgttggctaggttggtctcgaactcctggtcacaagcgatctgcccgccttagcctaccaaagtgttgggattacaggcgtgagccactacacccggcctgtttgttgtctttctgctgcactcttgcactggtccctcatgctctcccctctccactccttcagcccttgtccgctatttcatcactgctacctcctccactccatggattctgttctcaaagaggttaccaaagacttctcagttgccagactgggtggatatattttattccttatgttacttgatctcttggatgcattcaacatcactggctactttctgcatcttggaccagtattttcccttggtttccatgactttcctgggtcccatgttctcctggtttctcatttgtacttctatgactctttatcttatctttctttttaaaaaattaatttaattaatttattttagagactgggtcttgctctgtcgtccaggctggagtgcagtggcgcaatcatggctcactgcagcttcaaacttctgggctccagtgatccccctaccacagcctcctgagtagctgggaccacaggcacatgccaccaagcctcgttaattttttttttaattttgtagagatagggtcttgctatgctgcccaggctggtctcgaactcctggcttcaagtgatcctcctgactcagccttccaaagtgctggggttacaggcataagccactgcatccaatctttgtcttatctttctctggctctcttctccctgtaaatatcagttccagcaaattgtctctcagcacttcttatgattctatcaggataggacaggttatgctgcaataacaaagcactctcagtgtctcatggcttatagcagtgatgaattaattctcactcacactatatgtccatcatgggtctcccagatggctcagctctctgtaatcactcagagatcgaggctaacggaacagccattgtcttgaactctttaatgagaactctggagagtctcacagcagcaatgaaatgttctgacctcgtgatggaaggaatataaagttaccaaaaaaaaaaaaattggggattgaacggtggatttcttagtcttgtgagtgtgtgggtgtgtttacaatttacagaaaatcaagtgacattcttcagcagaaaagggagtttttttttttgaggaaacacttatctcacagactgcaagtgcaggaaatgtgcccaacctcatgagaacctattaatagaatcagaaaccaaactgtcctgtgctgaggttgctctttcagtttgtctgaagcccgcctctgtttgtctctgtgtgcccattgcgagtctctctaaacactggcttcctctgtttctcccagggcacgtggttcagcaatgctctccaagttaggttccacagttcaaatgcaagcccagatcccctgcccagttccagaactcaaggggaatgaatctgattggcctaattctttatccctggtccaatcagctatggctgtgggcggggccataatcacacagggcgtcaagggccaacctccgttgggggagaagggagggaggaaagaaaggaagatggcgggagagagagagagagagaaggggggtgggaagagagagagagagagggagagagagaatgagaatgtgactctcagagaatagaggctccaaggctgagggactgctggttaaatacccgttcctcccccaggtgggacaactctgagacaagtctaggcagtctccagagggcctgagggggtctgagcccagatgcccacagccgtgacctgctctttaattaattaattagttttatttatttccagtgtcttgctctgtcgcccaggctggagtgcagtggcacgatctcggctcactgcaacctccgcctcccgggttcaagcgattctcctgcctcagcctcgctagtagctaagactacaggcgcgtgccaccactcccggctaatttttgtatttttagtagagttggagtttcactatgttgccctagctggtctagaactgccgacctcaggtgatccgcccgcctcagcctcccaaagggctgggattagaggtgtgagccactgcgtccggcctcctgacctactctttaatgcttcctgtgttgactgccttccctttcctgtctcacttccccactcctcttcctgggtcgcctcccaaacaaactacttggacctgaatctcgtccagccttatgttctggtgttaaagagtctgtctggaatttaccctgagaacaataggtgggtttataaacgggtgtgcatggtctcatttgcagctcagtcagagcactctagctgcaccatggaaaatgggcggaaggggcaagagtggagccaggggtctgcccagggagagggtagagtgacatggagggggaccgaagacagatccctgaaggacaccaacaccaaggagactaagctgaggcagagtagggaggagaggaaagccgaaagacagtgagtccccagaggccatggggtgaacacttcacaaataaaccggtgaccacggagatattaagagcgatggtaaatctgtgtaattaaagcagctctagtaagggaactgacagacacattattggaacagggtggagtcacgtattaaacacaaagataggtgcagaccgggtgcggtggctcatacctgtagtctcagcactttgagaggccaaagcaggaggattgcttgagcccagaagtttgggaccagcctgggcaacatggcaaaaccctgtctctacaaaaaataaaaaaattagccagttgcgggagtgcacacctgtagttccagcttctcgaaaggctgaaatgggaggatcccttgaccctggaaggtcaaggctgcagtgagccaagattatgtcactgtactccagcctgggccacagagtgagactctgtatgcaataatgaaaaaaaaaaaaaaaagagtaggaacttagtgtgcaataaaagcatttaaatcaggggagaaagaaatttctccaaataggatctttaaacaattggctgctcgttcaggggaggtcagaggagacaggaaaatgtactcaaactttacagatttgcaaaggtgtgtaactatttaaaatgtgatagaactgccatgggtaaactgagtcctttccctactttgtgtcagttgcaaagaaagaacacaaattggagggttgcggggaggaaggcaagcaggatttattctttggccagagaaggagaaggaatgacctcttgctccagagacgcctcctcctccccaagatgtgggtagctggggaattttaaggagttagatatggggcggggaggtttgtatgtttgtgcagggaggaactttagatgtgcaggtgcaaatcataaacatgtctcttcacaggatgcatgtttagaaaatggcaattttctacaaagattagccaggtgtggcagcgcactcctgtaatcccagctactcgggaggctgagacaggagaatgacttgaacccaggaggtggaggttgcagtgagccaagattgcaccactgcactccagcctgggcgacagagcgagactctgtctcaaaaaaagaaaaacgaaaaaaagaaaaaagaaaatagcaattttcttctctgggtgggaattttagtattataatgatatattaatggtctaaagatagcaaggagtccctgattctgcgttgctctggtttccagcaggctttaccttcctctgataattggcaaaaggttctgaagctcccaggccatctggagtccttgtaaactagcatacctacaggtaaagagactgaaagaaactgtttaagaaacgaaatggagcttttgcagctatctactgcttaagaaaataatgagtgttcagctggtttgctctctcggctgtttctccaggactgccccaggagcagagtctccaaaagtgagcaaaatcagctacacaaaatgggacgtgcaagttacccatatgtttgtgttgcacacattttgcatgaaaggtagaaagtgcaaacaaagaaaactggacactctttgaagttactcaactgatgacgacacctcactctcttctctacgtggctggtgttccatctttcctcccacagacgctgtgagcatgtcagtaccagtggggctttgcagccatgatacaaggcttttcttctctgtcatgtgtacagagccatgtaccaccatggaaccaatgttccagccatggttcactgtgtggtttccttcttcataactgccacgactaaaacaacacgtcaaagcaatatttttttcctctttatttctccggggcaatttctcagtgaatgtgccttttttatttctttttcctttttttttgagacggaatctcactctgtcgcccggactggactgtaatggtgtgatctctgctcactgcaacctccgcctcccgggttcaagcgattctccttcctcagcctcccgagtagctgggactacaggtgcgcgccaccacacccagctaatttttttgtatttttagtacggataaggtttcaccatgttggccaggctgatcttgaactcctgacttcatgatttgcccgcctcggcctcccaaagtgctgggattacagacgtgagccactgcaccctgccgaatgtactttttttttttttaaactctatcttacttccttctcatcacctaattcagaattcctataatcgttggtcgagagtctattgcctagtgatgtcagagggttcgcagaaaccccagtgccttggtatccacaaatgtttttcttttagttatgctgaactggtgctgcctaatagggcagccactcacacatacttcaatttaaattaattaaaatgacgtaaaatttaaaattcttgttttcagctgtacaagccatattttgatagccccctgtagctaatggctaccatattgaacagcaaagatatacggtacttacccagcagtatagaaagctcaaccggacagtgctacaacagttgcaggtaagcaagcaaggtaaggatagtcccaatcagatagatggcatctattttgtgtgaagccttgtgaggtggctcacacctgtagtcccagctacttgggaagctgaggtgggaggatcacttgaggtcaggagtttgagaccagcctgggcaacataatgaaacgaaaataaaaaaattttttttttctgtgtgaaataggaggcacagtagtcccagctacttgggaggctaaggagggaggatcacctgagcccaggaggtcaaggctgcagtgagccatgattgcaccactgcacctcagtctgggcaacagagcaagactctgaaaaaaaaaaaagaaagaaatagagaaagagagaaaggaaagaaagagagagagaaagaaataggaagcagagttgcttaagagtgagagggaaggcaggtgggtgggatggtgggatgagtatagagaagattcgaaggaaggaaggagggagggagggaggaaggaaagaaagagagagagaaaggagaaagaaagaaagaaaaagaaagaaaagaaagaaagaaagagaacgaaagaaagaaagagaaagagagaaggagggagggagggaggaaggaaggaaggaagcaaggaaggaaggggaggcagaggtgcctgagagtgagagggaaggcaggcaggtgggaggtgggatgagtgtagagaagattcaaaatagttgctatggtgaatgggaggagagagccaacagggaaaacaggaattccagagtagtggtaagaattagagaccatgaatttgttattgccaacagtctaggtgactgagattatggtagaggcctgggccttcccaccaataggaaccgcctcctacctccacactcagtaaccaccaggacttgccaactggttcacatagttttaagatgtgtcatcattggtatctactatgtttgttatggtgttgacatgtgttactgggacagtagctagtcaggtccaagatacaggagcaaaaggctgattcagttgctctgcccataggtcaccctcccctggggcttgcacccctgccaggcaggaagcttctctttgtcccctaactcaactcagccactgggaatgacttcgttcattcaacttaatctgagtataactaccctacctccttatgaatgctggatttcttttaacctcaagatctcccctctgttcccctctacccaagccaaatacccatgctatccttgggaactttaaaaaatatctatttcctagtcaagacagctggccacttcacataacaacgcaggtcttctgcaaccctaaacaaaggctggagatggatggggaaacgctctcctaatggtggatgggtagagagacgtctgaggtttctggaagactgaggacctattgttttctccaccagtctaagcagaacaggtataaaaacagaatggaaggaaatttacattgatccaggactgggcttttgctgcaagttgcaaattaagttatttagggtgcttttgtctgaaagtagcagaatgcctgactcaagctggcttaaatatgaaataaattattatttcatgtattgggatatcctgggggaagatacttcagatggggttgatttagtggtttgacaacatcatcaaagatctgggttcttcctgtctctatgcactgccacccttgttgctgggttcatcctcaggaggaaagatcatcagttcttttgtctctttcatgggaaaatctttcccagagtcctctttaccccacctcactctaccctctagaactagaagtgagtcacatgactgtttctctcctgataagagacagggaatgaccatgaccaacttggaccaaccgtctgggttggaatggatgttggggagtcattcacaacatccatgactgggtatagcaaagatcatggaatctaggctggatgggaaaggaattggaggaaggagggtcctgagagggagaaagtggaagggccaagggatcctggagttcgaagaactgctaagctggaatgatcaaaagaacagaaggtacaagtctgtgatcagagaaatgtgagactttagaggaagattcgttccaggagaaactgagggccagtacatggtccagggagatggtggctaaagtagagtggaggtgaaggtcattggaataagaagggacaggagctgaagggccaggagttcggccaggtcctgggtcattaaagtcaccaatatggcggtaggaactggggcgagaagggtaagccagttgccaaagccctctgagaataacagttgattgattgattgatgagtaggcatcatcaatgagaaggcacagaaggtggtacagctagatgtcaggagcctcagtgcttactcaagatggaggactatggatctggaaatagaggtgtggagcatagaggacaccatgggggtgggagacggactaccatcccctgggaagggcttcgaggactgtcagggaagagccaggtcttactcaggtcaggaagtagagggaactttgtatgcagaggtcaggaccttaaaaataaagagcacaccccactcttccctttcaccatctcacaggctggaatgagaatctgtaggtgagccaccatttacccagagtgtgggccatatccctacccggtaattggtaatagaagcgtgcttgaaacagtccttcccacgtgtccgttaatccttagagctcgtccgtatcaggggtgtagcagacactcctagttgcccattcaaaatccattttaggtagggcacagtggctaatgcctgtaatcccagcactttgggaggctgaggcaggaggatcccttgggcccaggagttcgagaccagcctgggcaacatagcgagaccccttttctctacaaaaaaatagaaaaaataaccaggtgtggtgggcatgcgcctatagtcccagctactctggaagctgggtggcaattgtgggggatcatttgagcccaggaggtcgaggtgagccgtgatcatgccactgcactccagccttgagtgctcagtgagaccctgtctcaataaataaataaataaataaataaataaataaataaataaagcattctattttccttattaacagaatccccaattttgttcgggtttgaaacccttgagaaagacagcttcatccccaattcaggagtatcacgttagtctcattctgcttgtggttgactcgtgtaggaatggatatgaaaatgagtatatggctatgaaacgtgagaggaaacttgttggggggcttctaaagaaagatgtaggggctgggcacagtggctcacacctgtaatctcagcactttgggaggctgagatgggaggattgcttcagatcaggagttcaagaccagcctgggcaacatagtgaagcccgtctacagaaatgttaaaaattagccaggcgtgggtggtgcacacgtacagtcccagctacttgggaggctgaggtgggagggtcacttgagctcaggagtcaaggttgcacatcgctgcactccagcctgggtgacagagtgagagcccatcaaggaaggaaggagggagggacagaggaaaccaaggaaagtaggaaagaagccaggaaggaaggagggaaggaaagaaggaaggagtcattcctaagaaagagacacaagaagagatggcctttctgaaatgacacgctctgggtggtagagcagaatgatggaaagaacttggtttgaaccgctgagttaactaacccaggagccaccctaccttgggacttctctctctctctctctctctctgaaatattgtttaagtcgttttaactgggctttcatttactcttagccaaagaattctgtgatgatcagaagactgaccacagcatccctgcagaacagagccagacaaacatccaggcaaacatccgcctgctggaggcagcctgcctgggtgctgggatcagtctcaaatctagcacacaatgggccacccacgctggcatctttcctatggtgtccttgccctggcatctcctggtcattgataggtcctggaataaggtactggaatgtggctcaggtgtctactaccttatagaaccaaagcctcaattcccttccattttctcattccccttgagagttctggcagcttctcctttagtccaactaacacagaagagatgctctcattcaaataatggatgggttgactgcctctaactagtccgcccttccttccttccttccttccttccttccttccttccttccttccttccttccttccatctctcgctctctttcttttttgagacaagatcttgctttgtcatccaggttagagtgcagtggcaccatcatagctcactgcagcctcgacctccagggctcaagcaatcctcccaccacagcctcccagtagctggaactacaggcatgcatcaccacactgggctaatttttgtattttttggagagatggggtttcgtcatgttgctgggctcaagaaatctgccgcttcgacctcccaaagtgctgggattataggtgtgagccactgcgcttggcccagaatttcatttcttttaaaggctgaataataagtctgttgtacagatattccacattttgtttgtctgttaatccgtagatgaacatttagtttctttccactttttggctactgtggataatgctggtataaacatggttctacaaattcctattcatgttcctgccttcaattctttggggggatatagccagtagtagaattgctgggtcatgtggtaattctgtatttaagtttttgaggaaacacgttttgttttttcttttttattcttttaacacaaagaacatttcttctgtatttttatgtaatctgccaggatagccacgcgtgcctgatagcatctccttttaaacccaaaagctgaatacatcacccttggaaggggaaatatcttccttgtatcagtgagtcaccgcctctctcgctaaagcagaaataaaaattattaatttaattccagctgggcacattggctcatgcctgtaatcccagcattttgggaggccaaggcagacagatcatctgaggtcaggggttcgagaccaccttggccaacatggtgaaatcccatctctactaaaaatataaaaattaactgggcatggtgttaggcatctgtagttccagctactcaggaggctgaggcaaggggatcacttgaaccttggaggtggaggttgcagtgagccgagatcacaccgctgcattccagcctaggcaatgagtgagactccgtcttaaaaaaataaaaataaaaataaaaataaaaatgtaattccaacagtgcattttgctacagaggatagagaggggaagcagaataaagttatgctgaatagttggacatttaggacatgagacaaaaaacagaagcagagagactgagagaaggaagagaggagctgagttatggggctgtggcgtgaagaccaccagccccaagactccctcgagtgatcctcaataaagagttcctccctagtcctggactccaggaggcctgactcatttacaacatgtcttcttgttttctacgagatctcgtcttccatatttctctctgagcatccgcataagaagccctaagtgtgtaactgttcaaacgaacgcagctaaaacacagtctcattcccttggttcccaccaaactgacagcaccttcatgtcaatgacattgactcacttgggcccattttgttgagccagtgacatggcactcatcagagtagtcgtctcaatccagctaaagagctccaagccaaatggagaagccagtggaatgggtaggaactgggattgtcactatgctgaggaatggagatggtgatatgggataaagcaggtacagcaagcaggacgtgagggccagagctgaggggtctgcaggtcaggaggctgagctcaggatcgctggaggccccaggaaggtgtagggagggcaccttggttctgcccacctgcaggaagagaagaggggatggcgatagagtccatgattgaagatctctgtacttctccctgcccatggcatagctcttaccaaaactccctcttttcactggcctttttatccagtcaaaccaaatttcccttgtctctctctctctctctctctttctcttgctttttttcatacccacccccatttctcttatgcctagaacagtcgcccacttagcatctgcctgcccagtactttgccttcctttacaactccacctaccacttaatttctctaagtggctaattaactgaaagttgaataattatacctctttccccaaaacacatctctgaaatcccacatgcccctggggttgcgatccatgaagaaaggtctctgactacctaattttcattaagggaattcaatgagatgactaattacaagcaccatgcctggtatctaatactgttcagtgaactgcagctattaattaataatgatatgttattaataataataaaataataatatgatataagctcttagaagacaaggacagtggctgctctatgccaagtttcaataatccaatattcaattttttttttttttgagacagaatctcgctctgtcgctcaggctggagtgcaatggcacgatttcggctcactgcaacctccatctcctgggttcaagcaattctctgcctcagcctcccgagtagctgggattacaggtgcctgccaccatgcccagctaatttttgtatttttagtagagacagggtttcaccatcttgttcaggctggtcttgaactcctgacctcgtgatccacccacctcagcctcccaaagtgctaggtttctaggcgtgaaccaccatgtctgacctcagatatttaattgtagcagagattgatagatttttctgccatgcccatcttccccctctagctcaatttgagatcacagaccttcatatccatagctgtggcttattggaccagggtgaacatctgcccaggagagcaagactattggctggtcagtggccaattgggactgctctattgagaatatgagccatgtgtagcggctcatgcctgtaatcccagcaatttgggaggccaaggcaggaggatcacttgaggccaagagttcaagaccagcctgggcaacatagcgagaccctgtctctacaaaaaaaaattttttttaattaggcatggtggtgtgtgcttgtagcctagctacttgggagcctgaggtgggaggattgctttagccaagagtttatttgtagagatgaggtttcactatgttgcccaggctggtctcaaactcctgggctcaagcaatcctcccacctcggcctcccagagtggtaagattacaagcgtgagtcaccagacccaaccccagctctgccatctctatggtgttaccttcatcagcatgatccaaaatggttcccaccagaactgaattctaaaaaggctggaagcactttaggaggctgaggcaggtggatcacctgaggtcaggagttcgagaccagcctggccaacatggtgaaacctcatctttactaaaaatacaaaaaattagctgggcgtggtggcacgtgcctataatcccagctatttgggaagctgaagcaggagaattgcttgaacccaggaggtggaggttgcaatgagcggagattgcactactacactccagcctgggtgacagagcaagactccatttttcaaaatcaataaatcaataaaaaattaaaagcctggaagaaagaggaaaggagaaagagaaggcatgttcctcccttgaaggatgggatctgtcactgccacttgcaggtcattggccagagcgtagtcacatggtcacacctacctgcagtagaaggtaggaaatgccatcctcattctgctgaccatgttccctaccgaaaatcagggagccagacattgaagacaaccaagaattcctgccaccagtacccatgaaacagtcctctgagctggggctgaatgagtcctacacatggaaggaaatctttgggtttccaggggatctgggcagctctgaggcatataacatagcccagccaggaaaaagctcccaaaagagaatttatttgtccaggaatgtacaggcaaaaaatcaccattctgtgtttttccatggggtagaggcctgaccaacctcatgtggtttgttccgtccagcttggcactgacagaggctggtggggcctgggggagggtctgaaaatccagggtctcaggtatgaactactgctctgatcaactgctaggctgtgtcctgtgggaatgtgctgggtttctacatgacccagaggtcactgatttcacaagatctgcaaacaatccaatattcaaatatttaactatagcagagattgatagatttttctgccatgcccagtatccccctatagctcaatctgaaatcaacagaccttcatatccacagctgtggcttattggaccattccctgatccaccagctgaacgagagtcatgctgtcctctgaggctccaccatacctggaatagacatctcttggtaggaccatgcttcctgtgttctcagttgatatggctcagattgagctgtccccttccgcaagtcccaggggcaggtccaggatccagtcctagataatcaaagcacaatttttccctggctactgtgctttgttcaagagcaggcacatgattcaggttggtctgagacaagtcttggaattttggctaaaatcattgaaaaagtggtgctctttgagttggagttgctaagctggcaggacataagcctaaagctcttggtggccgtcatgccagcagggaattaagttgactcagagaaaaccagaggcagagggtaatgatggagggatttctgatgacatcatttgaacacactgatcaagccatacctgaaacctcactagatttaggagccaataacctccctttattgcttaagccaattggagcaggcatacatatcacttttgaccaagagtcttggctaatctagcatctttgtgtcccttcataacgtggcttctcactttgtatctgatgtggcaattattcctgagcacaattaatgcgtcctccttggctacgagaatttttttttcttttttttttctttttagatggagtctctctctgttgtccaggctggaatgcagcggtgcgatctcagctcactgcaacctccacctgctggatgcaagtgattctcctgcctcagcctcccgagtagctgggactaaaggtgcatgccaccacgcccggctaatttttatatttttagtagagacagggtttcaccatgttggtcaggcaggtctcgaactcctgacctcaagtgatttgccctcctcagcctcccaaagtgctgggattacaggcatgagccaccgtgcccagccagctatgagatcttgaaaccagaattcctcctaggtgccagacacaactcaggtgtttggggaatgcttggtgaatgagtggctggatcgatgaatggatggactgatggatggaaataattaagataatacacgtccctccagaacatcaagcctccaattgcagcctatgcttctccaggcctttctcagaatccttgccccattcttgtgttcattcactgaggtaataaatgtttattgctcactacaatgtgtgaggctgtgtgccagggagtgtggcacagtggattcctcagcctagacactgtggacacttttgttttttgtttttgttgttattgtttttgagacagggcttcacgctatggcccagctggagtgcagtggcacaatcacagctcactgcagcctcaacctcctgggctgaagcaatcctcccgcctcagcctctcagttagctgcgactacgggtgcatgccaccatgcctggctaattttttttgtatttttttgtagagatagggtcttcctatattgcttaacctggtctcttaatcttaatcttaatctggtggcacccgggctctggagtcatatggacctggatttgaaccccagctctgccccttcatcttggtgtgaccctggacaacttgcttagcatctctgggccttgatttcttcatctgtaaagtgaacattggtggcattttgcccatatagttgttgcgagaataaccaagataaaatgaccccttactatgtgctatttacaaatgttagctgtaattatgcttttgctttccaatttaactagccaggtaggtaggtaagtagggggagagagagagggagagaaggaggaaacagcaaaaataaaagcatttttttctctgataatttgaggaaaatatacttgtctagaccagtggttctcaactagggatgactgtgtgccccagggacgtttggcaatgtctggagacatcttagttgtcacgactgagggagtgctactggcatctgcagccaggggtgctgctaatctataggacaacccctgtgacaaagaaatacctggttccaatgtgcacagtagccaggcatggtggctcacacctgtaatcccagcactttaggaggctgagacaggaggatagcttgagctcaggagttcaagacaagcttaagcaatacagggagaccctatctctacaaaaaatacaaaaaaattagccaggcatggtggcgtgtgcctgtaatcgcagctacttaagaggctgaggtgggaggattgcttcagcccaggaggttgaggctgcagtgagctgtgattgtgccactgtactccagcctgggccacagagtgaaaccctgtctcaaaaacagcaacaacaacaacaaaaaacaaaagtgtccccagtgcctaggctgaggaatcctggtctatcatacattgacatctctgatattaagggccacagtgcaaggtacagtgtctggcacatagtaggtgctcaatgaatgtttgacaaccacatgaatgaatgaatcaatcaatcacagaatggatgaatcatcgaatgaatgaatgattatatagttcatttgtcatttggctgagtgcctgggacagggctgcatccgagcagctgttcattaaataggtatggacaggttcctgtaaatgttcccttctgaagcagctggggagtgaggtcctggcgggggaacacccggcctcacagctgtggttccaggtcatgataaattgctgtgggaagccacagagcagacagctcatcacacattgtaatggattcattgtcttctctcgtggccccctttatctcaaactctcagcagacaagggttaaaagggagtgagctgagtgagggcctgtggatgctgctcttcaggaaaaggagggaaaatgagcccagacaggatcatcgttaaccggctccaaggtcaagagccgggttagaacgttagaattagagatgggggcagggatggcggcgggactctctccatcaccacaccctatctaattcatttattcaacaaatatttattgagtaccagagactctttgggcatatgtgagttaacaaaacagatgaaatccttaccctgttggaatttatattttaaagaagcaggatgaacaatggacacataggccggacataccatgtgtgaggggccctgtgcattaggagaaaaatcaggtagggagggaagataaggcatgtttggggctgagtttttccattgaggtgaaattcaaataacatgaaattaatcatttaaaagtgaacaattggccagcgcggtggctcaggcctgtgatcccagcactttgggaggctgaggcgggaggattgcttgatcccaggagttagagaccaacctaggcaacacgacaagactccatctctgtttttttttaagtgaacaattgagtggcatttagttcattcacagtgttatgtaaccactatttctgtctagttccagaacattctcatcaccccaaaaggaaaccccgtacccatttggccattcctcctcctccagcccctggtaaccgttgcttttctttctctgtgtgggtttgtctgtttttggatatttcacataaatggcatcatacactatgtggccttttgtgactagctcctttcacaagaatctcaccttgttttcaaggttcattcatgtggtagcatgtgcctttcattcttttttatggctgagtaaaattgaatcacatggatagaccacattttgttaatccattcgtctgtttagggacatctgggttgtctccatctttggctactgtgaatagtgctgttgtgaacatttaggttacaagtatctgtttgaggccaggcatggtggctcacgccagcagtcctagcactttgggaggccgaggcgggtggatcactcgagatcaggagttcgagaccagcctggccaacacggtgaaaccccatctctactaaaaataaaaaataaaaataaaaatggtatctgcttgagtccccattttcaattctttggggtaaaaacctaaaagtggaactgctgggtatatggtaattctatgtttaacttttttaggaatggccagtttcccacagcagcagcaccattttacactcctatcagtaatatacaaagcttccaatttcttcatctcctcaccaatacttgttattttccatttttaaaataacagtcatcctagtgataggaagtcgtgtgtcctgtggttttgatctgtgtttccctaatacatatcattacgtggtgagcatcttttcatgtgcccattggccgtgtatatatatcttcttagatagtcctttgctcacttttgacgttggtcatttgtctttttgttactgagttaaaagcatggagctaacttatttttatttatttttatttttttatgttttttgagacagagtctcattctgtcgcccaggctggagtgcagtggcgcaatctcggctcactgcaacctccgcctcccaggttcaagtgattctcctgcctcagcctctcaaagtgctaggattacaggtgtgagccatgacgcccagcctgaacttttaaatagggtgatcagaaaagacctccctaagatgatgactttttttttttttttttttttaagatggagtctcacactgttgcccaggctggagtgcagtggcgcgatctcggctcactgcaagctccgccttccgggttcacgccattctcctgcctcagcttcctgagtagctgggactacaggtgcctgccaccatgcccagctaattttttgtatttttagtagaaactgggtttcaccatgttagccaggatggtctacgatctcccgacctcgtgatccacccaccttggcctacccaaagtgctgagattacagggtgagccaccgcgcccggccagatgatgacttttaagtgaagaccttaagaaggtgatgggggatgccaaggtgatatctgagaagagcattccaggcagagaggatgtcacatgcaaaggccctgaggtaagtcactttcatttgtctgcaactcggttttcctgtctgcaaatggggaggaataaaaccatgaagcatcacgtcaaatgctggcaaattatcaacacctgggttccccacaactcttgctcttaagcaagatacttaatgtctcagagcttccatttgctcacctgtaaaatggtgataataataattgtaccgacctcacagtgttatcagattaaaagaaatatgatttgccagggcttggcacacagtagtgttcagaaatgcagggtttgaacccagaccaggaggacttccagtcctgaggggcgatcacagctcactgcagccttgacctcccaggctcaggtgatcctcccacctcagcctctcaagtagctgggactacaggcatgtgccaccatgcccagctaatttttgtatgttttgtagagatgggtttcaccatgttgcctaggctggtctcaaactcttaggctcaagtgatgtgcctgccttggcctcccaaagtgctaggattacaggtgtgagccactgtgcctggctcccctccctccctccctcccttccttccttcccttcttttttttgagttagagtctcactctgtcccccaggctggagtgcagtggcacaatcatggcttactacagccttgaactcctgggttcaagccatcctcctgcctcagtctcccaagttgggattacgggcacgagccactgcacctggctcagttcccctcatttctatgggagagtctgaagggtttcatagtgtgggggcctgtggtccatcctgactgctaccctgtacacacacatgtgtctgcccaacaaataccattcggggaaataacaaaacacaagatctatctttttcaacacaagttaccatggtgttttgctttgtcttgttttttggtggcaaatagattgtgggccttggggtctcaagtgagtgttcagatcccagcttccgtgctttactggttgttggacctccggcagcacccaagaggactttgggccttatggggccacacagatggttatcctggtatgaagaaaaggacaagaaacccgagcagtttgggtggcaagggaagaacaggagagagaaattccaatcagcctatttaaaatgccgtgcagagcctagtgagagtgaaacgacaatccactagtttccagcccttatttttctccctctagaaagaactaggaattaggaatctcagattcgagccatcactttgtccaaagctaactctgtgcccttgagcaaatcccttccactctctgcctcagtttcccaggaatccctttgtaaagaccttttcctctctgtaaccatggtggtgctgctactgaccagcagagggcagtgttgcaccaacattctctatggctctgcattgcttttgcctgaccttggacgggaacattgaaatcattaattagtggtcagtgtcatcatctttttcaaaaggccttattttatcctcagtgcatagtcagaacaaggtcttgccacagtgtacagatgaggaagcagagcctcagaaacataagaaacttaattactggtaattttggtcacaccacgtcctaaatttagactctcagaatggtatgaacccattgctgtgtgtctgagcagcaaagcattgataatccattacctgctttatgcatcatgaagcactttctgatcctcaatatcagacaattctcatcttattctcctccagtttgtaaatgagcaaactgtggcttctagaggctatatcatttgacttacagcttttttttttttagagaggcccaggctggcctcgaactcctggcttcaggtgatcctcccacctcagcctcccaagtagctgggattacaggtgtgagccattgcacctggcaccagcatattcacaatcagttccatcttagagactgtttggtggactcccaaaaatattagtttaaaaatgacagagcctggcgttttgcaatttttatgtgatgaaatgtactgagttctcatataaatattgctccttgttttgcaaaaggaattaggcccctttccctgtctcagcagctgcaccggttattagcaatcccctagggaactggaatagctttagatcaacagtggttctcaaaagggactatcaaatgacacacctgtccccagctccagattccgatatccacaccccaaacatccaatcactgtttctcatagtcttttgatgttttttgtttttgttgtttttggtttttggtatttttttgagacaaagtctcgctccgtcgcctgggctggagtacagtggtgccatctcggctcactgcaacctccacctcccaggttcaagctatcctcctgcctcaacttcccaccatgcctagataacttttgtaattttaatagagatagggtttcaccatgtaggccagtctggtctcaaagtcttttttttttttttttttttttttttttttgtcagagtctcgctttgtttaccgagccagagtgcagtggtatgatctcggctcactgcaacctccacctaccaggttcaagcaattctctggcctcagcctcctgagtagctgggataacaggtgcacaccaccttgcctggctaattttcgtatttttaatatagttggggttttaccatgttggctaggctggtctcgaactcctgacctcaagtgatccacccacctcaccctcccaaagtgctgggattacaggcgtgagccaccaggcccagcctaattttttgtatttttagtagagacagggttttgccatgttggccaggctggtctcagactcttatcctcaagtgatccagctgcctcagcctcccaaagtgtggggattacaggtgtgagccaccgcacccggccttctgcttgatcaattctgctattaagactctgatgcattcttcagtatgtcaatttcattttcaactctagaatttcctcttgattctttttaattatttctatttccttgttacattcatctgataggaaatctgaattccttctctgtgtcatcttgaattgctttgagtttcctcaatacagctctttcaaattgtctgcctgaaaggttgcctatttttgtttctccgtgattggtccctggtgccttattcagtttggtgaggtcatgttttcctgcgtggtgttgatgcttatggatattcatcagtgtctgagcagtgaagagttaggcatttattgtagtcttcacagtctgggcttatttgtgcctgtgattcttgggaaggcttttcaggtattcaaagggacttgaaccccgaacccaataaaactgtagttctgcggactcgtaaaggtaccaccttagtggtcttggagaagatccagaagaattctctgcattaccaggcagagattcttgttcttttcccttgctttcttccaaacaaatggagtctctctctctctctctccaagctaggcctcttggaactgggggtggaaggacacaagaacccctgtggccatcaccactgggactgcactggttcagacctgaagcagcccagcactgggtctcacctaaggtctgctagaactgctacctggccatcacctgaattcactcaagggcctgggactctacaatcagcaggtggcaaaaccagccagggtgttgtccctcccttcagggcagtgagttccctgggaaggtccagagatgctgtctgggagccagggattgataaaccttagaattctattctaagatagaatagaattctatagatgtatcattccactgcaggtaagctggcactcaaaccacaagacaaagtccttcccactcttcactcccctttcctcagtcagaggaacctctccttgtggccaccacttccaccagcctgcaaggagttctcccaggccactgctgatgttcacaaaaaccccgagggctcttcaggcagcctgcgatgaatgctatcaggcctgtgactcatccttcaggcagtgggctccccttggcccagggcaggtccgcaaatgctgaccaacagcctaggcctgtactcagggaccccaagagcctgcttggtgctctaccccactgtggctgagctggtacctaaggggcaagacaaagtcccctttactcttcctcctgcttttctcaaacagaaggcatctttcactgtagccaccacagccggaaatgtgctggatcacacctgaagccagcatgtctcagagcccagtgcccacaggtggatgggaagtaggatttagtggtgagtattaagaaggggcagcacagcagaagccctcacgagtgcagggcccactacttgtccagagggccacaatgaggatgtacttgaccccacacccatctcagatgagccacttctcagccaccgtgtcttcaaattcatcttcactgaacttggtgaagacccacttctgtgagatgtggatcttctggcagccaggaaacttgaacttggccctgagcagggccttaatcacatgctccttgttctctgggttcaaggcggatggacatgataattggccaatgtgaaccccagccacggtgccccggggctttccaaaagcacctcacatacctttttggagcctacactggggtagtgcaaggtcagagacatgaacatccatctgagggcctgtctccaaggtcccttagagcagccatacaagaaacaggctgcatacaccaccaaggaagctgctgtttgcagccattgcacacgtcccccatgaggcgaggaactcagccagctgagttggctgtagatgcccgcagcatattacctggctatggctgttggttatacagggcccaggggctccttagtcagcagatgatgaatgctgccaggtctctgctgtgatgggacagcactgagttcaatgtaaagtccccaagttgctagctctccctctcccaaatgcacagatctgtctgtgccacatggccactgccaggggtgggagtagggggtggcccaaagaactcccttagctgccccagctaatgtctcaggaggttgtgtgcccctgactccacagtccactggttgtgagcccagctcggcactcgggtttgcctgtgaattgcagtcctgatggcctaaactgcccctcaagtctgctaagggccccagagcactccagctcgcagtggcaaggcttgccagaactcaagctccaactgctaagatgggcaattccggtgagtgccagtccaagcgctccttgtgtgagccagtgtcagcgaagtacacctcggttctgctttctgctgtgacaatgcagcaccgagttcaatgcgaagtctcacaattgctatgctctccctctccaaagcacactgattctccgtgccacggggctgctgctggggggtgggggatgggtggcatcagcaactcaagactgtctttcctgccctcttcagcatctctttcagcgatataaggttaaaaccgggtactgtgattgttcacctgatttttggttcttgcgatggtgctttttgtgtgtagttagctgttaaaatttggtggtcctgtgaggggtcaaatgatgtaggtttcttttttttttttttgggaaagatctcgctctgtcgcccaggctggagtacagtggcacgatctcggctcactgcaagctctgcctcccgggttcacaccattctcctgcctcagcctcccaagtagctgggactacaggtgcctgccaccatacccagctaatttttgtatttttagtagagatggggtttcaccatgttagccaggatggccttgatctcctgacctcatgatccgcccgcctcggcctcccaaagtgctgggattacaggcatgagccaccgcgcctggccaaatggtgttggtttctattcagccatcctgctccaccctctgtgattttttttttttttaattgaaaagcacaggcaaagtttggttgtggtggtggtagagacaatagtgattattagcagaaaaagaaaagagctccaggatgctgtccatatttaatgtgcaggcctcctggctggatcatattgatggttcaagtagagggacagggtcgccactatcccccgactactccatgtcatcagacctctggctcctcacagggcccaggtacatgggactctgttttttcttttctttctttctttctttctttttatttttttttttttgagacagagtctcactctgtcacccaggctggagtgcagtggtgccatcttggctcactgcaatctgcacctctgggttcaagtgattctcctgcctcagcctcccaggtagctgggattataggcgtctgccatcatgcctggctaatttttgtatttttgtagaggtggggtttcaccatgttggccaggctgttctcgaactcctgacctcaggtgatccacctgcctcagtctatcaaaatgctgggattatagacgtgagccaccatgcccagccaggactctgtcttttcattgtgcagtcctacagaccttctctttcatctgtacctgtttcactagccagggcaccagtctcctgaggactgcctaggtaaatgcccggattaatttgctcctgtaggatatttatagacactctctgtggacagatcatacactcagcaaagagcagcaaacaggtcttagcaccctgtgaacctgatcttgggaggggccccacaccctctcatatcaccctcatttagtcttatttatacaagtagcaaatttaggactcaagatctgccctgtgtcaatgtctttctaggcattttgttgtctgaagtttgttatttctctggaagagatcatgggaataatagcacctgaggtcttctgtcacagcatggcacgtcagggtcttctctacccaaatgtgagttttgctggatataacattcacggtttacagtttcttttcttaaatatgtactccattttcctcaggtacaaagtattgctctcaaaaaggtagattctaatttctttcccttattatgtcacttgcgcttttttgtctagaagcccagaaatttttattttttaaagcccggtattgtactagaatattactaataacctgcattagtcattctgaatcaaaattccatgcactctcttttttttaaatttatttttgagacagagtctcattctgtcacccaggctgcagtgcagtggcatgatctttgctcattgcagcctccgcctcctgggttcaagtgattttcctgcctcagcctcccgagtagctgggattaaaggtgctcaccaccacacatgggtaatttttgtatttttagtagagatggggtttcaccatgttggccaggctggtctcgaactcctgacctcaattgatccacatgccttggcctcccaaagtgatgggattacaggcgtgagccaccatgcctggcccatgcactctttcaataagcagaatcttccagtaagggtatactgaattcatggataacatactctgatgtacccaataatcactgggccaagaattggcttttattttattttagttgccaattctcttccatgtgactgtcagcagattcttctctttgccggatctaaacagacctcattggtaaaactctccattgaaaacactttatagatggatggaagtgaagccagggctctgtcaagcctttgctttttatattgtaggaagagggacttgatttcccagagaaagccaaatcagggtcagaatgacaaattcttggctttttctgtgtgtggagaaagagaaaatataagcaaatagatctgaacaaggtattatataaatgagcccaaaatgggtctgtattgaatatccagtgcaatgaaactggagatgaatagcagaaggaaaacgggaaaattcaaaaatgtggaaattagcaacactctttttattgaggtaaaatatacacatataatttgtcatctttacttttatttatttttcttcttttattttttatttttgagacggagtcttggtctgtcacacaggttggagtgcagtggcgcgatcttggctcatgcaacctccacctcccgggttcaagtgattctcctgcctcagcctcctgagtagctgggattacaggtgcctgacatcacacctggctaacttttgtatttttagtagagatgggatttcaccatgttggccaggctggtctcaaactcctgacctcaggtgatctgcccacctcggcctcccaaagtgctaggattacaggcatgagccactgtgcctggctttactttttttttttttttgagacagtatctcgctctgtcacccaggctggggtgcagtggcttgatcataggccactgtaaccttgcactcctgggctctagcaatcctcccaccttggcctcccagaatgctgagatcataggtgtgagccactgtgcctggccatctttaccatttttaagtgaaaattggtggtaataaataaagttatatatgtatttttttcccccttgtatctccctttccctcttctctttgctgcttctgttaacaatcaatctgctctccatcttcatgagatctgcttatttagcttccacagatgagtaaggacatgtgatatttgtctttctgtgcttggcttgtttctcttaacataatagtctccaggtccatccatgttgctgcaaatgacaagatgtcattcttttgtacggctgaatgtttatatgccacatcttctttatcctgggataaagcaagtctcctgcttcaccctcctgagtagctgggactacaggcacatgccaccatgcccagataattttttattttttgtagaaacagaattacatcgtgttgcccaagcttgtcgtaactactggcctcaagtaattcttccaccttggcctcccaatgtgctgggattacaggcatgagccaccgacacccagccacgttggccattttaatgtctgcttttgagaaatatctgttcagatcatttgcccattttaaaattggattatttgtttttttactattgagttgtttgagctccttacatattctggttattaatcccttgtgagatggtttgcaaatattttctcctatctgatgggttgtcttgaagtaggaggtgggacttgatgccagtggcagggctcagacatcagaccagattgaggactagctaaaacagggaagaggcaaaagcatctctccataagacttggccaccattgtgccatgttagtttaccattgccatggcaacatttggaagttactgcccccttccatggcaacaactcaacgacctgaaagttactaccctttttctagaaatttctgcataattcacctcttaatttgcatataattaaaagtaggtataaataggactgcagaactgcccctgagctgctgctctgggcacactgcctatggggtgaccctgctcaacagggagcagtacctctgttactgctgtacacggctgcttcaataaaagttgctgcctaacaccaccagctcgcccttgaattatttcctgggcaaagccaagaaccctcccgggctaattttggggttcacctgccctgcatcaatctcttcacttcattgtttcccttattttttagcttgatgtaattccaactgtctatttttgctttggttgcctgtgctttcgaggtcctacacaaaaagtctttgcctagagcaatgtcctggaacattttcccaatgttttcttctagtagtttcatagtttcagatcttagatttaagtcttgctgggcatggtggcacaggtctgtaatcccagaactttgggaggccaaagcagaggattgcttgagttcaggagtttgagactagcctaggcaacatggcaaaaccctatctctacaaaaaatacaaaaattagctgggcatggtggcgtgtgtccgtatagtcccagccacttgggaggctgaggcaggaaggtcactggagcccgggaaggtcaaggtttcaatgagccaggataatgcccctgtactccagcctgagtgacagagcaagatcctgcctccaaaaagttttaagcctttattccattttgatttgattgttgtgtgtggtaagagacaaaaatagtttagtttcattctgtgtatacttatccagtttccccagcaccatttattgaaaagactgaccttttccccatgtatgttcttggcacctttgtcaaagatgagttagttgtaaggccgggtgcagtggctcatgcctgtaatcccagcgctttgggaggctgaggtgggtgtatcacctgaggtcaggagttcgagaccagcctggccaacatggcaaaactctgtctctactaaaaatataaaaattagccaggcacgatggtgcacgcctgtagtcccagctacttgggaggctgaggcaggagaattgcctgaacttgggaggtggaggtttcagtgagctgagatcgtgccactacactccagcctgggtgacagagcaagaagactccgtctccaaaaaaaaaaaaaaaaaaatttgttgtaaattcatatgcatggatttatatcaggattacctattctgtactatttgtctgtgtggtctgtttttatgccagtaccgtgctgttttggttactatagctgtgtagtatattttgaagtctgatagtgtgatgccgccagctttgttctttttgctcagaattgctttggctagttgaggtcttctgtggttccacataaattttatatattttttctttttctgtgaagaatgtcattggttttgatagggattgcattgaatctgtaaattgctttgggtagtgttataattttaacaataaaatccttgccatccatgaacatgtaatatctttccattttttgtgtcctcattaatttttttcattagtgttttatagttttccttgtagagctatttcacttcttggtaaatttattcctgtgtgttttatttttattttggtgctattgtaaatgagcttcctttcttgatttctttttcagaatgttctttgttggtgtatagaactgctactagcctgggcaacatggtgagaccccatcttatctctacaacatttaaaaaaaatctagccaggtatgcacctgtggtcccagctacttgggaggctgaagtgagaggatcgcttaggtccaagagatcaaggctgcagtgagccatgttcgtgccactgcactccagcctgggcaacccagtgagactgtctaaaaaaaaattagaaatgccactgatttttgtatgttgattttgtattctgcaactttactaatttgtttatcagttctaacagttttttcgtagagtttttagatttttccaggtataagacgtgtcatctgtgaacaaggcttatttgacttcttcctttcaaatttggatgccctttatttcttgttcttgcctaattgctctgtccaggacttccagtattatgttgaataaagtggtgaaagtgagcatccttgtcttattccagttcttagaggaaagaccttccatttatcctcattcagtacaatgttagctatgggtttgtcatacatggctttcattttttttgagctatgttatttctataaccattttgatgagggtttttaatatgctaaactttacaaaattattttccagcatttattgaaataatcatatggtttttgtttttgcttctgtttaggttatgtatcatgtttattgatctgcatgtgttgaaccatccttgcattcctgggatgaatcccacttgatcatgaagcaggataggtagtcaaagaagtaaccatgttctcaggatgcagtaactgtggtgactatacagtcaacacaataagcctcagtatttgcattgtaattgagctcattcaagcaaagctatcttcagtagggactttcccctctggagagcatgaacagtttgattttacctgtcctcaaactgaccctttgctcattataatagtaaaaaaaaccacccctgggtggagatttaagatgcgaatgagacatgcaatgtatgaacaatcatgtacagctactgtgcatgggcaagaggaccacccagaagatgcttactaccaacacctcttccaaccctttatgaataatcgtgtaagacttccataaagagagtcttcctagtgccagtttttgctgtctcgcccttatgagcaacaaaattctctctcccagggtatattatctattttgcaccaaactttcaaaatattattattatttgagatgtagtttcgctcttgttgcccaggctggagtgcaatggcacgatcttggctcaccgcaacctctgcctcctgggttcaagtgattctcctgcctcagcctcctgagtgccaccatgcccagctaattttgtatttttagtagagatggggtttctccatgttggtcaggctggtctcaaactcccaacctcaggtgatctgcctacctcggcctcccaaagtgctgggattacaggtgtgagccactgcacctagcccaaaatagtctttttcttttgcaataaattactctatgttgcatctcctttgctgtgagtctgtttaaattttcttaaactaagaagacaagaactgaggtcttgcatcagccatcaacaatcatggtgaatggtctttttgatgtgctgttagattcagtttgctagtatcttgttgaggattttggctctatgttcatcgggaatattggcctgtagttttcttttttttgttgttgtgttcttgtctggtttgggtatcagggtaatggtggccttgtaaagtgagtttggaagtgttccctcctctttagttttttggaagagtttgagtaggattggtaatggttcttctttaaatgtgtagtagagttcagtagtaagcaaaacagcatgtgccttcggctcctggagcagaggatccctgtctctcagtgcacgcaccatgcctggcatggaactggcctcggactccacttgcagccttaataactccattctttggattttgctgtcttatatttgcctttcgtagaaggctgagaagtaaaaaagaaaaataccactggactcaccttcatgaactagtttcaaaaactttctgctcacagagtaaaaacacttcatatttagatcaaggaaatgaattaaacctaatcagtttaaaatcaccctcactagaccacacttttttcttttgagatggagtctctgtcgcccaagctggagtgcagtggcgcgatcactgcaaccttcacctcccaggctcaagctattctcccgcctcagcctccagagtagttgggactacaggcgtacaccaccacaatctatttttgtatttttaatagagatggagtttcaccatgttggccatgccggtctcaaactcctgacctcaggtgatccacccacctcagcctcccaaagtgttgggattacaggcctgagccactgcacccggcctacaacaactgctttgaaagggctttttctctatgattaggaagatccatgtttagaagcttggtaaataaatccaaaacctcttcccagacaatgaattgacccttcgatgtcctatgttttttttttttttttacctttgctagtcactgtatcaaaagtaaaaaatatttttataatcttactatttttcttacatcacaacttacataaaatgagatgcacttctttttaaaaagttttcaaaagcattttgttgtggttttagatgattaataggtgatcagtttgaagagtgagaatgaaaaaaccagcacatgtgggggaaggctggggaagggatttgattatatatttaagtgactgaattcagttctctctcatttcctggacaatagttctgtttttttcagattattctgatcatttcaaattaaagcgaagacacatgatcagttctcaagtcctatgttctcattaggaaaaatagaaaaacatgcaactctagctgaatatggtggaaaatattttgttagaggtcctttcatagggcctttgtccagatgtttggaccgaggcccccgagggcatggagagccagcctgaaggacagcgtagggtgtgcctgcagggaaggtcgtagctcaccagtgacagaagaggcagactccccttcttccaggccttggtcttctacatcctagctcagtggtcatttatttgtcaggcccttcattttactgatttaataacgtgtttaaggcagggtgcggtggctcacgcctgtaatcccagcactttgggaggccgaggtgggtggatcatctgaggtcaggagttcgagaccagcctgaccaacatggagaaacccatctctactaaaaaaaaaaaaaaaaaaaaaaaataccccgacgtggtggcgcatgcctgtaatcccagctacttgggaggctgaggcaagagaataacttgaacccatgaggtggaggttgcagtgagctgagatcatgccattgcactcgagcctgggcaacaagagtgaaattccgactcaataataataataataataataataataataacaacaataataataatgtgtttaaataatttatctcatatctctgcaccttcactccatttcttttcaaagaaacagagaaaaacaaaaacaaaatgtcatagttctgggccgggcacggtggctcacacctgtaatcccagcacttcggaaggctgaggtgggtgggtcatttgaggtcaggagtttgagaccagcctggccaacacggtgaaactccacctctactaaaaatgcaaaaattagccgtgcgtggtggtgggcatctgtagttccagctgcttgggaggctgaggcaggagaatcgctgagggagcccgggaggtggaggttgcagtgagctgagattgtgccactgcactccagcctgggcaacagagcaagactctgtctaaaaaaaaaaaaataaaagtcacagttctacttgacccagcagcaggctttaaaaccagaggctttaattctcccaatttcctcatttgtcaaaatgcagaagccaatctaagtaaatcacctagaacggcagcaagctacgtaagttcggggctgaaatgtgatatttcttctgaatctctcttttcttacaacatcagagaaatgggtaataaatagcaccaaacccaggggctccacatttattcctctttccggaggaaataaattctagccaccatatttctcaataggaaccgatatgtaaggagaatgaatttattcattcatgagtcatgtattcaatcctgataaaaatactttattctggtcttcaatagcaaatatgaccggagagccagagggtcagtggtcctgctctgagctgtgcaggtggggctgtctctgggtagtgggagggtcgggtgggtgtttctgacctgggcgtctttgcccagaggagcagaagtgaacacacgccctcccactgggctcttctgctgacgtgggttggtaggacggttatggctcagcttagggtccgcagctgggcaatgaggagactggaggggcctttctcaggtagtggcgtctggtaatcagcagatggcgcccgaggtcgctgggcccgccccgcgtgcgggtctttctggttgactccccaggctcttgcgtgggaactcaccactgagcactgaacgcagttcctcagtccgagacctcctcactctcgcaggacgcacagttgcacacacaagtccctcacctgtcacgacccacgctcttacatactctcccactcccacccacaccccctctctcagatgtgtgatccaggatttcctctccacccacagccgcagacgcccccacggttcgtgcaaatgtgcacactcggtgcagcagatccccgcctcctgcacacgtgcgcgtttttccagcctcgcactttatctcacacgttttctcacccagagaccccatttcagacacacacaccctctcagccttttctcttgcctcccaaccccttaaaacggaaatcctttatttcctccggaatttgctcacttcgtgaaatgccggtctgtcttctggcggatcctatagggcagccctttcctgccccttggttccaacagcccctttcatgccagtttttgtcacgtgcctcttaccatgctgaagtgaaattgacccagccatcacacaatgccctaactcaggggtctgcaaacaatggccccagaaagctgtttgttttcccccagctttatctgaatatgcttgaaaagtaaacattgtatatatttaaagtgggcaaccggatatttaatacacattgtgaaatgatcaccgcaaactaaaacacccaccatcttacattgttaccactttctttcttttttggaggtggggtggttaaggatcttaagatctactctcttaagaaatttcaggtatacaacagagtgttgttacacgctgtacgttacatctccagaacttactcatcttgtataactgacactttatacccattaaacaacaccccgttttctccaaccctcagtccctggcaacgactattctactctactctctgcttctatgagtttggttagtttagattccacatataagtgagatcatgcagtatttatttatttatttatttatttatttttcttgatgtggagtctcgctctgtcgcccaggctggagtgcagtggtgccatcttggctcactgcgacctctgcctcctgggttcaagcgattctgcctcagcctcccgagtagctgggactacaggcgtgcaccaccacaatctatttttgtatctttaatagagatggagtttcaccatgttggccatgctggtctcaaactcctgacctcaggtgatccacctgcctcagcctcctgaagtgttgggattacaggcgtgagccactgtaccaggctgagatcatgcagtattagtctttctgtgcttacttatctcacttagcatagcaggttcatccaggctgttggaaatggcaggatttccttcttttttggagctgaataatattccattgcgtagacacgtttccctcacccattcatctgtggatggatgttattttccataatggctgtacaagtttacatttttactaacagtgtacagtgatccctttcccccacatcctcaataacagttgttatctttcctcttttggataatagccattctaacaggtgtgaggtgatgtctcattgaggttttgatttgcatttccctgatgattagtgctgttgagcactttttcatacacccgttgggcatttatatgtcttcttttgataaatatctgttcaggttctttgcccattttcaatcaggtgatttgttttttgctactgtgttccatgagttccgtatatattcttgatattgcctccttatgagatgtacggtttgcaacgtcaggaagcttttcccctgtgttttcttctcgtagttttatgatttcaggtcttacattgaagtctctaatccattttgagttgatttagaatatgcaaaggaagcacttgaaaaagccagcactaggttgggcagatccctcctgtgggaaactgacttgggataagagcaggactgcctggccccccagtgagaggtgacagcgtgctagcagccctcgctcgctctcagcgcctcctctgcctgggctcccactttggcggcacttgaggagcccttcagcccgccgctgcactgtgggagcccctttctggtctggccaagactggagccggctccctcggcttgtggagaggtgtggagggagaggcgcgagcaggaaccagggctgcgcgcagcgcttgcgggccagtgcgagttccaggtgggcgtgggctcggcaggccctgcactcggagcggccggccggcaccgccgccccgggcagtgaggggcttagcacctgggccagcagctgctgtgctagacttctcgccgggccttagctgcatccccgtggggcagggctcgggacctgcagccccccatgcctgagcctgagtctccccaacctccaccccgcccccgtgggctcctgcactgcctgagtctccccgacaagtgctgccccctgccccacggcgcccagtcccatcgactgcccaagggctgaggagcacgggcgcaccttgcgggactggcaggcagctccacctgcggccctcgtgcggaatccactggctgaagccagctgggctcctgagtctgatggggacttggagaacctttatgtctagctaagggattgtaaatacaccaatcggcactctatatagagctcaaggtttgtaaacacaccaatcagcaccctgtgtctagctcagggtttgtgaatgcaccaatggacactctgtatctagctactctggtggggacttggagaacttttgtgtctagctcagggattgtaaatgcaccaatcagcaccctgtcaaaacggaccaatcagctctctgtaaaatggaccaattggctctctgtaaaatggaccaatcagcaggatgtgggtggggccagataagaataaaagcaggctgccagaggtagtagtggcaacccgctccgacccgttttcatagtgtggaagctttattcttttgctgtttgcaataaatcttgctactgctcattctttgggtccacgctgcttttatgagctgtaacactcactgtaaaagtctgcagcttcactctggaaccagcgagaccacaaacccaccggaaggaagaaactgcaaacacatccgagcatcagaagtaacaaactccagacagggggcctttaagaactgtaacactggccacgagagtccgcggcttcatttttgaagtcagtgagaccaagaacccaccaattccggacacagtacttgctgcctctctatatcatctcctctgaaggcaggtatttgcctacacagtctgctgagtactaagtgcaacacacactgcaggggcttcccagagccctactcggattcaggtggattcttatgcagatggtgaaaaaggtcaaaagtttgaactgggaatcaattgctgtaagtttctctatgatattctcccagcaagatgtcttccttgtaataacttgggagaacgttgactccagggtaggagagtgttcctgaggagtcggcacactttatggctggccccaggccgtgggtcagaaaaatccacagctggccacaccattctgtgcagcgggaaaaaccatcagttgaaggtactgtggaaaatcagttaagctcattcaatcatcctggttcctggtgggttcagtgtcccatatttaagacaaaactcttaacactgttatgctgtggtcttctttgagttcatctgtgaaaaatctaaattgttaagtcaatcactagtcttacaactagaaaagaaacatactatgtaaagttgcgacacttttcatagaaagcaacatctcaatctaatgttacatattcaggtgagtgttaaacatcatctgagatgagctcttctctgggctcagccacatctctcaagatcccaagagaatcaaaaggttgaagtgtgaatcaatttgtatgaatttctcataaatcctgtcaacaagatgtcaacagctgtctttatcgtcatacatttgggaggctgttgcctccaggatctgacagtggttaccaaggagtcagcaccgtctattgctggccccacgcagtgggtcagaaaaacccacaactgggcagacaattgagttcatcccagaaaaccatccattgaaggtgctgtggaaagtcagtgaagttcattcaatcatcaagattctagggggttctgtgtcccgtactgaagtcagaactctcacactgttacgccttagtcttcttgcagttcatctacacacatctaaaatgaagtcattgctgtttctgcaactgtagaagtaaagatgtatttacaatttaaaggatggtaccattttactggaaagcaacgtctcaatcttatgttgacacattcacctgagtgttaaacatccactcaaaagagtgttgccaaccttgactaaaatagtcattgtgtagaacagtttgaaattaacatgaaaatggaacagacagaacagaaaggtctcagatcctttgtccacccttttcttttcttaaccccattttcagtggtgtggtccatgtgtgtaacaatgactaaaccaatatggatacatttttacgatctgaagtcaggagtttgcatggaggttcaccgtgttgtgccctctatgggttgtgacaaactccgaatgccattcaccacccatacgaagtagctgcatgccttaaacacttcctgtgtttcccctgtgcatccctctcccctttgccagaagccctggcaacaagaatccttttcactgtgtctagagttttctctcccagaattgtataggcttggaatcatggagtaggcagctttttcagacggccttatcctcctcagcaatattcattcactgccagcatctgtctttgaggtcaccccatggtcgccactcccccttcccagcttttccttgcaaggtctcttgttggctccagtgggagcttcttcccatctgcccaggcccttccaacgccccccagtgtcagcaaggcctggaccagggacaccagcagccccctgcactggagtcctgtggctccaccccaagtttgaaatttcccagtaaccctgcagccactgcccagccagttctggtagaaatcagggaaagaaggatcttccatgcactcagcgaccttctcaactgaagtctaaagtttcactacagataatgttgccaagaatgtggaaaatctgcctcccatcatcacctctgccagccacggcttctgtgtggttgggccacatgcactgtgtaaaatgacaaaggggcttcatcaatggctgagcatcagggcaggcacatggctctgttcctaggaggaggacatgttaggttgtgcattgcagggtggggaaagatcaagtcagtgtaatgacaaagaaatccccacccgattccctgccgaacctcctgggtgaaataggtgtctgctggcttctgagggcctttgcaagaaaacaggattcttgcttaagcaaaagtaggtgtaaaatgaggcatactatggcttgaggaaccatttggatcatgaacaccacgtgaaatgctttgtatcatcatagaaatccattagcctgcaattgacctcttgatatttatccccacaaagcaaaaagatgagactgctccatttgaaaagggtcacttttgcctacagaaacatgcttctcataacaaggctgtcctagacatttcttactctctagaacacagtttcccagtggtgcttgagaaaaaacccaaggtgaggacctcaatgctaaaagcagtgacgacaagatcaaggactccaggaatccagagatggccgctcagtggactctgtgggagaaggcagggctccggccccaggctgggcctgcagagggagaagatatagagggatagaaggaagtcacaagggtccccgggcccggtgagttggggttggggaggatagattccagggttttaatgtcaggagactcatgacatcatcatcccctgagtcctatgattttcctgctccttctaagtgggaaagagcaggggggacggtcctggctggagtgaccctgcatggacatcgctgacatttcttaagagagggtagttccttcctgttgaagctgtgacaggagctggggacgggcgtcttcatcatgctgtgtgacaaagcaggcctttccatcctggaagctggcgagaggcagagagtaggaatcaggtttccggtcctctgagccagactgggggacatagttcagcagggatggtgtcaaggtcaggccagacacacagaagttcccagactgaccttcctggggctcatagttcagcagggatggttgtcaaggtcaggccagacacacagaagttcccagactgacctttctggggctggacagaaaccagtttccatcttccacctgcttctggaagttgcctgtcaagcgccctctgtagacagcactagccaaagattgcctggcccagaagtgcattgaaactgaaggcagtgtggccccacctggccagggcagctgctcacactgtagctccctggaaggagcgagggcaccggctcccgttcagggcaagctcagcaaagtgatggaggctgatcccagagcccagatcatccttgatcctctgtttcacagcccagaggacgtgggtttgagattttctctgaaatggtcttagagttctcaggcccaaactcttgagtcctcgcactcatggggatccgcaatgcggctgcagctgttcagtgcaggggcaggaatgtgccctccgcatttcctctcatcacagcgctcagccctgggcagcctgtcttaggccacatgaaggtctcatgaaaacacccctgggctgggctctagctcgagtgggcaaaggttccctcctcacactgttcagcctgttggaccttctcactgaacgaggcgtcttcccaggatctgacccaagtcagagggtggtgagggtgggctcctgcagaccctgggatgtccattttcctggggtctctctgctctgatgctgtttagacaaggttggtttcacttctctgtgtgcaagtgtaaccccctccccacggcttccctctaggccaaggcactgtcctcatggttgtatccccatatctcacacagtgcctggcccttgtgcaggtgctaaaaaaaatcctgtttccttgcagaggccctcagaagccacacatgaatgatgggatcagagcacccaaccccactgcaaggaaacacccagggagggagtcatgtccttttcatgtttgtatctctagagctgcagcatctagcgtgggaatcccagcctggaggtgctgtgtataactcattcattcattagtgcagttaatcacaataaaatgagaaattccaatcttcattcacactggccacatttccagtgccccacagagtttgtgccagcggccaccttatgcaacagcacagagaacatttccatccacacagaacacactcttgggaacctgctctgagcctggcatggggtctgttcatggaactcatctaactaagaaacctgtgcatcaaagttggaatttcaggtgaatgggactggaggaacgagctctaacgatccagcggaaatgcggaagtgggaagatgatgggggtgctctctcctgagggtttgcacccgtgagctgtgtcttgttagagactctggactccacagagttaaaggagggttgaacagaccaagagagagagcagggtggtcttgtgtgatccagcttgacctcagctggaggaggagggatggatgaaccttcctctggaataattgtcttcccacttttgtctctagagactccattgtcaacagaagacatgattcaagcagtgatgaagaagacactccaggtttaaaacaacccaggagggacccaacgaaggagggtgcctgtagcagttggggttggcctgctgccttagagactgaggaagtgggggatgaaattagaaagtgaaaggaaacgtgtatggaaggctgctttgtccttgtcatccttactgactcaatagggagaggtttggtgcctctgggctttgagtgtgcagtgtttgtcatcatcttttcttgctgtgattttttaaaaatgatctttcccggaaaaccgtgtctttcctgcctttgcgtcagtaaaactccaaagtctttggtgatgtttggcagcacctcctgcgtcttggtgaggaagaatgtgagcaaggaggtgcccatgatgtgctggagcattcactgcctcttcccagccaggcctgagtcggggatgctcagacagctgctcagatctttagtccataaagggaaagggaagcagggggctgacgggcttcactgattgagatagcagagcaccagtccagcaggcctcctccccagttaactcgccttccctgctcgtaagagtttgtcagttacagtgaagcgaattctttgggaggctctgtcctatgggtgtggctggcatgggagtcctgagctctgagccagtggggagtcaagaaggacactagtcattcagggtggtcgctggcacatccagaagcctcaccttgaggtggctcatggtgtgaaggtgctggggcaggagtggcgcagattggacaccctgatccttcaaagggtcttcatttggggtcagctgcatcatattttgggtcaaggattacaacatagatgcaggaggctgtgtcagccacctcctgcaggacatcacctctctccaaagtaatcctggaacaagaggatttgggaaatggggtgagggaagccctgggtcaggcacccagggcatgatctagaggaaactgggcttcagggatctccgtctccaggaaaccaactacgttcccggctcagcctcgtccctccttagtgttgtgactctgggtatgtcacttaggccctgtcaattttagtgtcctcaactgtaaaatgtgggtcacagccctgctccgcccacttcacggggctcctgtgagggtcatgagggatgacaacagatcctcttcaggagctagaagttcctgcccatggaaaggctggaaagtgactcgtgacttgtagccactctgaggcaaccactactacagatctccttcattccctcagacattatgtatttgagcagttttctagcacttatgaagtgtcagtcatttttctgttggcttcgtttgggtctgcttctaggtaggatctgagcccaggacatcaggcacctgccacttgctctaagtcactgagctcagctgccctcctgaattgtctcattagagtaacgtccccacgcaatcatccgggtgttatgtgaagtgctcacagcacctcaggacgcctcccgctaagccagctttgactcggttgctccccgaggcagctgttggagacaagtgtgacttgggaaaggtgaacacctgcccaccgtctcctgcctgcaccgtatcaacagggggctctattttcaatgcatttttccaaagctcatggctcagagatacaacaagaacagatcatggaagattcaaatccagactatgccagaaaagtgatctgggctgaagaaaacctcctggccattcccagaagcatcccgtcggcatctgggcaaaggcaggaggagcctcagacatcaccacctgccagctcctccactgaaggcgtcctggacctgaagctatcaggagattggaatcattgctgtggtttgtacagcagggcctgagtcttggtgaggaaggacaggagcagggaggcgcccactcagagctggggcagccactgcctcttctcagccaggcctgagtccagactgctggggcagctgctgtgatcaagaggaggcactgagaccctggcagcttgccggcttcactccctacgctgcccaagccccagcccagcaggccgctttttcattgaaagaatctgcactgcccagcagcccggtttggtcagttgaaggtgaatctgattcaaagtccaacggtcacgtgggcagttggtgggggacctcctgcattccgagtcggttgggagtcaaggaggctactggtcattcagggcagtcaccagaccacagggaagtctcttcacaaggcaaccacagagtcaagtgtggtgggagacagacacaaatttggaccccacgcattcagcagggcttcatttgggggaaagtcatcacatcttgggtcaggggttgaaatgtaaagctgggagttgagtcagggtttgggcccttctcttgggccaagcacctcctccaggcaacagtgtctccctgcagcagccgtgggggtgggaggatttgggaaaggagtaaggaggttcctcggttcagcgtccagggcatgatctaatggtcttgatgcaggcgaactccaaaattggaccttaggccatgacggtccttggatttgctcaggaaacaagagccagccaatggtgaaagccggcaagtttgtgtgaacaacagtgtctgccaaaatggctgttccacagacagagcagggctgtcccagaggcgtgtagcaccagtggcatgatggctagctttatttatacctactcttaattatatgccaattaaggggtgggctattcacgattttctggaaaagaaccaggagtcccggaaccatatggtaacttccgggtcattgccatggcatttgtaaactgtcatggccctggtgggggtgactcaagagtatacaatagaattcctagtcctagctggtttgggctggtttctttgctacatcttgttttcatcagcagggctgtgatagttgctcagaaagtgagtcctgttgatctcctgcctcagtctcaggtgttcagggatctccatcccttgggagccaactaaattccctgcctgagcttcattattcatcagtgttgctattctgagcacgtcactgaatctctgtcaatttcagtgccctgaaccataaagtaaatgttacagcccctgctctgcccatccaggaggtgtaaagtgtcgtgcacatgcccatgtggaatagtagggccctgtccttcccccgtctgtcaccctccatgttgcctctctgggggtcaccaatgctgcttgtcttttttatttttccagatgtgtaatcattgaacacttaggtaggcagtgcttatgaagtacccgtcatttttctctaggctgtgtctgtgtttacctttagcccttataacatggtagtactacgcaagccctagtaacatgttctcaccccagaacagagagctgaggacaaagggactgagtgacagtcccaggcacacgtggctttgatctcaagccatcaggcaccagcacccatgctctggtcactgtgttgtgctgactttctacactgttatctaaagaaagccactgttcccacacaatccctctgtggggtattttaggcacaccacactgcaggatccctcttcctaactccactttcattcaaatgccccactggacagttagtgataagaagataatggattccaataaaggatgtacatggggatggattcttggggaagaaaatgtaccccctggccccacagctgttcagcagcatcaaaaccggatctggctaaagaacgaggttaagcctcaaatatcatcctgtaccaccccctccactgaagtgcctgcgggaatttaatcattgaatttattcactagcaattgttgcagtttagtgcatcatatttagaaacaaaataaattgttgtcatattcttttgtattgatatataatgaaatataattcacattccataaatgcacctttttgaaggatacaattcagtggtttttagtatattctggttttgccatcgtccccactacctaattctagtacttcaccactccaaagagaaaccccttgcccatgtcagccaaccccattctctccacacaccctgccctgccagcctctaatctgctttctgtctgcgaatttttgtattctgtgtatttcatatacatagaatcatacaatgggctgtcttctatgtcctggcttcttcagtaggcagaaagtattcacgttcacctgtgttgtggccatacctggaccttacctgtttatggtggaataccatccattgtgtgagcataactcgtttcgtttttccatttatcagtgatggacagatgcgttattttcattttttggctactatcaatagtgctgctatgaacacccatcttcgagttgttgtataaacgtatgatttttttttttttttgagatggagtttcactcttgttgcccaggctggagtgcaatgatgcgatctcggctcaccacaacctccacctcccaggttcaagcaattctcctgcctcagcctcctgggtagctgggattacaggcatgcaccaccacacccagctaattttgtatttttagtagagacggagtttctccatgttgaggctggtctcgaactcctgacctcaggtgatgcgcccgcctcggcctcccaaagtgctgggattacaggtgtgagccaccgcgcctggtgaacatatgatttttatttctcctggatatatatctagcattggaactgctaggccatattcgtagctctgtgagtaactgtctgaggaatcaccaaagtcttttttcctttttatatttgcacaggcaatgtgggaaggtcccaatttctgtaatcattgctaacacttgtgtttgctttttaaattatagccatgctagtggatgtgaagtgatatttcaggggttttgattggcatttccctattaactaatgattttaaacatgttttcatttatttattgccaatttgtgtatcttctttagggcagtatctatgcaaatcctattttaattttgaaaatttgttagacattttatttttgatttgctagtgttctttatctcttctggataatagaccttatcagatacatgaattgcagataatttattcaactctgtgtttttgtatccctttcatgatggtgttctttgaaacacaaaagattttaagtttggtgaagtcctatttattttacctctggttgcttgtacttgcggtgacacatgtaagaattcattgccaaatgttagaaaatgaagatctatgccctttttttctgagattcatatagtttagctctttaatgttttttgttttatgttttatcaaagtcttaagcctttaatccatttttaattattattattattattattattattttgagacagagtttcgccgtgtctcccaggctggagtgcaatggcgtgatcttggttcatcccaacctccgcatcccgggttcaagcgattctcctgcctcagcctcccgagtagctgggattacaggcatgtgccaccatgcctggctaatttttgtattttcagtggagttggagtttcaccatgttggtcaggttaatctcaaaactcctgaactcaggtgatctacccgccttcgcctcccaaagtgttgggattacaggcataaattaactttcgtgtatggtgtgagttagctgtccaacctcattctttgcatgtggatgctcattgtcctggcaccatttgttgtaaagaatattctgtctttggccttgccacactttttaaaaattgacagtaaatgtgagggtttacttccagactctcaattctatttcatggatgtatacatccatcttttcaccagttctgcacagattgattatactacctttatattaagtttttaagttgggaagtctgagtccttgttcttttttaagattattttctctacattggtttctattcctttatgagttttgggatcaccttgtcagtttcaaggcagctggaatccttacaggaatttgctgaatctgtcaatgaattaggggaatataacatcttaagtataagtactccagtctgtgaacatatgtcttttcatttattagatcttttaaaatttatttaaatgatgtttcatagttctcaatgtacaagttttgtacttcttttgatgaattcatttctatgtatttatttgtttgtttatttatttatttgagatggagtcttgctctgttgcccaggctggagtgccttgtcatgatctcagctcactgcaacttctgcctccccggttcaagagattctcttacctcagcctcccaagtagctgggacttcaggcatgtgccaccactcctggctaatgtttgtgtttttagtagagacagagttttaccatgttggccaggctggtctcaaactcctgacctcaaattttccgcccacctcaacctcccaaagtactgggattacaggcatgaaccacagtgcctggcctctaagtatttatttctgatgctattgcaaaaggaattttttcttaatttcaagttcagattgtttattgcaagttcatagaaatacaattgattggtttatcaagcctccaagccttgtcaaaggtttattatttctcaatataggattatgttcaaagaacctcgaaatcttctcttatggacaagtggaagaataaactcatataaactttctggaaagcaagttggctagttatcaagatccttaaaatgcaccatatcctttgacacagtaattcttgcccaagaaattttttttatttcattgtaagttgacaatttataattgtatatatttatgaggtgcaaagtgatattgtgatttacaaatataatgtgggataattaaatcaagctaattgatatatacacaacctcaattacttatcatttttgtggtgagaaaaattattacctgttgattttgtatcctgtaatattgctgaacttgcttattagtccaaatagtttttcatttatttcttatggttttctatacagtgtcatgtcatctgcaaattgggacagttttatttcttccctgcctatttgtatgctttttatttctttttcttgcctagtagttgtagctggaatttccattacagtgttgggtcaaaagtgatgagagttggccaggcgcggtggttcacgcctgtaatctcagcactttgggaggccgaggcaggcagatcacccgaggttaggagttcgagacctgtctgaccaacatggagaaaccccatctctgctaaaaatacaaaattagccaggtgtggtggcgcgtgcctataatcccagctactcaggaggctgaggcaggagaatcgcttgaactcgggaggcggaggttgcagtgagccgagatcatgccattgcactccagcctgggcgacaagagcaagactctgtcttagaaaaaaaaaaaaaggcggggggcggggggtagggtgagagtggacatccttatcttcttttaatatcgggggaaatttttcagtcttttaccattaagtataaagtagtggtgggtttttcataggtgccctttataaggttgaggaagttagcttctattcctagtttttcaactatttttattatgatagggcgttgcattttgccaaatcattttttagtctattgagatgattatgctttttttgtttgtttttctggttgcttggagtttattttccacttggtgccaggtgcacattttcaggtatcaagagagctcacaagtactggggcagtagggagcagggctttctcactccttttcagtgtctgctgtgttgatgtgaaagtcaacttgctgcagctgcctagtcctacagggtgaggagctgggagggagacagacagggcctctggtggcctagtccctccataggcctggggctggtggtggccactcaggtcaggacaggggtccaggatggggctgtgctggaccggccaccgggctgcttcctcggggtttcccgagccaggccccaggtggtcatgctgctgcaggcctggggggttccgggtgctctaccaactccaacaccgtggccatgaacaggagggtggacttcccgaaaaataagctggcccaccagtgacctgggtcagccttggggaaagccggtgggtgggggatggcttccccagggcacttggtattgccacaggagctgctgctggaagtggaacccaggcggcctgggcggcgacccctctctggccttggcacacgatcacaggtggtggggtcaggggcactgggccacggagcccatttgcagaggagacctggggaggctgctccatgatcaagacacaggcgcacaagagatgattatgcatttttaaccttgttttattaatatggtatattaacattgattgatacaaatttttggaaccaaccttgcgttcctaaaattaatcccatttggtcatcatgcatcattctctcttttttctttttcttttcttttcttttctttttttttttttgagacagggtctcactctgtcgcccaggctggagtgcagtggctctccatagctcactgcagccttgacctccccagattcaggtgaccttcccacctcagcctcccaagtagctgggactacagtagtatgccactacgcccagctaatttttttttgtattttttgtagagatgaggttccaccatgttacccgggctggtcttaaactcctgggctcaagcgatatgcctgccttggcctcccgaagtgctgggattacaggcgtgagccaccctgcccggcccgtgtatcatcttttttgttgttgttgttgcattcggtttgcaagtattttgttgaggattttttgcatctgtattcattaaagatattggtctgttgtttcctgttcttgcaatgtctttgtctggttttgatatcaaggtattaaccttatagaatgggttgttgggaaatgacccctcctcttacatgttttagaagtttgtgaaagatttaattctgttataaacttttggtagaattcaccagtgaatcaatcgtgccctgagcttttcttttctttatggggattttgacttttttttaaaaaaaattaataactcaatctataccttgctataggtatattcagatttcctttttttttttttttttcagttttgttggtttgttccttttttttttttttttttttttttgagacggagtcttgctctgtcgcccaggctggagtgcagtggcgtgatcttggctcactgcaagctgcgcctaccgggttcatgccattctcctgccttagcctcccgagtagctgggactacaggcgcctgccatcatgcctggctaattttttgtatttttagtagagacggggtttcaccatattagccaggatggtctcgatctcctgacctcatgatccacccactgcggcctcccaaagtgctgggattacaggcgtgagccaccgtgcccggccaaggtttgttcctttctagatatttcttcatttcatctaggttatatcatttgttgccatacaattgttcatggtattataatctttttatgttttcgtagggttggtattaatttgagtcttctttttttctaggtcagtctagctaaaagtttgttaatttttttgatattttcaaagaaattttggtcattgattttctctattatgtttattttctccattttatttattttcattataatctctatttattccttcgttctgctttctttggtttagcttgtgcttcttttttcagtttcttaggtggaagattaagttaccgatttgagttatttcaagttttctaatataggcatttcctatattaaatgcatttaatatagacatttaatataggatataaatttctctcaatgcacagcttttgtcgtattccttaagttttgatattttgcgttattgtatccatccatctaaagtattttatgaattcctattatggtgcctttgacccataagctatatagaagtggtattgtttgattaacctatatttgtgaatttcctaaatttctgcctattattgattttattacactgtggcccaaaagcataacttgtatgattttaatcactttaaatttattgagatttgttttcttgcctatcatatggtctattttggggagtgtttgatgtgtgcttgagaaaaatgtgtgtcttgctattgccagatggagcaatctatagatgcccattaggttccttagctagtattgttcaagtcttctacttccttgttgaacttttctgcctaattttttatctactatttaaagttaggtattgaattctccaaatattattattttttcattattcttcaatcttttttctttttttaaatttatttatttatttatttatttatttatttttattgatcattcttgggtgtttctcgcagagggggatttggcagggtcataggacaatagtggagggaaggtcagcagataaacaagtgaacaaaggtctctggttttcctaggcagagggccctgcggccttccgcagtgtttgtgtccctgggtacttgagattagggagtggtgatgactctcaacgagcatgctgccttcaagcatctgtttaacaaagcacatcttgccccgcccttaatccatttaaccctgagtggacacagcacatgtttcagagagcacagggttgggggaaaggtcacagatcaacaggataagaatttttcttagtacagagcaaaacgaaaagtctcccatgtctacccctttctacacagacacagcaaccatccaatttctcaatcctctccccacctttccccgctttctattccacaaaactgccattgtcatcatggcccgttctcaatgagttgttgggtacacctcccagacggggtggtggccgggcagaggggctactcacttcccagtaggggcggccgggcagaggtgcccctcacctcccggacggggcggctggccgggcgggaggctgaccccccccacctccctcccagacggggcggctggccgggcggggggctgacccccccacctccctcccagacggggcggctggccgggcggggggctgacccccccacctccttcccggacggggcagctggctgggcagaggggctcctcacttcccagtaggggcggccgggcagaggcgcccctcacctcccggatggggtggctggccgggcggggggctgaccccccacctccctcccggacggggtggctggccgggtggggggctgaccccccacctccctcacggatggggtggctggccgggcagaggggctcctcacttcccagtaggggcggccgggcagaggtgcccctcacctcccggacggggcggctggccgggcggggggctgaccccccccacttccctcccggacggggcggctggccgggcggggggctgacccccccccacctccttcccggacggggcggctggctgggcagaggggctcctcacttcccagtaggggcggccgggcagaggcgcccctcacctcccggatggggtggctggccaggcggggggctgaccccccccacctccctcccggacggggtggctggccgggcggggggctgaccccccacctccctcccggatggggtggctggccgggcagaggggctcctcacttcccagtaggggcggccgggcagaggcgcccctcacctcccagacggggtggctggccgggtggggggctgacccccccacctccctcccggacggggtggctgctgggcggagacccttctcacttcccagacggggtggctgccaggcggaggggctcctcacttctcagacggggtggctgctgggcggaggggctcctcacttctcaggcgggcggttgccaggcggagggtctcctcacttctcagacggggcggccgggcagagacgctcctcacctcccggatggggtcgcggccgggtagaggcgctcctcacatcccagatggggcggcggggcagaggcgctccccacatctcagacgatgggcggccgggcagagacgctcctcacatcccagacggggcggcggggcagaggcgctccccacatctcagacgatgggcgcccgggcagagacgctcctcacttcctagatgggatggcggccgggaagaggcgctcctcacttcctagatgggatggcggccgggcagagacgctcctcactttccagacggggtggcggccgggcagaggctgcaatctcggcactttgggaggccaaggcaggcggctgggaggtggaggttgtagccagccgagatcacgccactgcactccagcctgggcaccattgagcactgagtgaaccagactccgtctgcaaatcccggcacctcgggaggccgaggctggcggatcactcgcggttaggagctggagaccagcccggccaacacagcgaaaccccgtctccaccaaaaaaatacgaaaaccagtcagtcgtggcagcgcgcgcctgcaatcgcaggcactcggcaggctgaggcaggagaatcaggcagggaggtttcagtgagccgagatggcggcagtacagtccagctttggctcggcatcagggggagaccgtggaaagagagggagagggaggccgtggaaagagagggagagggagagggagagggcaatcttttttctttctgttcctccaaatattattgttgaagtgtctacttcaactttctattctgtcagttttccttcatgtattttgaagctctgttgttaagtgccaaatgcaattttataatttatacatttataattttataacaattttgtaattattataccctcaaataatggaccgtttgatccttataaaatgttcttcttcatctctaggaataattttgtcctaagtctatttgatctaatattaataaggccattctggctctcttttggttaatacttgcttgctgcatttcttcctattctattactttgatcatctttgtgtcttgaatttaaagtttgactgttgtagacagcatataggtagatcacattttttatctgttctaccactctctgccagttaactgaagtgtataatgaaactccatttgatttaattaccaatggggatttagtaaaatactaacatgattgaaatattctattttgctatttttctatatgtgggatgtcttttgcttttgatattcctccattaccatcttattttgtgttaggtatttcctattgtgctgatttaatccctatgccatttcttttgtcatatatatttttggaatttttttagtagttttagtagttgccctggagactacaattaacatcttaacttataacatttaagtatgattaattaatttcaatagcatataaacttttttctcctatacatgttccatgccccattctgtatgttggtattgtcatacaaaacacgtctttattcattgtgtgctcaagaacatagatttatatttgctttacatagttgtccttcagaacagatacaggaaaaatacattatttatacatgtttactacatacattttatttatttatttattgagacagagtctcactatgttgcccaggatggagtgcagtgttgcgatctcggttcactgcaacctctgcctcccaggctcaagccatccttccacctcagcctctcaacatggtaaaaccatgttgccaaggctggttacgaacccctgagctcaagcaatccacccaccttggcctcccaaagtgctgggattacaggcatgagccaccgtgtccaccccatacattttatttatttagacatactgtctcatttttacttacataactttacctgtgctctttatttcttcatgtggatttgaattactctcttgtcttcatttcagctggaaggactctgtttagtgttctgatggggctagtctgacagcaatgaattctctcaaatgttgtctatctgggaatgctttaatgtctccattttttgaaggacaccactgctagatataaaattcttggctgacatttatttttcctttcagaactttgaatatgtcatcccactgccttttggcctccatggattcttcctttcagctttattgtggtataactaacaaacagcattgtttatattttaaatatacagtttgttgatttgatacacatatgcattgtgaaatgattaccacaatcaagtccattaagacattcatcacattatggttacttttttgaaatgagaattcttaagatctgctctcttagcaaatttcaagtatacaatacagtataattaactacagtcaccatgctatacattagatgcttagaacttaaactgaaagtttgtagttgttaatcttaccaatgatcctttatacatgatgatttatttcttgcttatcgctctcatgatttttctttgcctttggcttttgattaatttattaagatgtgcgtttatgctacttggagtttattgaacttcttgcatattttgattagtgtttttcataaaattggagaagtttttggctattataacttcacatattcttgtatctcctttctctcactcatctccttctgggactctctttatgcatacattggtattgcttgatagggttccatagttctctgaggctctttccttttgtttttttttaacttactattcatcaggctagataatctcagttgaccaatctacaaattcactgaattttttgtctgctgaaatctgctgttcagccctgttgtgggttgaatcatgttctccaaaatgatatgttcaaggctctcttacttagtccctataaatgtggctttatttggaaatacggtatttgcagatgtaatcaattaagatgaggtcatcttgtattagggtgggccctaatccagttactgtttctcttataagagcagggaaatttgaacacaggcacagaggaaagaaggtcatgtgatgacacaggcagagattggagtggtgcagctgcaagccaaggaaagccaaggatttccagcaaccacctgaagctagaaagaagcaaagaaagataattccctagagccttcaaatagagcacagcccaactgacactttaactttggacttctatcctccagcaatgtaagcaaataactttatgctgttttaagccactgagatgatttgttttggcaaccctaggaaacaaatacaaacccctccaataaatttttagttgtagttttagttttcaattccagaaattctatttagttctcttttatgatttataactttattactattttctatttgatgaaacacaatcgtcatactatattttaattctttatatatagttttatttaattctttgaatacatttaaaacagctaatataatctttgtctagtaaatccaatgcctggacttcctcatggacttcctcatggatggtatctattagttgctttttttctctagtgtatcaatcagcctgtgttggagaggccctagagcactgcaggttcagtgattctctaggataaaccactggactcagtatatagtcatacacctggctgtgatttcttatggtgaaagcacacctagcaaaataaacaagaaaaaaggtgcatggggcaaaatccagaggaaactaggcacaagcttctaagaatcctgtccaaacaaatcacacaggcacagaaaatttctccaacgagttgcgacaacatgtatgaaacattgtccaccagggaggctcactagggactaagtgcccacagtttttaacgggaactggttatttggtgtcctcttcctagcccatacctaaattccagtatcccagatagaaaaatatctttggcaagaaccatagtgtttgtgaaagcattttaggcacagtgagctcctcttatcggagaatgggacccctgcgcattttctagatacccaggaatgtgtcagaacttttcacaagccatatggtcatctaacttcccagcttttcttttaagctttttagttagtctattgtttgccccaactgtaatccaccacttcaagcagccacaaagttaaacaattgcctctcattgtttttgatagttgtgccacagaaaaggcttttttttgccttggacaaatttcaagtcaggtcaaatacagtctaacaaggtggagtcttatacagacttcaaatatgacttcaaatagtgataattctctgggaatgaggctttgagggagctccagtcctattctgctccctgcagtggctggcaggttgctggtcacggcaaatgtgggccttaattttctgggttaccatggaactacagagtaggaaataggactagagaaaattaaactgccacaaaactcactgctcttattgagattctgcttggtttttaatcaacaccctctggattactgcaagcttttggctaatttctagaggtctaaaaatattagtggtgataatttttgccagttttctcattgatttttttggaggagagaattcttggaggtctttcatttgctgttttctctaaagttatctactgaatcacatttttaaaaagatcctaggaccataatgtatgactagttatccttggaagtttgtaatcatcacaattcagtgtaaattgtacctcaaaactcctcttgtctgggcgtggtggctcacacctgtaatcccagcactttgggaggccgaggcaggtggatcacctgaggtcaggagttcaaaaccagcctgaccaaaatggagaaatcccgtttctgctaaaaatgcaaaattagccaggtgtggtagtgcatacccataattccagctactctggaggctgaggcaggagaatcgcttgaacccaggaggtggaggatgcggtgagccaagattgctccattgcactccagcctgggcaacaagagcaaaattccatctcaaaaaaacaaaaaacaaaaaaaactcctcttgcagtggtgttcacatgattgagtcaaatatatgaaattaaacctaaaaatagaagaagttctcaatttagggataatttccctaaaatattatattgaataacatgatctggttagtctggttcctctaggcaacatcccacattcagttgaggttgttagggggccttttgcttagttgtgttctccctcttttttttttttttttttttagatggagtctcgctctgttgcccaggctggagtgcagtggcgcgatctcagctcactgcaagctccacctcccaggttcatgctattctcctgcctcagcctcccaagtagctgggactacaggtgcgtgccaccacgccaggctaattttttgtatttgtagtagagacggggtttcaccatgttagccaggatggtcccgatctcctgatgtcatgatccgcccacctcggcctcccaaagtgctggaattacaggcgtgagccaccacacccggccttttctttttctttttgagacaggatcacgttctgttgcccatgctggagtgcagtggtgcactcatggctcactgcagcctcaaactcctaggctcaagtaatcctaccccctcagcctcctgagtagctgggactacaggtgtgcactaccaggcccagctactctttgtattttttgtagagatgaggtttcaccctattgcccaagctggtctcgaaaccctgggctcaagcaatccacctgccttggcctcccaaagtgctgggattacaagtgtgagccaccactcctggcacttgcctagtacatcccagctacatgagaggctgaggtgggaggatcacctgagcctgggaggtcaaggctgcagtgagccgtgatcacacaaccgcactcaagcctgggtgacagagcaagaccctgtctcaaaaaaagaaaaatatatgtattcccccaaactgttcaccccctcaggagatgcactggtgaaaacatagtgacttttttcccctaaagactcagtgaatagccagccgtttacatacacaatgatagataaattcgtctatgaattcacaaagattgggagataactaaatgcatagtaatatatagagataagtggaaaaattaactttgataattatattgttagagaaatatgatttttatttaattaaaatattaaatactattttttatttttaataaaaaatatattttaaaaagtaaaaaaaatacgatttttatttaatatcaactaatgctatcttttatctaattccaaacagtttgtttataggttctagaaatattagatctctcaggaatggtagaaatatgactttttagggaaatatgacttttagaaatataacttttagagaaatatgatttttataactgaatatctatttatgctgtcttttatctaattctgaacagtttgcttattgcttctagaaatattagatcacttaggaatgatagaaatatctggtgatggaatttcaagaatggaacctctggccgggcgtggtggagacagagtctcactctgcaccgtgccggccagattttggtatttcttatgggaaacctgagttcctgcattagaggtatgttcacactggcctgttgaatgctgtcctcttaaatgtatttaaaaattatcctctgtatttttcgtatgcggttataaatgtgttttggggatctattttattccttaatttatatatttgattctagcgtcaagcaggttccctttgaatttttcctttaaagaacatgtgctatttcctattacatcctgtacccctcaaactgcccaattaggtatactcctggggaaaatatggcaaagtttgttgtaatgcagtttttttacctaattaagtagctactaaaataattaatttcaaaaatttggagcaaacctagaaagatgcagatgtctttgtggcttttcacgcaatcaagtttacctatctttgcttttaatatgtatttcctcttgatgaaatgtttatttagtttagtaaacttgggatatgtcatttatatccataaatcaactttttaaaaaagagataataagaatgtgtattgtctatgtgttcgtgtgtaaaacaagatccacttttattttttattatttattttatgatttgagtttattttataaatgagtttatgcagaatcatagaggtatcaactacagtcaatcacccaacctacttacctttccaaaggtaaatatactcaagtacaatcatttttttctcatccaaagagtagcccatattgaataaagatagggacatgaaatgaatcggtagacactattaaccaagaatatacagatttattcacaccaagaaacaagtaagtcatatggatatatatataaagataaatttaaaaataataaggtgataattgtacaagtttgcatatagagctgcagctctgaaaaactgtttatattgttttgatatattgtgtgacttgttcccctaacccatcacccggagttgatgctaagatactgttggttccatgactcggaagcaatctaaggttagaggcacttacatttgctaggaataaataaggcaagatgatatttttcaccacttttagcacagcagacttgtcagtagataagcggctccacccaggacactggtattcatctcattcgcacagctcatctgttgaccatgactcaagcaactggaccactctggaggaccatagtgccctttaaaaaatttttttttgtatttttagtagtgacagggtttccccatattaaccaggctggtctcgaactcttgacctcaggtgatccacctgccttggcatcccaaagtgctgggattacaggcataagccaccgtgccaggcctcctaatgtgcccttttatgtggagtggccattgagtgtgcactcagccagacacagacagcatttttgaaagctttatctgagtatttcaaaattgagtatgaatttggataaagtggttggttgtagaccaagcaggaagatgtcatagaaagaacaatggcttgggagttcggaatcccgggcttgcatgaatctttgagcttgttaagtcgtgcaatctaaagcaaggcatttcactgataattaagcttcatgagcatttgcactgataacattatacacattgaacaattcagaagtcaccacatacgtatggcgtggcttactctcacctttcaccggttggagaaaaagagacagagatgaatgtgatcaagtttatgagctcctaagtaaaagagccaagatgggaacccaagcatgtggctccagcgccgaggctctgagcaacggatgcaccatcatcactcagctgtgggaccaccagtcactgtgcaaaagagttccatcatctgtatgtattgacacgtctggaattatctgagcctatagagttcctacacactatccacaatatatgctggtgtcagtgggcacatagcccagcacaggtattagtgcataaataccacaggtttatcatagtcattatgtgaaacccacttagaaagcccaaatgctttcggacagctcgtagattttgagagctcggggacaccacttgggacagccagtaaaattctttcagtgcttggccgctcctcagcacctgtcccaaactgataaataacgagaagactcttttttccaaacggagtttggctcttgttgcccaggctggagtgcaatggcaccacttcggctcactgcaacctccatctcccgggttcaagccattctcctgcctcagcctcctaagtagctcagattacaggtgcatgccaccacgcccagctaattttttgtatatttagtagagaaggggtttcactgtgtcggccaggctggtctcaaactcctgacctcaggtgatccacctacctcggcctcccaaagtgctgggattataggcgtcagccaccgcgcccaaccagtacctattttctttgaaacataacaactctctcatcttcatcctaaaatgttcaaagcatattaaagggcaaaaaccacagtatgaagagacagagcatgcatcagagccagactgcaatatacagagatttgatgattatcagactgataactatgattaatatgctaaaggctctaatggaaaaagtggatgagattcaagaaccaatgggatgtaagtagagaagtgaaaactctaagaatcaaaagggaatgctagaaataaaaaatgccgtaacagaaacggagaaggcctttgatggacccgtcagtggactgcacgtggttgatgaagaaatccgtgaacctgagaaaatgtcaatagaacttcccaaactgaaaagcaagagaaaaaaagactgaggaaaacagaaaaaaatatcaaaaaatggcgggacaattacaaaaggtataacatcttcgtaaagggaattctaaaaggagaaaaatgaaagaagcagaagaaatattttaactaataatggctgataactcaccaaaattattgacagacaccaagccatagatccaggaatctcagaacaccaaacaggataaatacaaagaagtcaatatctcatcatatcatattcaaattttgtaaaatcaaagataaaaactttgaaagaagccgggcacagtggctcaggcctgtaatctcagcgctttgggaggccaaggtgggctgatcacttgaagtcaggagttcgagaccagcctggccaacatggtgaaacagtctctactaaaaatacaaaaattagctgggcgaggtgatgggtgcctgtagtcccagctactcaggaggctgaagcaggagaattgcttaaacccaggagacagagcttgcagtgagccaagatcacgccactgcactccagcctgggcaacagagcaagactccatctcgaaaaaaaaaagaaaaagaaaaaaaaaaaactttgaaagaagccaaaggaaaatatacatactactcatagaggcactagtataagaattacactgggcagggtgcagtggttcacacttataatcccagcactttggaggccaaggcagtaggactgcttgagctcaggagtttgagaccagcctgggcaacatagagaaaccccatctctacaaaaaatatgaaatattagcaaggcttgccagtgtttgcctgtggttccagctactcgggaggctgaggcagaaggctcacttgagcctgggaggttgaggctacagtaagtcaagattaaggcactgtgctccagcttgggcaccagagtgaaaccctgtctcaggggaaaaaaaaaaaaaaagaattacgttgaacttcttgtcaggaaccacataagaaggaagagagtggagtaaaatacctagtgttgaaagaaaaagcccccacacctagaattctgtacctatcaaaattatccttcaaaagtgaaagagaaataaagaactttcaggtaagcaaaaaatggtggggcattttggaagaatatagatttccatttcataaatgcagaaagaatgagggaaatggagaattgcattgaggcaaaattcatcagtaatttatagccagtagatctatcttgtaagaaatgttatttaaaaaaaaaaaccaaaaaaaaaaaaacttgttcagagacaaggaaaataggtcagaaacaacatcacttttgagctgaaatttttattcactattttatgtcatttttctttaaagggatctagaaaattttagaagctccacaaaccctggataggcttttgcagccagccatgagcttatcccgcccctctcactccaccttatccacccacatttccaaaaacccagtcttattttgtgacccagagtcacaagctccccaaacgtgctcaatacgtatgctcccaacaaatggcaaaatcttatttttaccattaacgaaaagaagaagaaaatcattctggcgttttgttgatgatggttgagatgagggcaacttcgaacttagaaccctgagtggaaccgctttttgttcttcctgggaatacctgttggaaacaagaattaaagaatgtggttacagccggacgcggtggctcacacctgcaatcccagtactttgggagtccgaggcaggcggatcacctgaggtcaggagttcaagaccagcctggtcaacatggcgaaaccctgtctctacaaaaaatacaaaaattagccaggggcggtggcttgtgcctgtaatcccagctgctcaggagtctggggcaggagaatcatttgaacccaggaggcagaggttgcagtgagctaagatcccaccaccgcactccagcctgggcaacgagagcgagactctgtctcaaaaaaaaaaaaaaaaaaaaaaattaaaaaaaaaaagaatgtggttattagaggcaattcaggattatccaggcttcccttgaagaaacatatgcaaggctctaaaatgggagccagatggaagaaaaagttgcaggcttactggggaggtgggaaacacccggatcccagtcccacatgtgacttgagagctgagaggctgatgactagatgccctgctgccccagggctcccttctgactgatatgaaggctggagattttccctacactatcccttagcacccagcatgatgcacaaaaaacaggaattcaataaaaaggtttgagatgtgactcttgtttaggatgtcttttggtcctcaagaatcttccacaggagaagccaagcatggtggcatgcactgtaatcccagctattcaggaggctgaatgaagcaggaagatcctttgagcccaggaatttgactccagcctgggcaacatagcgagacgcccctccatctctaataaaaattttgaaaaataaaaaaaagcatcttccacagcagagattctttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttaaccaggatggtctcgatctcctgacctcatgatccacccgcctcggcctcccaaagtgctgggattacaggcgtgagccaccgcgcccggcccagagattctttttttatttttttgagacagagtctgacgcccaggctgaagtgcagtggcacgatcttggctcaccgcaacctctgcctccccagttcaagcgattctcctgcctcagcctcccgagcagcttggattacaggcgcccaccaccacgcctgactaattcttttgtatttttagtagagatggggtttcaccatattggccaggctggtctcaaactcctgacctcaagtgatccacccgcctcaacctcccaaagtgctgggattacagacatgagccatcgtgtccggccccatagcagagattcttaacttggggtccaggaagcccctgaaattgcatgcaaaatattagcattaacatgttttttagagggagggccccttgcattcatcattttctctggtgctcacaagacttcaaaatgttaagaaacactggggtaaatgaagaagcaagcacctccaggaaggaggtcccgcaccaccatgcacagagtgtctgcaatgcagaaccagagaggacctttgggatggtccactgtggttgagccaccatactcaaagatggggacccttgatagatgccttgacgaagcaagcagaaggtcaccaggaagttctctgtcctccaccatctatccgttttatggactaaaaaatagtcacaagattgaagtgcttttgcttcctaggaaacatggtgtcattcattcatttattcagccaacattaactgaggccccattgtgtgccaagaaatgtgctagaccctgggaccacgtgcttctcacgctgaagattcccagtagagaagacacataacaaactgcccgtagaatggggctgccttattcatttatgtattctccaagcctcgcccagtgcccagcacgtagtaggagctcaataaataataagtgccttgggcagtaagataatgtcgtgggtaaacctctggcatttagaatcagagaacctgggtttgaatcacagcttgtccacttctttggtgtgtgactctgggcaggccacatcatcttgctgagactcgatttcttcataatgtaacatggtgtgaacctgcatcacagagtcttgtggggattatgggaactaaactgtgaaaagaggctgggtgtggaggctcgcgactctaatcccagcactttgggaggtcaaggcaggcggatcactggagcccaggagtttgagaccagcctgggcagcatagcaaaaccccatctctacaaaaaaaaaaagtacaaaaattagccaggctcagtgatgcatacttgtagtctcagctactcaggaggctgaggtgggagaatcacttgagcctgggaggtgaggttgcagtgagcccagatcatgccacgcactccagcctgggtgacagagccagatcccatctcaaaaaaaataaagaataaaataaactgtgtagagagcctggtatacacgaagtgcttgataagtatagctattggagttaatatcaataccataatgtcaaagagccctggtaaacactctgggctcctgtctgccttctgaaaaacaaggattaagcagatcccctctgtctcttctgtactaggatcctaggaactacaaatggtgattgttttaggtgggtgtggagcatcatcttgtggaagagaggaaaattgacaaaaatgtcgcagtttcctattaagaatatatattggaattcacagtttttaaaatatgagtacatataccaaaaatgccctaatgcaaggtgatccccaaatccaatcaatttttccaatggactaataacaaatatttgccagggagaaaataaaaatgtgtttgagaatcacatggatcaatggggaaaaacataaaaataaatgaaaaataaaaatatgttggcatagccctaattacataagcttaagggaaatcaaatatgcacttccaatatttcgttaatttatttagatacagctatacatttgtatatgttatggggtaatatacaaatattactcttttccactttcagttttcaaaaagattttgtaactcaagctcttcacaggcatctcccacttagtggttttccctctccaaggcaatttttgaatcttctaagcctgtgtttcagggctcagtattttttactctgttaagcagagtgagagacaggctgtcatgaatctggacatttttatttttaattttttttagacagggtctcattctgttgcccaggctggagtgcagtggtttgatcacagctcactgcagcctcgacttcccaggctcaggtgatctccacttcagcctccctagtagctacaggcacatgccacatgcccggctaatttttttgtatattttgtagagatggagttttactatgctgcccaggctgggaatctgggacattcttaacaaactcagtgacatatttatgcgttggtagggcattttttaaatgcatcctataaggggcaacttattggcttccaaagtttcaatgtgggattaactttccttcctttttttttattttttttatttttttttttttttttttagaaaatcttgggctgggaacaggtggccccctttggggtaattggaaacccccgcccctggggagaaaagagtttttccgggcccaagccccccaaaaaagggggggattaaaagggggtctcaaaaaaccggggggaaaaattttttggtttttttttaaaaaaaagggggttttctcaattttttaaaacggggggggtaaaaaaaaaccggggctaaaaaggaattccccccgcggggggcgcccaaaaaagggggtttataaagggggggaaacaccccccccgggggggccattttgggtgtttttaaaaaaaaagggttttttcaaacaaagaatggtgttttttttcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacttagtaggcttttggtcatcaccatcttcccaggagaagccagtttggtggcatgcactgtaatcccagctattcaggaggctgaatgaagcaggaagatcctttgagcccaggaatttgactccagcctgggcaacatagcgagacgcccctccatctctaataaaaattttgaaaaataaaaaaaagcatcttttttttagagattctttttttttttttttttttttgagacggagtctcgctctgtcgcccaggccggactgcggactgcagtggcgcaatctcggctcactgcaggctcgacttcccaggctcaggcgatcctcccacttcagcctccctagtagctacaggcacatgccaccatgcccgggtaagttttttgtatattttgtagagatggagctttactatgctgcccaggctggaaatctggacattcttaacaaacctgagtgacatatttatgcgttgttagggcatttttaaaatgcatcctataggtgcatacttatggcctccacagtatcaatgttgggatttactttctttccttttttttttttttttttttttttttttttttttttgagacagtctggctggagtgcagtgatgccatctcggctcactgcaacctccgcctctggggtcaagtgattttcctgcctcagcctcccaagtagctgggattacaggcgcctgccaccacgcctggctaatttttttgtatttttagtagagacgaggtttcatcatgttagccaggctggtctcaaactcctggcctcaagcgatcctcccgcctcggcctcccaaagtgctggattacaggcgagagccaccgcgcctggtcgctagttgagatctttaaaagccaatgtgtctaccacaaactgtcagtttgctcttcaaaatgaagttcttgagagaacagcgccccctaaagacaattttttaaaagattacctccttcctgtggattattggtgaggggataggggagacctaaatatacgcaacaaaacaagtagtaaaggggtgagtatgtctttgcttttagaaaataaagagtcaatcccaggccccaggactcccggggctcagcccaagcccccatcccctcaccccaaggagccagcaccttctgattccggggcagacactactgagttcccgtagggagacaaggtctgctcctgcagcaggaaataggggatggagaggtgggggcagcccagctccaggacaccctgggaaactcccagcctgagaaccttcctctcaaggaagcccaaggggcacttggctccatctccagccttttttcctggcaacctcaaatggaaagagaaaattcctctttcaaagctcagcaaattttctgtttccaattaaaacaaaacaaaacaaaacaaaaaaacccaaacaaacaaaacaaagttcagtttcagtttccattctcagccggcaggagagatggctgctgaactaaggcagcccagcagagggaggctcagctgatgcctggagggccccctagccctctctgcaccctaaaaagaggaaagtaagcttagtgattcttccgtcggtggctcacgcctgtaatcccagcactttgggagcccaaggcgggcagatcacctgaggtcaggagtttgagaccagcctggccaacatggtgaaaccccgtttctactaaaaataccaaaaataccaaaaattagccgggcgtggtgtcaggtgcctgtaatcccagctacacaggaggctgaggtgggagaatcccttgaacccgggaggcagaggttgcggtgagctgagatcacgccatgggtgacagagcaagactctgtatcaaaaaaaaaaaaaaaaagaaagaaaaagggcagctaactctctctctaacccacaccatctccctgcccttctgcagttctgtggcctactggacaaaggctgggagttgccccttacagggctgggcagaagcagagacgattcattcctggtcccacagagatggcaggcttccaggacctgtatgacacccctggggacaggctggatgtcttcataaaacatccttccagtctgccttcgtaaaacagcctccagccccagggagactggaaggatgaagtgaaggatgccgggcattgaactgagcagttcttgagggatcagttcttctataatgagctgattctggaccaggaagtcagggtgctgaagatggcaaaggtgagcactcaggaacccccggggttcaaatcccagctctgccctgtgggactgtggggctgtgggataggtaagggatgagttattttgtctctctgagcatcggtctcttcctctctaaaaccggtttctaatgaacaataaatgggataaagcatagaaaagtgctcttaagcagtaaactattctacaaatctggatgatgatgatgatgatgatgatgatgatgatgatgatttgggatccagctctctaagtgccagggaatcaagtggactatgggtagcaggtttgtataaaatttatgccttttggccaggcacagtggctcacacctgtaatcccagcactttgggacgctgagtggggaggatcacttgaacccaggagttcaaggccagcctgggcaacattgcaagacctcatctcaattatttaaaattttaaacttttttatatattatttaaaaaaaatttttaaagaaattaaaataaaatttatgccttttgtttcctctttaaccagccccacttaacccctaaagtcatcaagatcatctatattttccttctaaaatggcactgactggccgggcgcggtggctcacgcctgtaatctcggtactttgggaggccaaggcaggcggaacacgaggtcaggagatcgagaccatcctggctaacatggtgaaaccccgtctctactataaaaatacaaaaaaaaacttagtcaggtgtggtggcaggcgcctgtaatcccagctactcgggaggctgaggcaggagaatggtgtgaacccgggaggcagagcttgcagtgagctgagatcacgccactccagcctgggtgacagagtgagactcgatctcaaaaaaaaaaaaaaaaagtaaaaaaataaaatggcgctgactgattttgttagaaactacctagcaattaggtaatatcagagggtactctctgggttcagagggtttgttagaggctgaccatggaatcaaatacgtatttatagcatggtttcccctgggaaagtactaaactatagttcaacttttaacatatcaccctaaatcaaaaatgccttaaccataaatctagatttggtttattttgctagaatgaaagacatctaacattatcttaagcaaatcagacttcacctgggagtggcaatggctgccgagaatacgactgaaaaggaaggaaatgcagctttaatgaatcttcaggccaggcacagtggttctcgcctgtaatcccggcactttgagaagccaatgtaggcagattgcttgagcccaggagctcaagaccagcctgggcaacatcacgaaaacttgtctctacaaaaagcacaaaaaaattagccaggtatggtagcatccacctgtggtcccagctactcgggaggctgaggtgggaggatcacttgaggccaggaggtcgaggctgcagtgagctgtggtcatgccgctgcactgtagcctgggtgacagtgtctcaaaaaaagaatctttaaatacggagtcgaaggcaaataatcaggagtgttactagcaaaccctgagcttcaaaacagaaattcgagcttccatggttgcttaaaaagatacaactttgcccttctggcttctggctcgtccacacatctgcatgtgccctaaggtccctctgctgcagagctctggcagcatctttgctttccagatccaaaacaaaaacacaaagaaaaggggaatcccgatcagaaccagaaatagaatgcgtattctcttaagaatgggttcgagggtgttcaagtactttaacatatgttataataaagttcttctactgattgaaaggcactgtcttgatgggaggcgcaccattcatatgatctcaaacactcacaacgtgaagttcctattcccgcctctacggggatgtgtttcaaatggagactatttgtctgtataagaaaaaaatgcattttacctttcctcttgctctctcaaccatctctatttccagaggtggaaacgcccctagaatacctatttccaccagttttgaccagcacagaaaatgcctacaacaaagttatctatagagctagagatcctgtctgaataaacatcggtaaacaagcaacaagaaggactttgtttctgtattgggaagaagggagtacattgcatataattcaacatttgcttgagcttttcaagcactaagttttcttcctttctggttttttttttcttttttcttttttttttttttgagacagtattgctctgttgcccaggctggagttcagtggtggcacaatttcggcttactgcaacttccacctcccaggttcaagcaattctcgtgcctcagcctcagcctcccaagtagctgggattacaagcacgcaacaccacgcctagctaattttttttttctttttttgtgtttgtagagatggggtttcaccatgttgcccaggctgatcttgaactcctgagctcaggcaatccactcgcctcggcctcccaaagggctgggattacaggtgtgagccaccatactcggcctttaagttttcttttctttcttttttttttttcttgagagagagtctcactctgtcacccaggctggagcgcactggcatgatctcggctcactgcaacctccttctcccatgttcaagcagttctcctacctcagcctcccgagtagctgggattacaggcatgcaccaccacacctgggtaattttttatatttttagtagagacgggctttcaccatgttggccaggctggtctcaaactcctgacctcaggtgatcctcctgcctcggcctcccaaagtgctgggattacaggcgtgagccaccacacccagccctaagttttcttagttgcattttagtcttctagctttcattcatccttattaagacaagagtgctgtatttttctagagtcgaatatactggttccatttgatttcctgccatgaatatcttggagagtcttctgggaccagggacaacatttgcaaggacatctcttgcagtacttagtcactaactccacctgacaccaatattcttccttttctactattctgtgtcctctggtcaaggaatccaatgtctaaattaaggttacagaggaatctgaagtcaaaattgcttcataatgtttttaattacaaaaatcatacattgagtcacaaaaatataggaaaataccaaaaaaaaccctcaaatgaatgcccttactattcatagataagcaccatttatattttagtgcactatgatcacattttcaatgtttataaagaactagaaaatattttatttcatgtgtaactataaatatacttatttcaaaagtgattataaacttccggtgccagccaagatgtagtaaacatctcacaaattacaactaaaactctggacagacattagaaagcaagtacttgaggactccaaaaactaaatagcaggcaggcagattagggactggagtcaaatcttgaataatctgtaacaagagtgatggctggtgaagaactacttgcagtggaactcgaatccct

SEQ ID NO: 717 - DNA, 66611 bp, Homo sapiens
  misc_feature (1)...(66611): n = A,T,C or G
agcatgcgctactgtatctcgccctgtggtggnattcgatccgcggttggttgaatctatggttgcaggacctacagataaagagagccggctgtggtacaaatatgaaggaatacccattagttttttttttttttcattttcttggtaccaataaaatatcaatccagagatattgtaatttgacccaataaagatttaaggaaattaaccctgcgatttattatgcccatcaaaactagtaaagttaggaaagcagaactgatctacaacagatggtatagctaccttttcaaagaatgaggagttaagaaatgttaaatgacttgttcagaaagaacagcgaaatcatgccagggctggaatccaagcccggcttcccagcttaggcacaaaccatttgcagtgctggtgattacagatgactttggtgctcattaagagcgggcttctcagttgcaacaaaagcaaaaattgacaaatgggatctaattaaactaaagaatttctgcacagcaagagaaactatcatcagagtgaacagacaacctgcagaatgggagaaaatttttgcaatctacccatcttacaaaagtctaatatccagaatctacaaggaacttaagcaaatttacaagaaaaaaaaacattaaaaagtgggcaaagggcaagaacagacacttctcaaaagaagatatttatgtgtccaggaaactacctgaaaaagctcacatccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactgcgntactgntatcatcgccactgtggtggatttcttgtgtcggccaagagttctcaatctcctgacttgtgatccgcctgcctcgggctcccaaatgctgggattacaggtgtgagccaccacgcctggcctgaatccagcttgtaactcattgccatgttctccaatttatattcccagattcttctcttccctttttatagtgcccagcaaaataattttcccaccttgggtgtgtgcattacccagataacataatagctatctgcctgtgggatctaaagtgtgacatgaagggctaaaataatgaacacattagaagaagccaattcatttcttaggcttatggcaacacagatgtattgtttatcactaaatctgtctttgccaactcattgcaatgtggctgtatgaaaactcaacggggcagaagaaactcatcctagcactcgataccccacaatgtgctgctgtcttcagaatgtttcctgtgaactagatatgtactttcaacttgtttttaaaatagccaaggatataaatgcctaataatcagtgaaatcgctgaactaattattgttcacatgcatgtcatttttcccttcctactttacaatcataatgacataatagtagaacctatcataattntccttaccacttacatcttaatctcatattgtcattccatcttttgcacgtcccatgtcccctncaccgcactctggccaatttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgcggtatgaaatctccgccttgtggtggnattcacgcgatgacggtgaccgggtcatcacaacattcaatattcaccagggggcgtggggggggacatgatgacggtgaccgggtcatcacaacattcaatattcaccaggtaactgacggacacacgtgatgacggtgaccgggtcatcacaacattcaatattcaccaggtaactgacagacacacgtgatgacggtgaccgggtggtgggggattcaatattcaccangtaactgacggacacgtgatgacggtgaccgggtcatcacaacattcaatattcaccaggtaactgacagacacacgtgatgacggtgaccgggtcatcacaacattcaatattcaccangtaactgacggacacacatgatgacggtgaccgggtcatcacaacattcaatattcaccangtaactgacggacacacgtgatgacggtgaccgggttatcacaacattctatattcaccatgtaactgacggacacacgtggtgagtgtgaccgggttatcacaacattctatattcaccatgtaactgacagacacactgggtgagggcgaccgggtctcacaacattatatattcaccatgtgactgacggacacttgatgagggggagcggggcctcacaacattatatattcaccaccgccactgattgacaccacttgatgacgcgcgcgttcgcaattacaacattttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttgcgntatgatatctccgctcctgtgngtgggaattcaccctgtgancatttatgtaccagtttttgtgtggccacaggcctccaattttttggggtatgtacctggaagtgaaattgtggagtcatatgataactctatgtttattttaatttgttttaacttttaatttaggttcaggagtacatgtgcatgtacatgtttgttatataggtaaactcacgtcatggggtttgttttacagaggatttcatcacccaggtactaagcctagtacccaacggttctttttactgctcctctccctcctccaaacccccaccctcaagtaggccccagcacctgttgtgcccctctttgtgtccacgtgttctcaccatttagttctcacttataagtgagaacatatggcatttgctaaggataatgacctccagccccatccatgtccctgcaaaggaaatgatcttattcttttttcggatgcatagtatttcatggtgtatatgtaccatattttctttattcagtttgccattggtggacatctaggttgatatcatgtctttgctattgtgagtagtgctgcaatgagcattcacgtgcatctgtctttatggtagaatgatttatattcctttgggtgtatacctantaatgggattgctgggtgggatggtagtaactctatgtntaaatttttgaagaactgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgcgagtatgaatcctcccctctgtggtgngattcgacanattgggttagtaatcccagccgctgctgacggggcccaccaggccacagcagggcaccagaggctggctacgagtcagagatgggggctaccaaccccgccatgcggtggggctcccaccctccaccctggacacagccattatgcacaagacgcaggaaccaaaggagggtacgggcgtcccccgcatcttacatatattgggggtcaacttattttcttatttttagaatcaactttgttctaagaagctctccctttgcctcctgcggtgaccttccatgtcttgctctagaggccactggcaaagcaaccgggcctagtgctaggaggggagggccagggccgctgggagatgcgcatataaactgcaggggctaacacgggccagagtcgtccagggccgctcagctgcagaggcctgagaatcctgacagcgggaggatgttgagtgtcactcctgagctccgagggtgagctcgcttagcccagtggttctcgactgcagggtgaacccgaatggactggaaccaacgtggttggcaacacacacggctggctcagccccagggttttggattcancaggtcagggctgggaggcaaggagttgcatgtccaacaggtctcggtgctgctggagctccaagccacacttggacttggagagccgctttgtcagtgcgtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttgcgntatgattcctcttcctgtggtgngattcgcccacacaggccaaccctgacctgtcattcagccccagcgtctaccagcatggcagcatccaagagtcgcataaccgctgtgtgctaaacacatgccaggagcaacaaacaagtggcgagcagtgagaccagacttcagggctgggaagacagctgtggagggagtcaggcaagagagggctcatgaaggcaatggacacgggtgccaagccacctggattcccgcctggatgaggcagccgcctccccacgggcctccccactacggttcttgtccccacccctgctctccccaacactgcagccttccaaattctctcttccagagtcagagccacgatcgcctccaaggccacaaagcctgccaggtttccgttccccttctgatggctgcaccctctgccctggctccctccgccccagactgaacgcttcctcgcagtttctgaacaggccagatgctccagcctggacatctctaccgctgctgtttcccctgcctggacctcaccctcttccctctgggaaaaatgcggctgccctgagtcccccagcccctgctcagatgttacctcctcagtgaggccctcctcgagggtgccatccgaaatcacagcaccccttccctggatctccatccttctctttctccactgcatgcagagatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattttgcgntactgatttcctccgcttctgtggtgngaattcgacananaatgtcgtccgggggagccttcgattctgacctaggtgatgggtgccctggagaacgcaaggataagaacaacgttgaatggaaaacctggcttagaaactcttgagcttgaggggtgtgaacaggacctctgagcctctccaaacagaacggaacttaggccaaagcagtattcacaccgcgagcagctcccgtgggggtttggacgcagtagcacgcagtggtagaggcatcagacatggggaagggagtgacatggtacatgtgcgttctgacgtggattttactagggctgtgtgtgttcagcccaaaagaacaagagcaataaccagtgcaggcagttccacccacattctactcagccagagcaggggctggcctggaggcctggctctacaggagcctctgcaggctggggtacacacgcctcttgtggtgtgagcatgacaccagcggagatgtgtgcataacattgtgtgtgttcacagaacacactccccaaatataagccaactactccatctggtgctcagccagaggaagaatcttttctaaggctggcagagaaatctggctgttggacctaatgaggggggacttgactggttataacttttgagtgtcttcgtatttagatgttattaaaaaccctcgataggaagaaatcgccaggggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatgtgcggtactgatatccatccgctcactgtggtggnaattcagtagggaatgattattaaagatgatttgcttcactataaattcagttggtttagaggtgagaccaagtaatattctaattatttaggtccaatagttttttgagacatatttctttgtatctttttttttttttaaccccacaatgaagccttaagtctaccacactggcccggttaaggtagcttaagttggtatctttatcgggggggtcagttgctcacttacgtgaaggctacattgcctgattaaggtgtgaaatgaacactcttcttctgtttccaagcagatgagcaaagaaataaaaatatatatataaaaatataatatagaaaaacttgcagtgatgaaataaaataaaaatgagatactaaacatgaatgtagtctaatagttcaatatgcttgagaagcccttggatccttgtgaagagactaaagtcctaacagagggcaaataacctccattgcccaccaaatctgaagaggagccatccccttttcactcttgatcaaactgaaatgtgcttctataatgtaggatgggacatttctttgtgagtaaaggcagattgattgattaaaattgaaagggtctttttttgtaaaatgagtaagatttagaattaagaatttttaggtacaactcccatggcttcagggcagagaaaaanaattcaggggtgtatttacgcttttccgcccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctgggtctaaaacctcgtctggtggtggaattaccccaccctgtcccctgagctggtgcctcatttcccagggctccctgacacactgcctactcaccttcaagcagctgcgatgaaacatatctaaaattaaactcactgtggcgccctcacacacacctggctctggtccggatgtcattctccatgtcaatgacttccttccacctgcccttcctacccttccataaccggttgggcgtgtcccatctctttgagctctcagagctgggtcttcctctgcctgaactatggcagcaacccctacactactcccagtggcaatttcttcaccctccagcttttcttttgttttggaaacatgcatcagactctccagtgatttccaaaggcatcatcttatttaatcctcaaaataacctttcaaggcaagaggacgacttgagcccaggagtttgagataagcttgggcaacataatgagaccctgtctctacaaaaataaaaatttaaaaattagccaggcagtggtggggcacacctgtagtcccagctacttgggaggctgaggtgggaggattgcttgagcctgggaggtgggaggttgcantgagctgagatcacaccactgcactccagcctgggcaacagaaaaagatgctatccccaaaaaaacaaacaaacaaaaaaccttttaaggttggtactcatatctntccattttacagccaagatgagggaacaacttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcattgcggtatgaaatccatcgctctgtggtgngattctgcggnttaaaggcaaacatttcaaaaattattctgtagcttaagaaagctacttcagcggttactgtttccttttccatgtaaccagattcactgtacattacaaccttaaagctaagatctaaggtttagatcaactctttaatcctggctgtggctttgggtacttcctgctcttcatgagaagggctctaggcctgcagctgggggtgaacaacatcaggaaaaaagaaaagaaagttaaaaaagaacttagctgactgggaacaaggttctatagcattgcaaaggttaagctatggcatctgaaaatctgacacttgaagaatgcatagcttaatgacacaactcaacctctgtgccctttagagagcttcatgtcaaataaaataacttagaagagaagtggcaggtaatatccttcttgtcaactatttaacttaaaaaaaaaagtttgcatgccaggaacacctaactctgtttttctcaattgaatccacttttgtcttaatttgatatactgctttgtggatttgcctagctttgtgaattccttggttttcatctatatcaccttagtttgactctactacagacattaaaatgatacaggcgatggagggaagcccagcaaatgggtgctgacgctcacactgtacttcgtgatgccaggcagaatcttcatgagcgtggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgcggtactgatatccatcgctctgtggtggattcactgcagtgttagccgtcgggaccagcttctgtctggaagttcgtcgggttgcggtggagtccaagtatgccacatagcagataagggaatgtacaagacactcggtgtcgtgatggacagtgatggctgtgatgatgtcgtacgctcagctgatccttctccctgctgagaagagttcagctggatgcagggagccttacgttggcggggaggaaaaactttcaaaaaaagagatgtgtttcaactgtgagagttaaaatactaaagactcgacccaaggacattgagtaacattctttcctgaaaattttaagagtcactggataatggtgaagaaagcctggactggaatgtcagaggtgcctgaactcaagtccggtcaccagctgggtcaacacaggatagctacttaatcactcctcatatcagcccccacctctataaaatgtggacattaatattatcatgaaggtttatggtgaggaaccaagagaatgtagctaaaaatcccagaacatcataattgcttaataaatggcaactataatgattcactcttaataccaagagaaatgcctagctctcttttgctacttcattgtagatgaactgaataaccattttggttaactatgaattaaacaggaatgatcaaacatatacacatacaaaccatgattaggaaggagctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcgntactgtatctcgccctgtggtgngaattcagccgagnatttatcctcttaaagtcgccttcttcacaaaggttccagagcacctacgtgagaaaaacagaagtcctcccaacgattcgctgtcctgagtacagtgtcaacttagaatgactgatgggttgccatcacgaacatgctcactgcattaacaacacctcacacaaaagggtttttgaggaactcactaaaaatggaacagggttcggctgggcgtggtggctcatgcctgtaatcccagcactttaggaggctgacgcgagcggatcacttgaggccaggagtttgagaccagcctggccatcatggtgaaacctcgtctctactaaaaacacaaaaattagctcggcatggtggtgcatgcctgtaattccggctattcaggaggctacggcatgagaattccttgaacgcaggaggcagaggttacagcgagccgagattgtgctactgcactccagcctggggaacacagtgactctgtcccaaaaaaggagccaagtttcctgactttctcacggaatcctcccgtgctactaaggccatttccctgtgcctgccggtgcccgctgtaagctccggctggcattctgcttttcttgcggtcggtgagtgcagctcggctcagaagccacttttctcataagcacctctgtctcagataaaacttcttgacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgcgatatgatatcatcgctctgtggtgngattcgctccgggtgggggttacttacttaggtaaaataatgccatcgtgggaaaaagcgttcacttgaaattaccaagtaagtaaagccaacatttcagctagttccatggagatgggggaggtggagatttaggtttcaggacctgtttctctgttcaaagagaaaggggcctcggcatctcaagcccccgagctccatgaccatctgtggcggactgtcttcacctcctgtgttctcaggcagctccatcgactcagtgaccagctcctccgctgccagggctctgaggtcttggctgctcaccccctgggtttgccccactgtttctgatcggcctcctttgcatgtctgcacagccctgcccttcctccttcctggatggcccctccttgtggctcttcctgctgtttcccatcacccggccctgctgctgtgaggagttcaggccacctgggattgcagtgctggcctggcagaggcttcccttcctctgtggccctggctgtgccagcctcctgtctgctgccccacagcctgtggcctgtccactctacacacggtgccttttgtccctgcgcccatcccaattcctgtccttctcactcttccttcaaaacagcattttccaaacatttctggagtgcagcttatggtcagaaaagcatttttatcacaactgtgcgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttcgatactgatcctcgttatgtggtgngattcactgnanaaaaattttgcaaaaacatatctgatcaaggacttgtatccaaaatggacaaagaacttttaaaactcaacaatagaaaagtaaaccaccctattaaaaaatgggcaaaagatgtggacagatacctcaccaaagagaatatacaaatggggaataaacattttaaaaagtcttatcatcagacatcattagggaattgcaaaataaaacaacgagataccactgtccgtctattagaatgcttaaaagtccccaaacctggcaatattaaatactggggaggattcagaggaacgcgaaccctcattcattactggtaagaatgcaacataagtcagcaacttagaagacactttggcaggttttttttttgttgttgtcttttgctttttttaagcatagtcttatcatacaatcaagtgattgtgctcctaaatattgacccattgagtttaaaacttaagtccatacaaattcctggacataaatgtttatagaagctttataatcacccaaaactggaagtaattcatacaccttttaatatgtgaatgggaaatgaactatgacaaattcacacaatggaatattgttcagcaatcaaaagaagtgagttatcaagacatgaaaagatatgaaagagacttaaaggtacatagctaagtaaaaaatcccagtctcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcggtactgttccatcgtcactgtggtgngattcctgtttcccagttcaagtgattctcctgcctcagcctcccgagtaggtgggaacacagatgcgcgccatcacacccagctaaatttttttgtatttttagtagagacagggattcaccatgatagccaggctggtcccaaactcctgatcttaagtgatctgcccgccttggcctcccaaagtgctgggattacaggccgtgagaggcagccttctgagaggagaggagccttgtgagtctcaagtagggaaaatgagagaaagtgggctgttcagtaggagaggggaaagaaagagggccttgaaccctgtttgcagtttcagcaagggtcctgacagttggcatttgagaacggtcggaatgcctgctatgtggcactatcttgttacgtaggaacccatttcaggcagacagaaacaccactttgtgcagcctacctggtccttcttggtagagtggggtctcatcacacacccttttaatgtgcgtgaatttaaataacatgcattcatccaagcaaacaccctgcctgatgagaagaatggcaggttgtccaaacactagatgaaaaactggctcttaagtcagagtcatagagcgagggttacatgtacacatccacagcacacacgtgggtgacctatgcaggtgatttatggtatttctaaactatatttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcttgcgtactgtatccatctctcactgtggtggnattattgtttcggggaattttctctaaatatctttcccttctccaaatatttcaaatacaaaaactggaaaatgaaactgataataaaacaaagagtaaataacttcaagatgagcaactgttagattttttattttttaaaaaagtcatctttttattttttaaaaaggtcatctatttagggtctcccctcaggaagataacatggggggaggcattagaggacaaaggtggacaagactctgttggttttctatgaccaaggtttgttttaaaagatgaaaacatacaatagtttgagtatctgtcctttcatggccaagcttgtataaaaccacgatgcaccccagcagctcttctggaaacatgctgggcatcccaggaaacacttcatatggtaatcaataaagctcctgactttggacttcaagaggtgccattcaacgtatgtcattaacatgttcttgttgctttatgggtgaacatcattttgtaccatttgaagcagcattcacccgtgcctatgtgctggtactcagcgtccttatctggcatgtattcagagcaatcctgatgatctcaactcactggcaacagacatcagttaaagctaggccagtgcctaacttctcttaaaacctggacaaactgaaaaactgaaccagatttcattaattacaaatttattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcgctactgtatcatccgtcttctgtggtgngattctctgcctacgcanactactgctgcccagcgactgcccgtgctaataggtgtgggtgtggcgaagccacaatgaacgtgttgaaaacgtgtgcagccctctgtttcaaatgcctctgccacttacagagattaagttcagcatagggccttgttagaaagtgatgactatctaggacttcatgacagcatctaaaacaagtatcagggtgggggacggaaggacataaggtggataaagttaatcctataacatcacgagaaacaatttagcaaatatagtaacaaaaacaggtnacaaatatgctggcatgactttctgattcggtcttgcctgaaacagcctaaatcacctgccccgtgatacgtccgtatggaagctcaagtccccatttccatcctgccgcgaccttcttcttgtcatatgtgcttcgccccacgtttcgacgctggcggcgttcgtttcctccttaccgaccatcccgtatatcgggcgccgggtcccagtttcctgtcctctccccgcccgtcgccggttgcacgttcgccgcccccccgcccgacgcgcgggcgtacaatgctgcccacgcggcacgcagatcgccgatgtccgcgcgccggcgcggtgttttgcctctcttccgcgcgcgccgccctctggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttgcgttactgtatctcgtcctgtggtgngattcgagccagcagtggcaacccgcttgggtccccttcccagtgtggaagctttggtgttggcgctctttgcaataaatcttgctactgcccactctttgggtccacgctgcttttatgaggtgtaacactcaccgcgaagatctgcagcttcactccagagcccagcgaaaccatgagcccaccgggaggaacgaacaactccagacgcgcgggcttaagagctgtaacactcaccgcaaaggtctgcagcttcactcctgagccagcgagaccacgaacccaccagaaggaagaaactccgaaaacatctgaacatcagaagggacagactccagacgcgccaccttaagagctgtaacactcaccgcgagggtccgcggcttcattcttgaagtcagtgagaccaagaacccaccaattccggacacactgggacctctggtcaccctatctctggatctgaagtacttaaccctgacttgttatggcaccaataggcaaggccaagcacccacttactttaggaaatcacatttatgggcgtgtttcctaaaaggcaaacgtgtcttttttccccaatctctgccttcctcattaaaagtaaaccaaagctgggcatggtggctcatgactgtaatcccttccgcacattgggaggctgaagcaagaggatcacttgaggtncagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttgcgntactgtatccatcttcctgtggtgngattctttcctttctcgattattctatatttatttcactcttagcaatctggcgtgtttgggactgccttaaagacatctgttaacatctccaaatactttataaaaaccttacacagaaggagcaggatacaggagatcccgtatcagcatcacaaactgtgtctgttttcattacaaatcagtaccatgattccagctgctggggagaaaacagaatttagctataatacccagaggcgctgtccaggtttattacacctaaatacgcacagaagcacactcatggctgtgctcttgagaaactattcattgtaagtttcactcttctaaaagatgaaagaccttcagctccatccgttacctctagcaaactaatgcaggaacagaaaaccaaataccacctgttttcacttataagcggcagctaaatgatgagaactcatggacgcaaagaagacaacagacaccagggcctacttgggggtggangggtgggnnaaggagnnanaanancanaaaaaataactactgggtactaggcttagtacctgagtgatgaaataatctgaaccacaaaccccatgacacgagtttacctatgtaacaaacctgcacatgcactcctgaaactaaaagttaaaaatgataagaccttgaaatatatccattactaatgtcaacaactaacatgccttcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgtgcgntactgatatcatcgccctgtggtgngattaaccttcagctcatcacatggnaacttaccattctggtctggtaacctctacatcaataactgttccaggaagtggattctgaagtcttcctccagactgagcaaaaaatctggtgttcactcttttcttcaccacaattaccgttagtctagggcttaaaaatgatgatgaatgtaactgcatttagccagtcatattttcagggcactcattcattcaggtgttcacatgctccatttaaaaaggaacacatccctcctggggcgtatcatctgtccaggttgtggagaaggatcaggatcttactcttgacaggagtaaagaccacggataaacggtgagagggaaaccaaatggcacatatgtcctgtgacacacggtcatgtagatggtttatccatagaccaaacacattacataccaatcacaccaaaatgttaaatccagcatgtcttcaaaattcacaatttataacagtcttcagtgggcattttctactgtagaaaatatattttctagtgtagaaaatataatattaactctaaaatctttgacaggtaagtggatttaagtagtgcttttcaaaattaccgtttcactatatatcggggatacacacagacacacactcatacatacatactacatattcatatacctttntcaggaggagtaacttcattttctactcgtgtncaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgcgntactgttcctcgctctgtggtggnaattcccaatgcaacctacanattcaatgctatttctatcaaacttccattggcgttttatatgagaattaggaaaaaactactctaaaattcatatggaaccaaaaaagagcccaaatagccgaagtggtcttaagcaaaaggaacaaatccggaggcatcacattacctgacttcaaactatactataaggctacagtcactataatagcatgggactggtacaaaaacagacacacagactaatggaacagaatagagaaccagaaataaaaccacatgcctacaaccctctgatatttgacaaagttgagaaaaataagcagtggggaaaggactccccattcaataaatgctgctgggataactggctagtcacatgcagaagattgaaactggactcctaccttttaccatatacaaacattaactcaaggtggatcaaagatttgaacgtaagacctcaaattacacaaatactgcaagaaaacctaggaaataccattctggacatcagccttggcaaagaattatgactaagaccacaaaaacaattgccacacaaacaaaaattaacatgcatgacctaattaaagaacttctgcacagcaaaagaaactatcaacagagtgaacaacaccctacagaatgggagaaaatatttgcaaattgtgcatctgacaaaggtctagtgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattgcggtacgaatccatcgctctgtggtggnaattccacaccagncccanaccaatgatggacaccttcanacggtggggacctggtggtcctaacatgccagcaagcttgagcgctactggtctactcagccttaagactgtcctccctcttactcatggataggttattatcgtaaacattcaaacaatatggagaaaatgaaagtgtctgttgataacctcctcagacattactgcttgaggggggtatatatccttccagatctttctactcatttacatatctatgccttgtctaaagtcgagatccatgagtccatctgcctgctggtcatctgcaccaagtggctcacaggcctaccacgtcacttcttccccaaactcatctgcccataaagtgcctaaaccaagttcaaaattggctggctctgggcaacacggaatcctgtttctctgtttatatggtctaggaaatgacataaagagcctactacatcaaaacacctgtgcagtgaaggacacagcanagtgatgagtacctgtggaatgggagaaaatgtctgcaagtcatctatctgctaaggggttaatatccagaacatataaagaacatcaaaaaacccaattaaagacatttctccaaaaatgagattcaggtggccagcangcacatgaaaagatgccagtcaccacgaatctccagggaaatgcagttcaaaaccatgtagtaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactgcggtacgaatccatcttcctgtggtggnaattcggcatcagttgaaggacctttaaaaagtccctcccatcttaaaacaggcgctcccgccaagtgatttcccttcagccatcgcataatcgcttttctgccttcgcagttcactccttgaagacgctgtgtagattcccgcctcggctccctctcttaccagtcttcactcaacccgcctctgttagtgaacctctggcttcctgccgagccatcctctcccatcactgaacccaatggacaatctttagtccctgttcttcctggtcacgctgtcgtatcggaaccattcttctttttaaggtgctctgtttttgagtttttgtttggcatcacacactcttggttttcttctcacctctctggctactcattcctagtttattttgctgactcatttctttcacctatctgctaacattgtctatcttcacagttccaccatttttatcttgttgacttatttgacactctccccatctcagtgttctttgagtgttcttctgttaacctttaaacaacaggtgccaaagggtcctctttggttcttactatagcaaacgggacgatgtggtctccttccacagccccagacaccagtcattgaggatgactctcaactcatggactcatacgactctgagctccaaagtcatgtatccagctgagaactgtacatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctttgcgntactgatntcctccgcttcctgtggtggnnaattcgattttggtcatggtcccagnaggtctagagcagctctgggcaccagatacttcagagtccagaggcaggaagagaccatctctttgttacgtcctgttttttccttttttttttttttttcctttaatgaccccagacaaaatcctcttatatgtctttggccaggattgtttcacatgctgaggtctaaaatacaccatttactggggaaggttttggagctgccacatttgtttaaaataatttcaaagcaaccctgagttactcaaggcagtggtagccaccccacaatatgctgagttctgagagcagaggaggcagtgaacgattgtgtgaggcgagggacagcccanttaccccgatttgatccgtagacatcgcacgaacctatgaaatatcgtaagtacccccaaaatgtgtacaactatgacatgtcaatttaaaaaaaaggtagtaaacagtctttgggtgtctctggtgccaggaaactgtgttcaaactaatttgggcataacagccagtagttatggccactccaaaacaaaactacacagctcttggggaggaaatggtcanagagaaggatgcaatatttgaagaagaaatgaacacaacaggtatataaaaattaagaatgccaaaggccagtgactttgcccttgccctgagttctgagaggacacaagaatggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacttcggtatgtatcctcgctctgtggtgngattctctatgaactcaaggttgagaactactgatttagcatcttggccatggtaaatgataagggtcttattgtctcacccattgggaggggctaagagccaccaatcggccttcagaggaggctttccagggtagaccagggcttgagccagacttcggtgcacatcaagctcaaagagatagaggttcaaagagatccattagagatggataaaaggcataagccaggtttctcaacattttgcaccattctaacattttgcatcataattctttgctgtgggggggctcctgtgtgcttgtgggggcactcctgtattctgtggcatgctatgagcaaacctggtctctacccatgagatgcccgtggaaccctcccaagatgtaacagccagtaatatctccggatattgccagttgtccctgggaaaagaaatggaccccagtggagaaccactgacataaacaaagatgaaaaaccagaaaagtcaaagatccatgcattatctgaatgacattcactccacatctgtggtttaccatcctggactccggcgggctttggagacaggtctccctctctgaaggcaganaaaacacangcttggggtgccaacaaatgcatacatttatttcaaaagaaaaaatttccattgaaaacaggcccctgctatagtttggctgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcgntactgatatcaccgctcctgtnggtggnaattctgcagcaacatgggatggggactggnaaaccattatcttaagtgaactaacgcaggaacagaaaaccaaataccacatgttctcacttataagcaggagctaaacactgagtgcacatggacacgaagaaggaaacagacactggggcttacttgagggtagagggtaggaagagggagaggattgaaaaggtacctattgggtgctggggggggtacctggcgacaaaataatctgtacaccaagtccttgcaactctcaatttacctatgtaacaaacctgcacatgcacccccaaacctaaaataaaagttaaaaaaagacatggtttcctgtctgtttttaaaacatactgatctatgattcacatgccataaaattcaccctttaaggtgtaaaattcagtggcttttattatatgtacaagattgtgcaaccatcactgctatctaattctaatatgtttctatcaccccccctcaaagaaaccccgtacctataccgagtcattcctcacctctttctttccgcccctccaaatgactgatcagctttctgggtctgtggatctgcatattctcaacatcttgtatacatgaaatcatatgatcggtgagccgtcttttggggtgggtccttccctcgccgtgatgcgtctaggctcctctcgtctcctcctgtgtaagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcttcgntactgaatccatctttctgtggtgngaattctctcatttctgactttttctaattctgagttatatttttctttttcatcttgcactttttaaaaaaaaaaaaagagcaacattttcttctgatcgatgcatatgtttttctggtgtgctctccctctctgtaggtatgtttttctgcttctagcttattttatgtgattatgtgtatgggtttatatctcagttgcttctgtcgtggatctcacatggagttggtttttctagaattggataaggaggcatgtttccaagctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccctttgctcaacatttatccttcttgtcaccttgtgaagaaagtaccttgcttcgccttcaccttacaccatgattctaagtttcctggggcctccccagccatgcggaactgtgagccaattaaacctctttccttcataaattacccagtctagggcagttctttatggcagtgtgaaaacagactaatacaacctccctcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcaggagggttgttnaggttaatttttattcttcncggaactgggtacgaagctcccttctgtggtggnaataactcgcctggctattgcagaataattccttcaatcttcctccgacccctgtgttgtggttgtgtagatcagagtggccgacagaggtacagctgatggcacagccaggacacgcacaccggggtttccatcccaggcgttaaataaggcatttgcatggatggtgtggccttgcggctggcacatgttggcatattaggctttctgtggggggcttagcaagtgtgactatgaaatcctgctgtttttgtgttctccaaggctgtggtaataagtaccatagttgggtggcttagaccacagaggtgcattctctcattcttatgggtgccagacatctggaatcaacgtgccgaggggttggttccctctgagcatgtgagggagaactactctgggcctctcttcccggccctggtggccttgggacacctccctgtgtctatacgctatctgctcttcgtgcatacctgtcctgcgcacccatttacctttttgacaaggacctcatattctattacggcctttcttaacgacatgctgtagaattggactggcaaagactctatttccaaataagggcagtttcacagggattggaggtgacgccctatgggggggcgggggaaggctaattcatcccacacctccgttgtttttgccaatttttttctgtgctttccctccttctcctctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctcgtactgaatctcgcctctgtggtgngaatcctcttctgtgcctctggtctggcctgatttcatgtttcctctgcactgggccttggtgtgcatacagatcatgttctgtagcggacacagggagtggctagaaaggagaagtgaaaaatccaggagctcttgtataaaaacatgggatcacacgagggaatttagatggtttggcttctttttctcaaagaggagagaaagcagctggtgaccattcaaattcagtctgtttggaggagttgttaagacttccggagattacctggcctcatcgcacctgcgtcattgggacgctctcagatccatatttccaaaggagtccccaccagtagaatcagtggattctgacttctctcctagattccagaaggagcctgatttcctagtgaaggggggtttgtggtttcagccgggccttccagtgaacctgngcattaacccactgcagacatggtgggcaccgtggtgtgggagaaagaccacctcacaatccttgacgccctcccctcctcctggatgaggagacagaaggtcancatcanatgatacacaggggccttgggatggatcntcctgggagagagaatgcccagcacttattcccagagacacccatgcctgatgtctacttcacccactnctggtaccatggatgatagacagctttattttattaattaaccctaaccaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcngagggtagttttcatctcctccccccgaactangtttatgtaggtcggcctaggtggtggnaaaaacgcgttgacggtgactgggtcatcacctcattcagtattcaccagggaggtggcggacacgtgatgacggtgaccgggtcatcacaacattcagtattcaccaggtaactgacgcacccacgtgatgacggtgactgggtcatcacaacattcaatatgcaccaggtaactgacggacacacttgatgacggtgaccgggtcatggggggattcaatattcaccaggtaactgacgcacacacgtgatgacggtgaccgggtcatcacaacattcaatactcaccaggtaactgacagacacgtgatgacggtgatcgggtcatcacaacattcaatactcaccatgtaactgacagacacacgtgatgatggtgaccgggtcctcacaacattcaatattcaccaggtaactgacggacacacgtgatgacggtgaccgggtcatcacaacattcagtattcaccangtaactgacggacacgtgatgacggtgaccgggtcatcacaacattcaatattcaccangtaactgacggacacacgtgatgatggtgactgggtcatcacaatattcaatattcaacaggtaactgacggacacacgtgatgatggtgactgggtcatcacaacattcaatattcaccangtcactgacggacacacgtgatgatggtgactgtgtcatcacaccattcaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcattgcggtactgtatctcgccctgtggtgngattctgtccgttgtaatttctatggagataaagggaatcatctattaaacagagttgacggcttttgattttttttattgcagggaaacctgaagaaaagagctcccctttttaaggggcaaagctttgtcaatagagttactaatgtttttatttttcctccctggacacaaagaaaacacgctggactttcctcactttgtaggctcagtggccaaaataacaaaaaatgggagaatacagaggagatattcagagttgattcctaagaacagaatcctcttgaacgtggtgcttcggttttagaagagtgaagctacaggccttctgtctgacaggtcaacaactagataaatgcaaagaccaaaagttataaaggataaaaatcaaacctaattaagtatatatttgaagccacataattttgttttttaatcatgaaggacattttttaaattttggaaatccagaaaatattaaaatttatattatttttcattgtaggtccactgcttattaaaaataggaagtgtatggtttacagacttaatttcctctgaaaaagataagtaatcctttgaaatatagatttctaaaatattgttttctagtattttcacaagaaaaatagaagtaaatgaccactagaggaatatccctgtctgttcagctgtcactgatgttcatttcccaaagctctttgccgagtcctccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatggcatatgtatcatcgccctgtggtggattccaacgaaaatgaatgaatgaatgaatgaatgaatgagtccattgtcatcaacttttggaaaaataattgcaacttttacttaaaattcaggggtccatgtgcatgtttgttacatgggtctattgcgtgatcctgaggtttggggtacagttgatcccttcaccgaggcagtgagcacagctcccaacaggtagttttttcaagcgtggccccctcccctccccggtagtctccagcacctactgattccatctttatgtccccgagtgcccaatgtttagctcccactgataggtgagaacatatggcatttagttttctgctcctgcattaattatcttaggataatggccgccagctgcatccatgttgccgcaaaagacatgatcttgctcttttataggacagtgtagtattccttaaggtgtcttcttaaaagaagatttcaataaccagaaaaaaaagtgtcttcttcctaaagctaaattgaaaaatacctaattaagtcaataacatgacttaaaattcattatcatactgaaaacactttatcacacaggaagtgcctttttcatttttgtaaggccatctttcagaatatagcctttcacctcaatgatttacggatatgcagtattagagtctcatcaaaatcacgggtaacatgaggattagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgcgatacgaatccatcgctctgtggtggnaattctgcactttttaaaaaaaaaaaaagacaacattttcttctgatcgatgcatatgtttttctggtgtgctctccctctctgtaggtatgtttttctgcttctagcttattttatgtgattatgtgtatgggtttatatctcagttgcttctgtcgtttatctcacatggagttggtttttctagaattggataaggaggcatgtttccaggctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccctttgctcaacatttatccttcttgtcaccttgtgaagaaagtaccttgcttcgccttcaccttacaccatgattctaagtttcctggggcctccccagccatgcggaactgtgagccaattaaacctctttccttcataaattacccagtctagggcagttctttatggcagtgtgaaaacagactaatacaacctccctcttctattttttcatgttatgcttaaagacatggtggcctatttctgagatttcttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaactgcgntactgaatcctccgctctgtggtggaattccccngaggagaacggaattttctttttaccttcatacactggcattaagcataatttgtctgtctgtaggactttactactgaagagtagaagggattagatttttacatcacaacctattttaagcaattataatccacaagtaatcttcctcattcatcccccctggggcgaggaagatgtaagagactgttctggggcctcaggggggatcagtgtttgcattcctactagctgaattagctgggattctggagtgtggagcccatttatctcagacgctgtgggaatgtgggcctcactcacaaaaggaggtttttgccaactgagtgccattagtgcagtcaaataacatatgacccccatcctttgccctcagacatgtcttttggtctttggcctccttgtgccagtgcaggaagaaacttctcgctttgtgggaagccatttgggagttaacgacctggctttccttcaatccacttacatttctggtcattctcagcatcagggagttgtgcactggagtctgttcatacaggctttttttttttttccaggaattttgtgagccagttgtaaacacagaattattaaaaattaaattacataaatgtacatttaaagcaattgtattggaaataaaggtagaagagaactcagcttcaatgccactcgtgatgacctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttcgntactgaatccatctttctgtggtggnaattcgacactagtcatctttttattttttngaaaaaatgacaaaatgtagctcagagatccagtacttcagacactcacattcatcttgagcagcaagaaaatattttctcaaacgcgagcctgtctgcggattaaaggcaaacatttcaaaaattattctgtagcttaagaaaacatacttcaacaattactgtttccttttccatgtaaccagattcactgtacattacaaccttaaagctaagatctaaggtttagatcaactctttaatcctggctgtggctttgggtacttcctgctcttcatgagaagggctctaggcctgcagctgcctgtgaacaacatcaggaaaaaagaaaagaaagttaaaaaagaacttagctgactgggaacaaggttctatagcattgcaaaggttaagctatggcatctgaaaatctgacacttgaagaatgcatagcttaatgacacaactcaacctctgtgccctttagagagcttcatgtcaaataaaataacttagaagagaagtggcaggtaatatccttcttgtcaactatttaacttaaaaaaaaaagtttgcatgccaggaacacctaactctgtttttctcaattgaatccacttttgtcttaatttgatatactgctttngtggatttgcctagctntgtgaattcccttggttttcatctatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatggcgntactgtaacatccgctattgtnggtgggaattagcacactctcctcagcaggatgggaggcagtgcccactccccccaggtcagacagacagctgtaggtaagtgcttctttcagtctcgcctgccatcaccaaggacaagggacccccaactgcccagtccagtctgcagtgaagccaagtttccatggacacattccagggaggctgctactctttccctgtcgaggtttggtgctgataacacatccagtgcatcctctctggaagaacatacggtggagtcaccgcatacgctgattttattcacatacgttcaactccaagtgctccacccacctctaccccacacctgtcttccccccaaaacaacgtgacattgtgggcagttctctggaaggagccttcgttgggggactggcctcaggcagctctgtgttggggtgtctgcctaaatgcctcccgtggtgtggccagttgcatggtccatgtgagtttggacttgaagacacaaagatgttttcacagatcatggtccttgagtataagccacctactgagaaaatgcactcttacgtaggctataggagggacctgaaagattttcaaggggtatgttgaccacacccaactctctctagaatctgaccttagcccctgacccctctgcacgttttgatgccacacacttgccacataaactcagctgggaagtgctgagaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacatggncgagtactgatntccatgcgtctcactgtgggtggnaattcaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgaggggagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgcgatatgtatccatcgctctgtggtgggaattccggggtcctcacaacattcaatattcaccaggtaactgacggacacacgggatgacggggaccgggtcatcacaacattcagtattcaccaggtaactgacggacacgtgatgacggtgaccgggtcatcacaacattcaatattcaccaggtaactgacggacacacgtgatgatggtgactgggtcatcacaatattcaatatgtgggggggaactgacggacacacgtgatgatggtgactgggtcatcacaacattcaatattcaccaggtaactgacggacacacgtgatgatggtgactgggtcatcacaacattcaatattcaccaggtaactgacgcacacacgtgatgacggggactgggtcatcacaacattcaatattcaccangtaactgacggacacacgtgatgacggtgaccgggtcatcacaacactcaatattcaccangtaactgacggacacgtgatgacggtgactgggtcatcacaccaaatattcaccacgtaactgacaccaacacgtgatgatggagactgggtcatcacaacattcagtattcaccacgtaactgacgcacacatgtgatgacagtgaccgggtcatcacaacattcaatattcaccaanatactgacgcacccaccggatgacggtgggcgggggctaccacattnaatatttacccgggactggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatgcgntactgtatctcgccctgtggtgggattctctgcctacgcagactactgctgcccagcgactgcccgtgctaatagctctgaatataacaaagccacaatgaacgtgttgaaaacgtgtgcagccctctgtttcaaatgcctctgccacttacagagattaagttcagcatagggccttgttagaaagtgatgactatctaggacttcatgacagcatctaaaacaagtatcagtcttaggaacggaaggacataaggtggataaagttaatcctataacatcacgagaaacaatttagcaaatatagtaacaaaaacaggtcacaaatatgctggcatgactttctgatttgttcttgcatcaaacagtctaaatcagctgccctgtgatacgttgctataaaagcttaaaagcaacatttcaatttgaaagcaaacattgtggttctaatgataactattagacaaacattgaagtccaaactttgcattttctaaaagtgaagaataattttcagatattttacctttacgtacaacttgaaggtttttcccagaactatctaccatgtattgaatacttactggatactgtgtgaagtccattacgtatattttcatttacgccttgcaatgcctcagttaactgttcccttcttctacaaacgaagctaaagctgggattaaccaaactctgattntaagacatattgctntttaccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcggtacgtatcatcgtcctgtggtgngattctattctcttctggtctatctattccagtgttacttctgtattgttttgaatctgatgttcatactcgataagaaagctagtgcttatcatctttttcctttttttaaataagtattctaatttattttccatataaatataattttaaaaatctgtccagtacaaaatttaattggaatagcttttaatttgtaagttaatttagaagaaataacgtttcagatagtcaccttcccagccaagaacttgatatctccttcccttggttcgcatcttgtcttgtgtccttcagtgggattacacatcttgctaaacggtaatacctagagctagacaggatgcagtaaaactgctatattggttagtggcagtgtggattagctccactcttactgaaaagcaattttacaatgtgcaaagggtcatgaaaatgaacattttgctgagatggagcaccatgctctggggaatttgtcctcaagatattttcaaaagaaaaaaaaaaagcacatgtgaaatatagcatcgattataatgttgaaaatctggaatcaatataaaaatccaatcgaaaggagacagtttttcaacattgggtaaattcagttaatagttaagtcatcaaaatggtaatttgaaagttatataacaattagtatatgataagaggaaaagtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacttcggactgtatcatcgcctctgtggtggnaattctcaactttngaatgctcagtacaaaagaattggactaatgccctacttggatgcgttctgtcctaaaatgtgacatgtctgatttcaatccactttaacccagtgtgctgcgtctttgttgtcaaagggtgttgcatctgcttaaactcacacatctcgaaggttgctgtgaaggtaaacagaaagcaacgtaaggcacggatgttgatgcgtgtgtcgtgtgtgtgtgtgtgtgtgtgtgtgtgtgtgtgtgtgtgcaaaatttgtacagcagtacctgcatctctatccaaagaaatcaaatcaaacattaagtgcaatttcccccgaccttttctcgcctttgtctctctccctggaaataacaggtgggtatgaatcctctagggtggatattaagagaaattagtgaaattggattttgtgcccataaatacgaccattcttttaaacgttcgcgaggctagtgtattgaatagcattcaaattaagtttttgtatgaaaatacctcttgtttatgatcggtcacaggagtcttgagccctcaaggaacgcacagaggagagctagcgtatttcagtctgcgtggcctttgcttgcttgtacttttgtggatcagttaattttttatacaagtgaaatatagttcacattctcgttctcattatacacatttgttaattatacacacaatttacatggtctatataatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcttcgntactgatatcatcgctctgtggtggaattctgtaacttttcaggtcaaacttcctgggttcaaacccctgctctgccactaacacatgacgtgacatgggcgagtctcctatctctgttgtctccatgtatccatctgtacagtggggatgacgatcagaggcgacgtcacaaggcccctgccaggagtaacctgggtgctacatgcaaagcacctgggactcagcactcggtgagcattagccattatcacacccatcctgttcaactccatgggtccatgaagggaaaacaaacacaccagggacatctaatagtctcgacatgttctaacccttcaaacatttcaagaaaattctcatgtggctgcatttttctcttctaaatatcctaagttccttcacagcgtctcatctgacatgaatttaaattccttcgccatcttgtttacactcctttgaacatggttttatttatatccccttaaatcccatttatttatacccctctccttagcagtgtggtgcccggaacaggactgaatactccaggatggtatgtcctgagagacagagagagggcttattgcttcctgttttccttatgttgaagtttcgctagagctgcctaagacaccgttgctttntcgttgttacagtcccagccacggctgaagcatgtggaatacacgacagtccctgaaaaacactgcctattcgcagtagagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttgagggggtttccttcttnnnncgaaactagcggtacgataacctccccatcngtnggnggnaattaatggcttctgtgttcattaggttgttctgtccattgctgacataatccggtccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctctgcagaactttcagcggtataccggcatacagcatgtgcatcgcataggaatggcggaacgtatgtggtgtgaccggaacagagacgtcacacccgcagcagcagcggcggaaaccgccttcccaatccaggtcctgacccgtctggccctactttccacatccccgctttctctgtccttcctgcgcgacgggtaccctcctccatgaccttatcccaataaatacctgtgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggcgntatgaatcctccttcctgtggtggnattcgatcatccttggtgaagttgcagagttacacagactactgtttctgaaccaagaaataaaaaattaagcaatgagaactgtgactaacaaagtctgaactcagaaccatactgtcctggaccatcacagtttttaggaaaaagatagggcactcagtagagcatagaagtcacaacctctgttttaagaatgttaaaaaaaatgcctttttaaaactttactctgaagctattatcagccttgctattggcatcagctctttatttttttaaaaaatgaaaccctttttgcccactgagatgctactcgaggcatttgccgtgaacagcgaccctttcgtctcttgagcagcaatacaaccaagagatcaccgacttgaagcagcctgtcttggtcagccagcccaaagaagggcggggccctggggggacactgccagggcctgccatgctcattcctgagctctgctatcttacaggtactgttgcatttcatttactcggaaggaagccactggatttaccctttctttcctaggagtcctcagacattcctttacttccccttccctccccccagaaaaccttttattaaaactgctttgtctcctgggaattcccactcaccatcaccctatactccagttatttagacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttcggtatgtatcatcgctctgtggtggnaattcatcacttggcattttgaacaaaaaacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaatgggaatataatagtatgtggtagatttattattaaaggaaatccatgtgtggttaagctctgtgtgggtgtgtgcatgtgcacagttagtgtaaaatattttctagaaataaaatttgttattttatacaacactgtttattctctttgttttaaatattttatcatagcgggataactgacttcctttctcttaatgtttacaaaaagcaccataaccttaccgtttctgggagtatttttttttttttccaaaaataattttggtctatgttttgggagccattgacaatgttgtgacactctcatactaccagtaacagtccagtcagtgacaaaaggtcattcgcacggagtcagtataagcactaccaggatgaattcaaacacaaattgttaattccctctggccgctttagaattcaagtgaaattaatgaacggctaccgcaacataatacaacaaaatataactcccccaatacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacattgcgatactgtatccatcgtcctgtggtgngaattcgtcaatcgcagaatttgttgccaccatcaatgaagggatgacccggtgagtgagactgggctactgtgggtggcagtgaggacataaagcagggttctggaggttcaggagtagtgttcattcttcgttgttatccttccagtttctcaatcatatacagcaacgaatttaggaaagaaaaataatgacctaccctagctcttgagtgagtttcatcctgtattcgtcaaactgcatttcagattttttttaatcacatgtattggcgagtacatcttgttaaatgtgactctctctaaaaatgtatttgtttaataatatttactggccactgaaatgtagtttcacattttgatgtagaaaaaccacttcagtttacccagtcacttgtatttcaacataatagcattatttttcagtgcttttcttggaactaagggaattgccaagaatagtaatatatgaaaactgaaggcatgttagttgttgacattagtaatggatatatttcaaggtcttatcatttttaacttttagtttcaggagtgcatgtgcaggtttgttacataggtaaactcgtgtcatgggggtttgtggttcaaattatttcatcactcaggtactaagcctagtacccagtagttattttttctgctcttctccctcctcccacccttcacccccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctactgcgtactgntatcatcttcctgtggtgngattcgcccacttcccacagcgtctgagaaaaatgggctccacactccagagtcccagctgattcagctagtaggaatgcaaacactgatccaaattgaggccccagaacagtctcttacatcttcctcgccccaggggggatgaatgaggaagattacttgtggattataattgcttaaaataggttgtgatgtaaaaatctaatccctgctagtcttcagtagtaaagtcctacagacagagaaattatgcttaatgccagtgtattgaaggtaaaaagaaaattccgttctccctctgggggaagaggaaggacatctttttagagctgtcagaattcacaagccataataaattattctttttcattactgatttattaagcaggctgcttggtgtaatggcagaaaatttctgtttaattttcatagtattagacgactgtgattcccgatctgaaatcaacttgagttattaaaagaagggaatgtatttaatgtcgtgcatcagggtctgtcttcattaaattcttccaactacagggtttaagcatttatgcaaccatggctgttgtttgcttggaaacgagacaacagccctttcttgggacagtctgtgtcaggtgtgctcancccaatactcttccattttagtgattggcaggaaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttcgntactatatcctcccttctgtggtgngattctggctctaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaataggtaagcgcaaacccctattcgaccttccctgtgcattttatcccacaaaacacctgccgctcagagaggcaggcggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagatgatctaatgggcgatgaagtaccgtcttgcttgcaaacaatttatcgcatctagaaaacacatgattagctgctttctggtaatacggtttgaacatcagcctgtctacaataaatttcagtgggtggttgggggggccgctatgcctttcattctttaggtgacctttgcttatccaagaggcacaagctcttttctctttagtttgggtagacatgaaactccttcatttatcttaagccagtctgcnagcaccagtgagaatgcagcanaactatnttcagtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgcatactgtatctcgccctgtggtggnaattccacattgnanaatctttttatatgatgattggccttttatatgtcttctatggataaatgtctatttggatcctttttccatgttcaaaaggcatgctttttatgagttgtaagagtacttcatatgttatagatacaagccctttatcacatgtatgatttacaaatatattcttctgtagattgactttccactttctttacagtgtagggtgggggcacaaaactgttttaaattttgatgaaactcatatctattttttttcctttctcccttgtgcttttggtatcatagctaagaaaaagttgtttaatccaaagtcatgaagatttatgcctatgttttcctctatgagatttatagttttatctcttaatttgggggctgtgttccatttggtgttaatgtttgtataatacggtataagatgggcatccaacttcattcttttgcgtgtggaattctaattgtctctcaccatttactgaaaggatgatcgtttcccccatggacttgtcattgcttccttgtggaaagttaactgaccataaataagagtctataatctgggctctccattcattccagtgagcagctatatgtctgtattcatgctagcacctcactgtttttgattgctatagctntataagctntggaattgagaactatgagtcctccactttggctgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctctttcgntactgtaatcatccttctgtggtgaattcctctcttttctctggataaagctatggcccgactttattattcattaggcatgtggggttctccattaactttgctcataaaacgtttttaagattctgacatgagaaggacacacacatttctgcacggcctccccacctgcactggttttgtggtctggggatcccggcttcctttctgttaagcctatttgggatgctcttccttgttttaaccctgtgcgtctttgcaactagaaaagggtgcagcattccaacctgaattcagctcagctgcagatttcagtgtctaacagctcctgggaggacacgaaacagactcagtatttctacaaaaaggagagagggtgagaaattggaccaacgagaaagagaaagggccaccgagctgcatggaggaggaaagtgagagaagcaaccggcaatttcgcagtcagaaagctccctggccttgacccttcaccactgaaaggcgagcgggttttatgccggagacactcactgccttcctggaaaatctaaatagggcaggtgatggangggtggtggaaacacagtccagatggagatgggccctttcagttctgagcatcaagcagaaatgcccatgcagacgggtgacagccacctgtgaaaatgcctcgctgattaaaatcagtctctggaggaaccccaaaggacaaggatccattttgcaggtctcattcgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttgggttataaaaacttcctctctggggtggnaataatctctggccctgatgaacatttggaaggatgaagtcctgatttacggagctgggacagggcttcaagaaatcacagtttaactttgagcatactgagacaccagttcaaccagaggttgtcaaatgcggtctggaggcccctggaaatctcagactcctttggagttctgcgaaatcaaaattatctgtatgatactgagaggtgacttttcctttgcactctaacgcgccctcaggcatatacagtgctttccagaggctacacgtcatgtgctgacagtatcattctgacaatggaatatgggcacgcatatttttagatgttttaatttttaatatggtaattatcaacagatataattcacataaacaaaatctctgtgtcctcagtaattgaagagtgtcaggcagttccgagaccaagaagtctgagcagcattgtgttggacagcctaagggagacgtctaggagacagctgatgatgtgagtgtggagttcagggaggaaactgggcctggagatgtggtctgggaagcatcttcatacaaatgagtcatgggtgaaatcaccaacagaggaagagcagaaagaaaggggatcctggcagagtctgaaggcacatttaggccttagagacaagaaccagcaagagactgagaaggaacagtcaggtgtggggagccaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgcgagtatgaaatctccgcttttgtgngtgaattcatcataaaaacccttcccaaatgaaactacttttgatgaatgtggttggatttttctgaagccgtanaattccaaaggctgcatgcgtgtcttaatttcagtagcacacttgttaaattgggtgaaagagcaaatctatgtcaacaccttaacaaggaaaaagcctctgaacataactcagaaaagagttaactgacaaacctatgatagggttgctttaattgtgctgacttcttatcatgtagcaagccgggacaccacataaaataactctaaccagatactttacacacaaatacacatctcagcacctattatggtttcaaaaggaaacagaagcggagggtgcttatcacccacctgaggaggaggaggactcggcaaagagctttgggaaatgaacatcagtgacagctgaacagacaggatattcctctagttgtcatttacttctatttttcttgtgaaaatactagaaaacaatattttagaaatctatatttcaaaggattacttatctttttcagaggaaattaagtctgtaaaccatacacttcctatttttaataagcagtggacctacaatgaaaaatatataaatnttaatatnttctggatttccaaaatttaaaaaatgtccttcatgattaaaaaaacaaattatgtgggcttcaaatatatacttaattaggtcntcgattttatcctttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttgcgatactgtaccatccgtcactgtggtggnattcacacgtacaataacaagtgtgngtaagggggtgtggaaaaattggaaccatgatacattcctgctctgattgtaagtggtgcagcactttggaagacagttttgtttgttctgcaaaaacattagcatagaattaccacatgattggcaatttgacacctaagtatatacccaagggaattgaaagcatatgtcacgtaaaaacttgaacgtgtatgttcaaaatagcccaaaggtggaaaaaccccaaatgttcaccaagagacaaccgaataaaccaaatatggtattctatacaatggattattattcagccataaaaaggaatacaatacatccgctacaatgtagatgaaccttgaaaacacgctgaatgaaataagccagccacaaaagaccacaaactgtaggattccatttacatgaaatgttttgaataggtaaatctgtaaagtcaggaacaggttaatgaggctgtgcgtggtagtgtatgtaatccctgtaatcccagcactttgggatgcctaggtggaaggattgcttgaggttaggacttcaaaaccagcctgggcaacatagtgagatcttgtctctacaaagattgttttaaaaattagccaggtatagtggcacatgcctgtagtcctagtgacttgggaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattgcggtatgtaatctncgctctgtggtggnaattcggcctttgnaaatccagttgtacaaacatcttctctttgaatgatacttgaggagagcaaaacagcaagccagaaactggaaggaaatattcacagtgcatgtctacaacaaaagatttgtatccagaatacataaacaacttttacaactcaataaaatacttttaaaatgtgcaagagatttgaacagacatttcataaaagaagatgtgggagcggccaacatgtaaacaaaaagatgctcagcaacattacttaccagggaaatgcaaacaataaccaaaataaggtaagattacatacccacaagatgactaaaattaaaaaggcatcatcaaatactggtgaggatgtggagcaatgaaatctcacgcattgtaaagaaaaagggaaaagggcataaatacttagaagacagcttgttagcttttcatgaagttgcagacatgcttcccatataaatccagcaattcctcatctatgtatccgccagagaaatgaaaacatacatccccacacaaaatcctcaacagtgtttttcatggtagtctactatactagccaaagattggaaacatccaaaacacccactgattgatgatgaataaacaaatggtgaactcatcacgcggtcgaataccacccagcaaacaacccacttacacagatacacagactctgctttaaaacaccaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgngcggtatgaatccatcgtcctgtggtgggaattcacancanaactaccacaatgtaagatagctcacatggcttttagagaggccccaggagtctcctgtctgatatgacttggaataaacacatagggtactttggcattattgtagcattgtcagatttgtctgggtaacttgatgattacaattgagttataatacacttagccactctttttctcagagccatttaaaaaaaatccaggtaaaacattttatggttttcaatgttgccttattaagcaagcagtatgtgattgggcataattgtcctttaaggatttaaagtttgggttttccacctctctggcttcaggttactgaagtttttagtaagacccggaatggagaggatgtgaggataacgatcactttaacaaatgaacttccacctacatcaccaacttgtttgcagttctataatattattttcaggaggtatgtgttttatttcaacattttattaagaaaacagcaaagttgaaataattgtacattgaacatctgcattcagttctcctagattttcagcattggttgggattattgagtttctctgtattgcagtaacttcaggtgtggtttactgatagaaaattcatctatttgctttaagcaagtatcctgcctttacttccctaattctgttgacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactctgcgantactgaantcctccgctcctgtggtggnaattcctgntgagttctgtactgggccatcaggttcaattagttcattcatgtgtgggatgcctcggcatagtatcttgacttacccattcatgcacttggttgacttattaatttagctctctacttattgacctcagtgggaactcctggcttgaattatgtgttcatttgtttgggtgtttgcttgggatgggtaatatccacacaggccacaggatttagaaggtacaaaagagtataacgagaaaataagttgccttttctcccctgttcttctcctttacctaggagaggcaatgacttttgatgctatcagaaagcacgttggttttcaggatggcttccgtgttcacaatcacgtgtgtgtcacacacatggtaatatgctatatacacattgttctagtcattctcagctggggacagttttgactcccggtgccatttcgccatgtctggagacatttttggttgttacactggaggtggggggccacaggtagctggtaggtggaggccanggaggctgctcaccgtcccgcagtgcacaggacggcccccaccacacagaaccgtctgacccaaaatgacattagtcctgaggttaagaatatctcgcttttatttatttatctttaactccttaagttgtttggactatgattcctcaagcaacttggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtcgntatgtatccatcgtcctgtggtggnaattcgggggaaggctagnatgatctatgtggtaaaagagcttccaatgtccaaatatgggacaatctgagcaagaaatagtgttggattaaaacccaaagtataaaacaaatatccatatttgtttataaatataaaataaatatttgagaaaaactagtaaatagaggagaagagacaaatgtgtgcagaattgcacatcaattatgtagagcagctccaccagtgaggagaggaagcataactccctattccctaagtgtgggatgatcatattaacatccgtccaaagacagtagggacagaaggaacacatttgacaatggagaaacctgacaaacgctactttagacagatgatgaatgtcaacatcagcaggcatttatcatgttgatattatacacccttgatataatgtaatggaaatggcactctacctctgtgatcttcctcctcacaacccataactctagtctcagcatgaggaaaacttcagacaaattccagtagagggacattctgcaatataccagaccaatacttctcaaaactgtcaatgtcatcaaacgtaaggaaagtctgagaaactgttgaacagacacttttcaaaagaaacatacttgtggccaataagcatacgaaaaaaatgctccacatcattaatcattagagaaatgcaaatgaaaaccacaatgagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctcatactgatccatcctctgtggtggnaattcaattatgaagcagccaattcattgatacaaaatctatttaaagttacaccagccatgggcatgcaaatgagaaaagcaataatgtaagttaatcaagtcatttctgctctgaaaattgcttggcagtcatttggaggggtgggaactattaaacatacaaactacgttatcttaattgaaaggtttgacgtggctccctgtaatgcggatgaacagaaacatattttaataactaagaatgggtgggagaagcaaccaagtaagacagtttctgaaacctgcgtgcttaaaatattgctcgtttgtattagaaacagcccttggcatgaatggctagtctcggtgtttgatttcatgttttatacggaaacgtttcctgtgttacacaggaaggtgtttatgcacggtccatttgtcgctactgtgtctgagtgttggattgtgtactttcattctaggattgaagtggatgacagaactgaagcctacttaagagtcttacagcaaaaggtcacagcagacacccagatagtaagtaactaattgacatataggcagttttcggtgaaagagctttttcaaagggggcatgtgtacattttggaacttggagttcttttttcaaatgttaataggttctcaaactaggcacaaaatatgttttgtaaccataaagtagctaagctaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctttcgntatgaatcctcgctctgtggtgngatttccctgtgcattttatccacaaaacacctgccgctcanagaggcagggggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagaggatctaatgggcgatgaagtaccgtcttgcttgcaaacaatttatcgcatctagaaaacacatgattagctgctttctggtaatacggtttgaacatcagcctgtctacaataaatttcagtgggtggtgtggggggccgctatgcctttcattctttaggtgacctttgcttatccaagaggcacaagctcttttctctttagtttgggtagacatgaaactccttcatttatcttaagccagtctgcaagcaccagtgagaatgcagcaaaactattttcagtgattttttaagcaacattacatttatgagttttaaatttttttccacgtgcaataacaatgtcctcattaaaaaaagcctctgtagtctcaaaaaaagcctctgctttttctaaaagctgtagagagatatcagttttatatcattcatatttaaggtttaatacttcaaaacttgattagcttctaaatcagacttcaaagacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgcgntactgtatcctctttctgtggtgngattcacctccgcctcctgggttcaagctattctcccacctcagccttctgagtagctgggattacaggtgcccaccaccacacccggctaatttttgtatttttagtagagatggggttttgccatgtcggcaggctggcctcaaactcctgacctcaggtgatccacccgcctccgcctcccaaagtgctggaattacaggaataagccactgcgcccagcctattattctaacaatattattttatcctaagtgcagaatattacgcagttctgctgcaactcttgttttgaagatacacgtttgttccaatgcagttgagatagtagggaacgatttgagctcagccccaaagtcgtatttgctcatgggcaatttcatctgtgataaacactagccgaatacagaaaattgcatgggctgaacagagcagcaaagaaatgtacaaaacccacacatgtccacgcctcaaacatctaccaacgatttcagttcactgagattttaggaactactccatccacgcctgccgacactccgttcttccaattgcagataatgccatttccaccgcttcacaataacccgcggactatagtccttccagtacccactcccgtgagcaatcttcggggttccctcctggtgaagagccatattcatggtggtatttatgttatttcttaaccacctgacacgtgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttcgntatgtatcctcgctctgtggtggaattcctcatggtttaatggacagactggaggaaggaaaagttcatgttagggtagggggggagaaaccatactacagcaaaaatataagaatatggagtcccagaccactgacccaaagtagagacgtttgctgatgtgagtgcccaggagcacgtggccctgttagcagtgccaggtctcggctgtattggccatgtgtgacccggaggggggggaacaccgctaagtttgaaataacctcatgatggatttctttcccccttgtgatctgaacagagagaagcaggagaagtggcaggcgtcattcggtatcgacgcggagaatggtggccctgtatgactacgaccccagagaaagctcgcccaacgtcgatgtcgaggtaccagccaaacactgcacttcatgacggacacaaccacacccttcccttccctcgtggtacaccacactgaggccacgtgtgttcacctcctcattccttctctccgaaccatccgtaggaagggctgccgatccgagggatggctgatacagacatggccacgcaggagagaaatcatgggattcccagggacatggccagcccctgacaagccctgtccccatggcccagattttcctgtgccatgacagaaagaacaatctgtcatccacatctaatggtgatgccacctgagggccatctttaggagagagataaaagcccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactttcgntactgtatctcgcttctgtggtggaattctaggaacttcttcctttcccctctgtattctcacggtgagactgcttggattagtgagtgctctcagtaacagagaatagttttagaggaatcatcctatggtgaagttgcagagttacacagactactgtttctaaaccaagaaataaaaaattaagcaatgagaactgtgactaacaaagtctgaactcagaaccatactgtcctggagcatcacagtttttaggaaaaagatagggcactcagtagagcatagaagtcacaacctctgttttaagaatgttaaaaaaaatgcctttttaaaactttactctgaagctattatcagccttgctattggcatcagctctttatttttttaaaaaatgaaaccctttttgcccactgagatgctactcgaggcatttgccgtgaacagcgaccctttcgtctcttgagcagcaatacaaccaagagatcaccgacttgaagcagcctgtcttggtcagccagcccaaagaaggccggggccctggggggacactgccagggcctgccatgctcattcctgagctctgctatcttacaggtactgttgcatttcatttactcggaaggaagccactggatttaccctttctttcctaggagtcctcagacattcctttacttccccttccctccccccagaaaaccttttattaaaactgctttgtctnctgggaattcccactcaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggttctaaaccctccctcngtggtggnattaactcaggaggctgaggcagaagaatgacttgaacctgggaggcggaggttgcagtgagccgagatcacaccactgcacttcagcctgggtgacagagggagacaccatctcaaaaaaaaaaaaaaaacccagaaaaaaagtgtaatttcagacagtgacatgagctatggagcaaacagagcaatgaggtgggaggggcgggtgggggtgatatggcagcacctctgggaagatggcactgaagccccagggaggatggctgaggctgggaataggctggaagagggctgagggtgaggctggagagaggcagggctacatcatccagcgtggagtttcccatgtctgacgggcatgggagtcaaaatgcagattctggttccaaaagtgcgtgcacgggttgggggatgagattctgcatttggaacaaggtgacggggctgccacactttcaaccatgcctagagtagcaagggccagagatttggtttttgacctcagcctcgctagagtcacctagagaacttttaccaatctcagatgctggggccccttcctggtggttctaatgaacatcaaaggttgagaactactgatttagcatcttggccatggtaaatgataagggtcttattgtctcacccattgggaggggctaagagccaccaatcggccttcagaggaggctttccatggtagaccagggcttgagccacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgcgntacgaaaccatcgctctgtggtggnaattccctcctgctttcctcttggctaattctgctctagtttccacaaatccttccagggccaggttggcctacctcggggcctcagcaggtgctgtctcctcagctgggatgctcctccctccaacctttgcccagctggtcccctttcctccttaaaccctgctctcatgtcaccttccccaggaggcctcttctgcaatcgctgtccagaatttcagcctgtgaccccagctccctgtcttcattgcttttatgtctccagaaccctgtcctcatctagcacatgagagacgctaactgggatcacactgaacacctgtgtccatgcctgcaagggtgggtcagggaggcaggggtctgtgtgtctcattctgcgttggcatctcagtgccttgagcagcacctggcacacagtaggggcacaggagtcacttgttgaatgaatgaataacattataatttatcagctgggtttattataaacacagtatggtcatgacaatagattagaaggttctttttaggataaaagaagaaagagatgatatactcaatggactttggcgagcttagcactacagcgtgctgaaaacccaaataaagagcgtccttattcctttacatacagtcctcttttaatgtatcatcaagaattgtgttatttggggacacagaacaactcaaacactttgatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccatggncngngtactgaaantccatccgcttcactgtggtggnnaatccccactggctcttccaagnctgcatttcccgtgcacgctcctcagttagggtgactggcggtctgttcttcacccccacttgctcgcagacgattacgggcgagaccgcctttctccagacttctatgaagagtcagaaactgaccctggtgccgaagagctcccggcccggatctttgtggctctctttgactacgacccgctcaccatgtgcccaaacccagatgctgcagaggaggagcttccctttaaagaaggccagatcatcaaggtgcgggatggctgcctgcgggcggcttcatcagcccctgaggcgggtctgggtcatgggggcagagactggcaacagggtatcgacttagagatggccttctcctgcaggccatgggcgaggcacgggaggaggtggcatggtgctgtgacggcaagggccctgccctctgcaaagtgccttctccagcatctgcccgggtttgtgtgcacacaaacacacccaaatatgtcctgtgaactctggattctattagggcctacgttgttgagaaaaataacacaggctccaaattttaaaacaacacttgtcagtcagcanacaggcagggaanagaggaaggagggagagggaaagggaggaaaaagggaanaacggagcatcncagctanaggctggactccatgccttagtctttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgnncgntactgatatcatccgcttctctgtggtggnaattcatcataccctattctttcgcccaataaaaagaatttaatgttggaccttcttgtgatgcctgtttattcatttgtatgtccactgcaattgctaatttcatgagaacagagacagtcttatggctagcacgcagtaggttctcagtaagtgtttgttggataaatatgaaaattgagattctatgctgtgttttccagccaatcaagtggggcttaccattagctgttgtacatgacttcatggctacatatatagaagtcacgatattcagagtttaggcatgaagctagtccttcatacatcttccctatgtttcataaacttcatctcagatttgcatgatgttttggttcattagctttgcattttagatttgtttttatggagcacataataagacttcatggcagtgaatntgttgagaagttgttgaaaaagtaattacatcccgaagagtttattttctaaagccatgaatcaatggaatttattcatagcttaacatggggagatgaacctatntataattacaaggatctttcattttaagggaatactgacagnctttactcagaaacatttgcatgtttaaaaagtataaaatacggtctacagagacaggtgacatttccgtattagtcatgaacgttccttttaaatgatcatcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacactgcgntacgaaatctcccttctgtggtgggaattcaccgtttgtcaggtttctccattgtcaaatgtgttccttctgtccctactgtctttggacggatgttaatatgatcatcccacacttagggaatagggagttatgcttcctctcctcactggtggagtgtctacataattgatgtgcaattctgcacacatttgtctcttctcctctatttactagtttttctcaaatatttattggagatttataaacaaatatggatatttgttttatactttgggttttaatccaacactattttcttgctcagattgttccatatttggacattggaagctcttttaccacatagatcactctagcctttcccctttgcttgtctgtaacctccaattccaacaataagaagcctggctcccaccataggccatttacttcattgttcaattcaaagtatatgtgtatagtggtatcagaattgttagcctgtaccttcaataggaaacaattctgtcaacaagaataaagtgcttatctgtagttagttttgcctttagtcttacaaattccatttatttctaaagttacacaggttagcaccttttctacacccttttcagtgagggttgtttcatatatttataatacagttagattttctggtcatggtctactagtctttactaggatcacctgacctcttcaataactttttaaaatttttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaattgcggntactgatatccatccgctcctgtggtggnaattcgcatgcaccaccatgccgagctaatttttgtgtttttagtaaagacgagggttcaccatgatggccaggctggtctcaaactcctggcctcaagtgatccgctcgcgtcagcctcctaaagtgctgggattacaggcatgagccaccacgcccagccgaaacttgttccatttttagtgagttcctcaaaaacccttttgtgtgagggggggttaatgcagtgagcatgttcgtgatggcaacccatcagtcattctaagttgacactgtactcaggacagcgaatcgttgggaggacttctgtttttctatgtaggtgctttggaacctttgtgaagaaggcgactttaagaggataaagtctcggcctgtgtgcaaagttgacatgtggaacacttctcctgtgtgaatcttgggtaaatgaggcaatactatagcgactttaggtggaaaatgataatagcatacagagtttagtcttatctagtctgctctgttatctgacagtggagagaaatttttattttgaaatacattatcttggatttctgtctttttctcagacagatgttatggcattggcttaggttaggttatggcattggcttaggttacaaggttctaatagggttggaaggattctagcctattggggaaaaattggctagaaagacaaaagaaggctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcttcgntactgaatccatncgctcctgtggtgngattcgacccataaaacagaaatgatgtttacagcctcaactcgggagaaaaaaccgtgaatgcaccttacactatagaagtaacacttttccctctgctttattttctctatatgctaaactccttacttgcctctgctaaagaacatcgctggagtgtcttggtgtgtgaagtatgaaatagtttctaaagacataagttgtgatatagcaagacagaggcaaaacccctcattcttctgagagtgtaaacatcatgtcgcaagaagctcacctaaaatttgaaaaggaaaactcaacgaaaatttgaaaagaaattcaaggaaaaaaaaatgtgacctttaaaatttccatgttgacagcaccaccaggaccccttctgggatccgttgctaggtataacttcgtgcctgactctggaagttaaaaaatgaatagttacagattctttttccgggagccgcctctagagggggtgtacccaccaggggaaggtgagcagagtgccaccaatcctgtgggtgctcagcgggaggttgctgagggatgcttcgtgactcaacgctgctgaagccctgaaggctgatttgggtttgcagggaacaggaggatcggcatggcggagcacgttggtctgagcacatgtgaggtgtttagaaaactgcaagtcatccagcacgggagcaacgccaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattggcgntactgaatccatccgctcactgtggtggnaattctcacgatgagcagttcctgtgcgatccaatacgccgtttcttcgagacagtcgttctcttaagttggttaaatctgtctctgcaatcttgtttggaggattgatttgcatctgaaaccctccttgaagtacaaagataaacttcaactcaattaagattgcattatccagcattctcattaacgaaatttaacatagtacaatttgcccatgcaccatcgttcatcacatgaataacgttttgtgttcattgtgatcaataaagccaaagtaactgtcactttctctacctataatgcatgcttataaacccattcgtagcttgacctgtaaagtgtgttgtgtacacacgacattctaggaatagttttgggcgctttatgtaccttatctcatttaattttcatgatcctactgatctcgcagactcaatccaagtttcgtctcacactagagtctgacctctgctcaccacactgtacctgtcatcccaaagttccgttttcagtgtaaatttctaggacacttctgatctgcgcaggaagaaaacccataccctgtgcagtgatgcatcctgtcaaacagctccacatgatttatagcaaccaaaactgcaggcactttcctttagctcttggtgtttaaagaattgaagtgatgatgggtgaaatttcaaaggcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatgcatatgaatccatcgtcctgtggtgngattcgacctcttttctaacatgcagtcttcgttttatccctgatgtcactgggttttgtgtcctacagactatttgagaggtttaatatcatattggaggccaggtgtcatggctcacacatataatcccaacactttgggatgccaaggcgggtggatcacctgaagtcaggagtttgagaccagcttggccaacacggtgaaaccccatgtggtactaaaaatacaaaaattagctgtgtgtggtgatgggcacctgtagtcccagctactcaggaggctgagacaggagaatcacttcaaccttggaggtggaggtttcagtgagccaagatcgccccactgcactccagcctgggcaacagagcaagactccacattggccgttttcttatgctcctttatgagatgtctgtttatatccttgtctggctgtcctattgaactgcaagaactctttgtatattatagacatgaaccctttgtctgtcttctgtgctgcaggtatttgcctcaaaacatcattttttcatgtattttattcatggtacctggtgccatacaaaatatttaaatttgtaaatgtgtttatactttctcttataatttctaggttttctaagtcacaaaaacctccttaattcctatgttgcaattgatactctcccaacttttcttcaaatgcttatgttgtttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccactggncngngtactagnanatccatccgcctcactggtnnggtggnaattncggnnctgccctgnagtcccccagcccctgctcagatgttacctcctcagtgaggccctcctcgagggtgccantccgaaatcacagcaccccttccctggatctccatccttctctttctccactgcatgcagagatttgtcggctgtgtccatcgatgtgtggcatcacctagacgggttccaggcactctgtaagagctgctgaatgagggcccgagtgctggactcaaccaggcttgcaggataaggcagatgttgtgggtggaattgcctctccccaccccccataggtcctcacctccaatccctgtgaaactggccttatttggaaatagagtctttggcaggccaagtggagatgatgtcgttaagatgggccctaatcgaatatgatgtccttgtcaaaaggggaaatttggacacagggcaggtatgcacagaaagcagatagcgtgaagaccagggagggtgcccgaggccaccacgaccgggaagagaggcccanagtanttctccctcacatgctcagagggaacccacccngcggcaccttgattccagatgtctggcacccagaagaatgagagaatgcacctctgtggtctaagcccccaactatggtacttattaccacagccttggagaacacacaaacagcaggatttcatactcacactcgctaaggggcgggagagaagcctaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgggggggacggaacccatccattactgtnggggggaattccacccctctcattttatgcctctcctcttgttttcagttcagcctgtatcgtgggtgggtgggtgctgtgttcagggcggggggagcgttcgccttttcatgctcacggttgagtcaagaatgggactctacaagagggaggcagttggataggaaagtgtaaacacttgcattgagagagattgtattaagcacacatatttttggagcgagggggagatcatttgtcttttttatattagcagatgaaaagaggcaatacggtaaagtattttttgtttttgttattgtttgttttggttttgctttttttgagatggagtctcactctgtcgtccaggctggaagtgcaatggcatgatcttggctcactgaaacttttgccacccgagttctcctgcctcagcctcccgagtagctgggattacaggcttgcaccaccacgcctggctaatttttttttttttttttttttttttaataaagattgggtttcaccatgttaggctggtctcgaactcctgacctcaggtgatccacccaccttggcctctcaaagtgctgggattacaagcatgagccaccccacctggccagtaaagtttcttttaaaaggcagccttgttagagttttagcacaacgctttcttggcctccttttcttgaccggcgtgaagcttcgcatcacaagctcctttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggttntaaagctcccctagggggtggaataagcggcccgctgtggccttttccttctgaaccacgtanagatgaagatgggaaagaanagagaaccgtgggctctgccaaccattcccctgtgggagcgtgcttggtctaacctcactcttccttttccattttgctgtggccacctctgccacctcagaggttcctaggtgccattcccactgcctgggcctctcatggctgcctcttcccaggaataattttcatttcataggtgtcagctcaagtcccatttaatgcattcaacaaatatctatcgtgcctcgtgttctcactttgactcagcagaccctgtggatagagagtgagacagacaagtccctgtcctcatggggcacacactcaaggcttgggggcatggggagcagatcatcaataggatgacacagaaagaagcatattttaattttgataagcggtacgaaggaaataaaacaagttttcttcagggaggccttccttggccatctggtctaacctggccccctattctctaacacgttggtcaatttgtcagacccattgagcttaatccatgagaatgtcagctctctaagagcagagccctcatctgccttgcttatggccatgtccccagtgctgtggacacaatagctgttggacaaataaaagagattgtaaataaataagtgacttttagtggctctcagaggcaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgcgntactgtatcatcgctctgtggtggaattcgaattccacagnccaactaactacacacttcattatctatggaaatgaaggctaatggggcatcaaaagcaaagactaacagccctgcagtataaaaatcataatagtgtattatggtgagcgtggaagagggagagaaaatgcacagcaattttaccgaaaaagagatgttgtgtttattgtttcggggaattttctctaaaattgggggccttctccaaaatatttcaaatacaaaaactggaaaatgaaactgataataaaacaaagagtaaataacttcaagatgagcaactgttagattttttattttttaaaaaagtcatctttttattttttaaaaaggtcatctatttagggtctcccctcaggaagataacatgttgggaggcattanaggacaaaggtggacaagactctgttggttttctatgaccaaggtttgttttaaaagatgaaaacatacaatagtttgagtatctgtcctttcatggccaagcttgtataaaaccacgatgcaccccagcagctcttctggaaacatgctgggcatcccaggaaacacttcatatggtaatcaataaagctcctgactttggacttcaagaggtgccattcaacgtatgtcattaaccatgtncttggtgctttatgggtgaacatcattttgtaccatttgaagcagcattcacccgtgcctatgtgctggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttgcgntactgaatccatccttcctgtggtggnaattctcacccactagtttcagcatcccttgatgattattgtcggaaacaattatgacggggagtattgttgaatggtgatttggcaaatcacctttacatgtacatgtagggtaatcttaaaacaaaattaaatctagagggattctgtgcaggaagaacctgcatagaacattcatccaaattcctagatgggctaattaataaagtgcggggaactatctcaatttgaatctaagcatcttaataacattgtggtagcaatgcagttggcagacatttaggacaaaagaatgatgcagaaaagttaaatccaggcaataggtttttatttttaaaaaatgcacagaaaaagtcttcacagttatccaggtagtgaatacagagcaagacgtttttcaactgtgatgattttggagatcactaagtcatcctgtcatggtattttactagtggaattaaatttttatactttaacttcatatgacagtttcttttacatgtgaccatgcattgcaaaaaaccttaccttcatgactcttgtaccttttagctgtatgaccttttcatgttccttatattctctgaactttattttacttatttgtagattgggaataataatagtaattgactcataggggctgcctgaaaattaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgcgatactgttccatcgctctgtggtggnaattcccctcgccttgtggcggcacctctccagcctctgtctccatagccacatggccttctcctctgtgtctgggtcctcttcttacagagacaccagtcattggatttagggcctaccctgaattcaggatgatttcagctcaagatccttaaccaattacacctctaaagactctatcctcaaacaagctcattctgagactgggtggggacgtgactgttgaggagacactcctcaacgtcccttggatggcatccctcagactcacttgctgttgcatttcgaggtgggttcggcccgtgagaggcactggccaggaagcagagagcaggagcagagacaggtcggacgtttcttcccaccgccctctgctgtcacactcagggcttagtgtggctgtgccccgcgcacctgcagctcccgcttaccaagcccatgtccaaggccctggccgtctgcagctctgggaacgctactccttcctcctgccccccaggcctggggggagagggtactactccttaccatcactgctccctcggggcctcagcctctcttgtgttttgcttaactttgcccacctttgaagggagtccctctattaaaatgtcttccagggaaccatctgaatgagattcttctccctgctgggaccctgattgattcgaagattatcatttattcatttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatggcgntactgtatctcgtcctgtggtggnaattcttcatttggctcagtacaagtgataaagatgatcctcattgggatgagtgactttttcattttatctacaaaacagcaaaaagggaatctactgggctcagccgagcgctccagtgatgcttccaaattaaaattagcttttaaaaactaggagtcataaaggacagatgttttagtgaagtcagctggcatttgcactcttctgccgaggcaccttaattctccagtgtctcctctaacctataaatgctcttccctaccgctgcttttggtttgattaccaagcgccactggtgtcccatttgataatattcctctgagagaccaatcctgccaatggttccatttgctgtcactttccgctatgctcattgagatggcaaaagagaaagaatcctgtgatcccagttgtgaggtctggctgccagagataggagcacacccatctgtgagagagtttgtcctttctgaaggaagagggtcttctatttataaccccccatggaagttaggcaagaggataacctcacggctgtcaacgggcagggggatgcctcgccttttcagaaaagtctttgcggaaagactcagcccaaaacaaggacctctagaaagaagtcctgtgcttcctgagctgacatttgatactggctctgcagtcccctttacacatcggatatttctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcgntacgaatccatcgttcctgtggtgngaatcctcacactatcaccccggagcacttcaaaagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatgtaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtggcggaggtgtagtcaaacaactcagcaggcgtgggaacaatcagcacatcagcagcacatacgacattaatcgtgccgatacccaggttaggcgcgctgtcaataactatgacatcatagtcatgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgcgntactgtatcctcgttctggtggnaattctgnagacggtgaccgggtcatcacaacgttcaatattcaccaggtaactgacgggcacgtgatgacggtgaccgggtcatcacaacgttcaatattcaccaggtaactgacggacacgtgatgacggtgaccgggtcatcacaacgttcaatattcactgggtaactgatgcatccatgtgatgacggtgaccgggtcatcacagcagggagtattcaccaggtaactgacgcacacacgtgatgacggtgactgggtcatcacaacattcagtattcaccaggtaactgatggacacacgtgatgacagtgaccgggtcatcacattgaatattcaccaggtcactgacgcacgcatgtgaggacggtgactagggggaaaggctctcgtggtcacaggcccttatcaggagcagcatctctgttaaggttcaaggaccccttacgcatgccccatgggtgtcgcaggtggcctgtctgcatcctcacccctctctggcccttctccattttctctgacactcagaccctctctgctggcttggcctcatctaccacagctggtgtctgcctccagcctccctaccattctgctggggtctttgcctccagcctcgtgaccattccgcacttcacaatccctattccatttagttaccagaagaagaagatacatgtaagtaaccatacaaattgac

SEQ ID NO: 718 - DNA, 61995 bp, Homo sapiens
  misc_feature (1)...(61995): n = A,T,C or G
atcttcaatgnggnggaattcctgtgttacacaggaaggtgtttatgcacggtccatttgtcgctactgtgtctgagtgttggattgtgtactttcattctaggattgaagtggatgacagaactgaagcctacttaagagtcttacagcaaaaggtcacagcagacacccagatagtaagtaactaattgacatataggcagttttcggtgaaagagctttttcaaagggggcatgtgtacattttggaacttggagttcttttttcaaatgttaataggttctcaaactaggcacaaaatatgttttgtaaccataaagtagctaagctaatgctagctttagttgtgcaccttaggagtttggtttacatactgcaaaaggtgaggaaggggtggagaaaaacaaagccatcttcaatttattcagacccaaaggctttacttagtctagaaaatttggaaaatacagaaaagcacagaggtaaaaatcagctgttgttcggcacacgtagacgtatgattgcgtaattacatggaagctccccagacagcctagtgccaggtatgggaagagtagggtcgcagagagcagggagccctgagtgacactcagcagcttgtcagcttccgcatgcatccacatcaccccgaggggtcgggatagggatgcaaccactctcctaagctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggattgggtgnnataaacccccctcggggnggnnggaaacccagtgatagnaataatcacctcattttgtttcaattttatagtttcactttccacatgtaaatctcaagtatctaccattttttcctaactatgagaacaaatgtctcaacacatttactaaataatctgcactttccctactttaaaaaaatcattttttaataataaaaaatgaatacgttttaaaattaaagtgtaaataggaatttaatacttagagtatttatggactttaacactactccatgctgtcttaattattgtatttttataatgcatttttatgtttgggagggaacattttgtaaagagtcccacctccacaacaaacctatacttttttgtttagatgtacatttagcttttggaagaaagagacataatattgtctttcaattctgacatagcatgcgcctcctcttaaaaagtttttcctttcatctgtcagaaaagattcatagatttattcttacgcatcctttatatatcttaagtttactcttaggaactatatagatccaacggccgggcacggtgactcatgcggaggctgaggcgtgctgatcacctgaggtcaggcattcgatatcagcctggccaacatggtgaaaccccgtttctactgaaaatacaaaagaattagccgggcgtggtggcatgtgcctgtaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatcctggtggggnggaattacaagcctgtagcttcactcttctaaaaccgaagcaccacgttcaagaggattctgttcttaggaatcaactctgaatatctcctctgtattctcccattttttgttattttggctactgagcctacaaagtgaggaaagtccagcgtgttttctttgtgtccagggaggaaaaataaaaacattagtaactctattgacaaagctttgccccttaaaaaggggagctcttttcttcaggtttccctgcaataaaaaaaatcaaaagctgtcaactctgtttaatagatgattccctttatctccatagaaattacaacggacagtagcagtgagggcagtcggtctgggccaggtagtgagggaaacctctctcctgtagaagacggtgcttattcttatggcaccagtggatttgggagcccacccaggcgtccaggcatgagccctgatctcccacacgatatgcacacccttcctcctaacaaagaccccttgggccagcacacttcctcagcaggatgggaggcagtgcccactccccccagggtcagacagacagctgtaggtaagtgcttctttcagtctcgcctgccatcaccaaggacaagggacccccaactgcccagtccagtctgcagtgaagccaagtttccatggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtctaaaaaagcactgggtttataaacacatctccctgnggnggnaattctccattcacccatgcacaccacccctttctgtctccattcacccatgcacaccacccccttcctgtctccattcacccatgcacaccaccccttcctgtctccattcacccatgcacaccacccccttcctgtctccattcacccatgcacaccacccccttcctgtctccattcacccatgcacaccaccccttcctgtgtgggttcacccatgcataccaccccttcctgtctccattcacccatgcacaccaccccttcctgtctccattcacccatgcacaccaccccttcctgtctccattcacccatgcacaccacccccttcctgtctccattcacccatgcacaccaccccttcctgtctccattcacccatgcacaccacccccttcctgtctccattcacccatgcacaccaccccttcctgtctccattcacccatgcacacctccccttcctgtctccattcacccatgcacaccaccccttcctgtctccattcacccatgcacactacccccttcctgtctccattcacccatgcacactaccccttcctgtctccattcacccatgcacaccaccccttcctgtctccattcacccatgcacaccacccccttcctgtctccattaacccgtgaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttggttnaaaancncccctgcgtgnggnggnaatttgccagtctctgccccctgnacccatacccgcctcagggctgatgaagccgcccgcaggcagccatcccgcaccttgatgatctggccttctttaaagggaagctcctcctctgcagcatctgggtttggggacatggtgagcgggtcgtagtcaaagagagccacaaagatccgggccgggagctcttcggcaccagggtcagtttctgactcttcatagaagtctggagaaaggcggtctcgcccgtaatcgtctgcgagcaagtgggggtgaagaacagagcggcagtgagcctaactgaggagcgtgcacgggaaatgcagctttggaaagcagtgaggatggcagcggttccttgacttttgtcttttttgtgtcttaacatgtaggtggaaatagatcgggaggtctaggtcagatgaattggagaagcacataaccacagccacactctgtacctggccacactgcatgtgaaagcattgagacagggctggacctcgggggcctcctcanagagcacaggctggggcaggggctgcggccgtgccaggggcaggatggcccatgctggggagccttcccaggacccacacactctgcanaatggaaagctaagcacagcccacgtttaaaatgtttgtatgttagtcaaagtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcctgtggtggaattccccagttttgggggctcccccatcttgcgtcactagggtatctttttccaactctcagctccatccactgacccccttcccccagcatccatccagtggatgtctaaccattttgaaaacctttctcaaggccaggtgtggtggctcatgcctgtattcccagcacttcaggaggccaaggtgggtggatcacctgaggtcaggagttcgagaccagcctggccatcatggcaaaaccccatttccactaaaaatacaagaattagctgggtgtggtggtgagcacctgtaatcccagctactcgggaggctgaggcaggagaatcacttgatcctgggaggcagaggttgcagtcgcaccattgcactccagcctgggcaacaagagcaaaactctgtcaaaaaaaaaaaaaggaaagaaaagaaagaaaaaagaaaagaaaagaaaaagaaagagagagagagaaagaaagaaagaaagaaagtgaaagaaagaaagaaagaaagaaagaaagaaagaaagaaagaaagaaagaaagaaagaaggaaagaagaaagagggaggaaggaatgaaggaaggaaaaacctttttcaaatatccccttcttggtgaaggctctcctgacttctctggagtatctggtatcttgctcatgtcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctacatgnggnggaattcgtcaaattgcagttaagtccaagtatgccacatagcagataagggaatgtacaagacactcggtgtcgtgatggacagtgatggctgtgatgatgtcgtacgctcagctgatccttctccctgctgagaagagttcagctggatgcagggagccttacgttacatatcaggaaaaactttcaaaaaaagagatgtgtttcaactgtgagagttaaaatactaaagactcgacccaaggacattgagtaacattctttcctgaaaattttaagagtcactggataatggtgaagaaagcctggactggaatgtcagaggtgcctgaactcaagtccggtcaccagctgggtcaacacaggatagctacttaatcactcctcatatcagcccccacctctataaaatgtggacattaatattatcatgaaggtttatggtgaggaaccaagagaatgtagctaaaaatcccagaacatcataattgcttaataaatggcaactataatgattcactcttaataccaagagaaatgcctagctctcttttgctacttcattgtagatgaactgaataaccattttggttaactatgaattaaacaggaatgatcaaacatatacacatacaaaccatgattaggaaggagctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaggtctttaanaaaagngactcgngtttnanataacnctccctcngtgngngnggnaatncgctaccctattgtactatcaaactgtatacttattccttctaactgttgggtaattgtacccataccaattcctaatgagtactgtacccattagtaatggatactataactaatctcatatgcatccaatacccatccaatatcgaatgggtgttatacccattacccaacctctcttcatctccccaccgcccccgaacacacacacactccccactctggtatctatcattctattctctacctccatggatccatttcttttagctcccacacatgagagagaataagtgatatttgtctttctgtgcctggcttatttcacttacatcgtgacctccagtttggtggcagctttttgaaagcttccaggcactctgtgatgcccctgatggggcggccaggacctgctttctacctgggacaggacactggcctcaccctcactggggcatgggggcagctgccccatgagaagggttctttttgctcattagagcaaatgttggcattataaacacaaacccgtgccatgaggcaaaccctgctccttcaaggaagtcttgaggcttaaaagtcttaagtgactttgcagggcttttgaaggctgagaaagctttcattttctggaaggaatgggagaatagttctttattggtgttgctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactttgngttnnnnttaaaccnccccctggggtggnggnnggaaatatccctnccggncaggnaaacatgggcccgaattacgtcagtaccaggggaaggcagactcaagatgatcttatccagcgttctgactgccagtcagagggacagagaatgtcgtccgggggagccttcgattctgacctaggtgatgggtgcccttgagaacgcaaggataagaacaacgttgaatggaaaacctggcttataaactcttgagcttgaggggtgtgaacaggacctctgagcctctccaaacagaacggaacttaggccaaagcagtattcacaccgcgagcagctcccgtcgtcactttggacgcagtagcacgcagtggtagaggcatcagacatggggaagggagtgacatggtacatgtgcgttctgacgtggattttactagggctgtgtgtgttcagcccaaaagaacaagagcaataaccagtgcaggcagttccacccacattctactcagccagagcaggggctggcctggaggcctggctctacaggagcctctgcaggctggggtacacacgcctcttgtggtgtgagcatgacaccagcggagatgtgtgcataacattgntgtgtgtncacagaacacactccccaaatataagccaactactccatctggtgctcagccagaggaagaatcttttctaaggctggcagagaaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactggggnnaataacctcctcctgtggtnggaattcagctggnatgcagtggcgcgatctctgctcactgcagactccacctcctgggttcctgccattctcctgcctcagcctcccgagtagctgggactacaggcgcccaccactgcgcccagctaatttttttgtattttttagtagagatggggtttcaccgtgttagccaggacggtctcgatctcctgacctcgtgatcctgccggcttagcctcccaaagtgctgggattacaggcgtgagccaccgcacccggcccattgaaggattcttaaatagcacagtggtgtgaggtctgatgtgtgtttgaaataaaatcactctaggagctgcatggaagggggaattagcaaggttcccagtcttgtccattctgaaatctgtcctcttcatcaagtgacaaaatcaagctttggctaagtgtcatagcagtactgtatatctcaagcagaactgatttcatcattgtttatattcagaaactggcaattggatttttgcgtccagaactgaatttttttaagacaaattaaaaatttttaaggaaaaatatcagcctttatgacccttcagtgtcatcaggttggattcagtatgcgtgatttagtgtagttactcacccagtgccatcaatacttcaaaccaagcctctgggataaaaagctcactgagagagacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggntatatccnctctcgtgtnggtggaatatcttcctttctcccttgtgcttttggtatcatagctaagaaaagttgtttaatccaaagtcatgaagatttatgcctatgttttcctctatgagatttatagttttatctcttaatttgggggctgtgttccatttggtgttaatgtttgtataatacggtataagatgggcatccaacttcattcttttgcgtgtggaattctaattgtctctcaccatttactgaaaggatgatcgtttcccccatggacttgtcattgcttccttgtggaaagttaactgaccataaataagagtctataatctgggctctccattcattccagtgagcagctatatgtctgtattcatgctagcacctcactgttttgattgctatagctttataagctttggaattgagaactatgagtcctccaacttggctgttcttttacaagatcatgttggctgttctggggtccttgcgtcctgacctacaagttcctgctctagcactgctccctatagcccctgcatccaagcccctgagtttccgagtctctgcctatttccagtgcttgtttcccatccttttccccaattctgcgagctcccttttagttcctttcattgtcactggccagagttcatttctgttgcttgcaaccaatgtatggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattggtttataaaccctcctcctgtnggtggatacgcggctggggacatggagaaggtaaggaaggtgacagcgcccaggacaggctgagccttggggcccatgcggagatcataggaggattttctatcgagtgccaggatccagtgtagatgatctacatgagctaaagtaaaacagatattggaatgaaacaccatcgttttggatggaacaatgaaaattcatgaagatgtccatttttcccaaatcaacatacaggtttctgacatgaccaattacaacagaacttttcttggagcttaacggtggtgtcacagtagcattaacagtaacagctatcctttaaagagtgtccagggtgcaacagatatggtgttcagcatttctttaaattttatctcattttatcttcataacaaccctatggacaattatttccatttttatagtagttttattatatatatcatacaattcactcatcaagggtataatttaaggtataaaacaaatgacttagtatattcagagttgtgcaatcatcaccactattttagaacattttcatcaccctcaaaaggaaccacgtacacattaaaagtcacttctcatttcaactcaatctgcctagccctaagcaatcactaatctaattcctgtccctatcggttagcctactctggacatttcatatcactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacactacttcctgtggtggaattcggtgtgagatggtatttcattgtggttttgatttgcatttctctaatgatcagtgatgttgagctttttcatgtatgtttcctggacacataaatttcttcttttgagaagtgtctgttcttgccctttgcccactttttaatgtttttttttcttgtaaatttgcttaagttccttgtagattctggatattagacttttgtaagatgggtagattgcaaaaattttctcccattctgcaggttgtctgttcactctgatgatagtttctcttgctgtgcagaaattctttagtttaattagatcccatttgtcaatttttgcttttgttgcaactgagaagcccgctcttaatgagcaccaaagtcatctgtaatcaccagcactgcaaatggtttgtgcctaagctgggaagccgggcttggattccagccctggcatgatttcgctgttctttctgaacaagtcatttaacatttcttaactcctcattctttgaaaaggtagctataccatctgttgtagatcagttctgctttcctaattttactagttttgatgggcataataaatcgcagggttaatttccttaaatctttattgggtcaaattacaatatctctggattgatattttattggtaccaagaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattggggaantaaacccccctggnggnggnnggaaaacccagctctggggtgccttcttccgctcctgggaactctaaagctgtggtagtttctttgcagggcttctgtgaatgtgcaaaatagagaacagggccagcacatagtacacactcagttaaagtgaactgttgacatcattgccgcatttagtaagaaaatctatgaatacagatatatagagatagatgtaaatatagatgtggatatatagatacagatatagataatagaatatgtttcaaagcaggccactagaagaggggccagttgctttccaaagctgggggagactgaggcaggcactcagacagcaccgaaccttcaaggatcttatggataagccattctgtgctactagtgaaatagtcatgatatataactatttttttgagacagggtcttgctctattgcccaggctggagtgcagtggcacagtggtagttcactgagacagggtcttgctctgttgcccaggctggagtgcagtggcacagtggtagttcactgagacagggtcttgctctgttgcccaggctggagtgcagaggcgcagtggtagttcactgagacagggtcttgctctgttgcccaggctggagtgcagtggcgcaatggtagttcactggagcctcaatctccatgctcaagcgatcctcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacagccactgnggtgtnggtggaaattacttatgataggttctactattatgtcattatgattgtaaagtagggaaggggaaaaatgacatgcatgtgaacaataattagttcagcgatttcactgattattaggcatttatatccttggctattttaaaaacaagttgaaagtacatatctagttcacaggaaacattctgaagacagcagcacattgtggggtatcgagtgctaggatgagtttcttctgccccgttgagttttcatacagccacattgcaatgagttggcaaagacagatttagtgataaacaatacatctgtgttgccataagcctaagaaatgaattggcttcttctaatgtgttcattattttagcccttcatgtcacactttagatcccacaggcagatagctattatgttatctgggtaatggaaacacccaaggtgggaaaattattttgctgggcactataaaaagggaagagaagaatctgggaatataaattggagaacatggcaatgagttacaagctggattcaggcncaggcgtggtggctcacacctgtaatcccagcactttgggaggccgaggcaggcggatcacaagtcaggagattgagaacatcttggccgacacaatgaaaccccatctctactaaaaatacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggtnnnataacncccctgggtgnggtggaatactatagtggggtctctggacacctgcaacttttccacaattatcacatttaccaatttttcacggttctaaagacattaaattcaactttcactttgaggcagagctgagacctgctaagaatgagcttttcatgacttaactaactgactagccaccaaaatccataaataaattaatattttccagtcgtatgattagacttccttatattccttaatgctaggacaaccttaagcaacttctaccattgaaatgtttgtctctggcctccttttgaaggtcacactgttctgtgtttcttgtcttctcatgcttagaaatcgaacaggttaaggaacctgggctgcttgcccagaacaatgttaacaacaattattagctctaagaactaaaaggaaaataaaatggttttcattcataatatgttaatgaggctaaatccagaatgagaccgtgtgccacaaaggtaagacaaatgacttgagtgatctgcgttagtttaaattacggttccagggacttgtgtattgtcattaaagcttacactcatcacatttgtaagcaatgtttaaaggtgttcccgggatttacaataattcattaattttaagccttctctttgcaaacattcctgagaattcctataaatatgtagatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaacctcggtggggtgggaattcacccatttcactagctttaaaaatgtattatcagtagaacatggtaataatcttgaattttggccaaaatcaaagcactgcagcattttccttttaggtgcacattatcttggtttgttcttactttctagaagactgtggacagagccattcattagcttctacctttatttgactgaaagagtagattaataccagaaattctcaaatagtaagggaaagcatagagaacttatttttaaaaaactactactgttgtgtagaaaaatacgattaattttatgtttcatctccacaggccgaacttacattttgcacaggagatattattacagtttttggtgaaattgatgaagatggattttattatgtaagtttttgaaatatcaagaagtaccatttgatttttgtattttcatttattttgtgtgttttgttttgctagtccgttccttctcttaaaattgggcatgaacgtcatacgcctgctgatagctttgcttaattggctgagttatagaactttgctgagttatagataatctagaaagttgggactgtgaacttcattgtttcttccttgctaatactagtgttttcaatgtatatgcactgtaaacaaaacaaatacattcatattcttattttttaaattgctgccacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcatgnggtggaattcctttaccaattttaatacattttacttttgttcttatattttttataaacattaattttttcaactaatttggtcaaacataattaataaagcccatggtttcctggtgtctgaacagaggtttccaagtacagtttttcattgggggaaagaggattattttctgtggtattaactacacatagggagattaagcattgcttctgtagattgcttttatattttttacgtacataacctatccacagattgttttctagtaaaaagtgtttagatttgtaatacacttagttgtctaaaggtcaagaagttttatctgagacagaggtgcttatgagaaaagtggcttctgagccgagctgcactcaccgaccgcaagaaaagcagaatgccagccggagcttacagcgggcaccggcaggcacagggaaatggccttagtagcacgggaggattccgtgagaaagtcaggaaacttggctccttttttgggacagagtcactgtgttccccaggctggagtgcagtagcacaatctcggctcgctgtaacctctgcctcctgcgttcaaggaattctcatgccgtagcctcctgaatagccggaattacaggcatgcaccaccatgccgagctaattttntgtgtttttagtagagacgaagtttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttactgnggnggaattcggaccaggataaggaacaaanaggagggaggcggcagggaaggaaagagctcccttttggacttgctgagttatccagagatgtctgagagaagatgtacagttctcagctggatacatgactttggagctcagagtcgtatgagtccatgagttgagagtcatcctcaatgactggtgtctggggctgtggaaggagaccacatcgtcccgtttgctatagtaagaaccaaagaggaccctttggcacctgttgtttaaaggttaacagaagaacactcaaagaacactgagatggggagagtgtcaaataagtcaacaagataaaaatggtggaactgtgaagatagacaatgttagcagataggtgaaagaaatgagtcagcaaaataaactaggaatgagtagccagagaggtgagaagaaaaccaagagtgtgtgatgccaaacaaaaactcaaaaacagagcaccttaaaaagaagaatggttccgatacgacagcgtgaccaggaagaacagggactaaagattgtccattgggttcagtgatgggagaggatggttggnggaggaagccanaggttcactaacagaggcgggttgagtgaagactggtaagagagggagccgaggcgggaatctacacagcgtcttcaaggagtgaactgcgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaatgctcactgtnnggtggaattcaattctaccaaaaatttttggatttatcctaagatctaactacttcatagtgaaaaagataacactactagcatcctgccttcgtgtagtattctaagaagctgacttcaagttgcttttaaagctgtgtgtaaataacgtgtattaacacgtgtagttataattttacctgccctttccattagggctaatgtttgttgactgctcactagaggccagtgtgagttctcatttgatcttcaccattgacttgtgcagtaggttattccaaccattcgacaaagagtcacacgctatgttgttttctcatgttgtctaaaatgtgaaggagttgggttcaggcagttgagctctgaggcctctacccttaatagcctgatgacattgtgtaccaccacgatgagggtgagagattgttacagctgagcccaaagctgatcccagctcacaggaagcacttagtaccatcatgatgttgaagaaatggagagaacggtcctggcagatgtaggagaaataaaggagtggttttgaaatcaatgactccattctttttatttagatataacgtatatggtgatgccactcaccaagaatgaaattatgggacatgaggtagaagagatactagtttgggtatgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcctgtggtggaattctgctgtcctccctggccttttcctccttttgctatttcataatttacatcagcccccattaagtcactgaagacttctaacaccccatcgtgttttaaagcgtgtgctgttcttgctatagcccagcatctcggtatctgaaaccttaaatcctgtaccttcctatgtcaaaagcaagccatcacgtggcgtactaaggtacgggagataatccagaggagtgtgcaaacacgagtggatgtctcactgactggggcacagagaaaactgggaggggatcgattttggtgttttctgcctttcagcctattcccattctgtctggacattaggcctccaggtagttactgtttggccgcaaacagagaaatggtgggaaatgaggcgtaggagagaagcagagatcaaattatggagggactgaggagggaaaggtcaaggtgaaatttttttagagaaagttattctgtaaagggttttgatggtacacttttgaagggggatgggagtgggtccaggaggctgggaaacatgctatatggaaccctccaggcaggaaacatggcccgaaatacgtcagtaccaggggaaggcagactcaagatgatcttatccagcgttctgactgccagtcagagggacagagaatgtcgtccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactggtgtattaaccnccctcgtggngggaaacccgtcatgcttggtgggaactgggtatgaggattgaagactgtcatgcttggtgggaattgggatgaggattgaagaactgtcaaggaacatttaggtttattcaatgtggtttgaatttcaataagaaaaaaatttgtacaattcttttatttgacaaatgtgtgagtgtctgctatgtgccaaataaattttaaaagaatgaagaaaaaaggcattatttatagataccagtaccaggtacaaatgaagtcaactgccaaacttacattaaagtaagtctatctcaccctacagcgaattaaacagctaaggaagatacttttttccaaatactattccaaatattatttagtaaacactgcaagtcagaatacaaatcaagaactttggcagccttttttgacaattacattttcaaccatgcatgaagcacatcgaagagtaggaagtgttaagtcctcaccagatggttctcccccatcagtggactttgaaatccagttgtacaaacatcttctctttgaatgatacttaagaaagcaaaacagcaagccagaaactggaaggaaatattcacagtgcatgtctacaacaaaagatttgtatccagaatacataaacaacttttacaactcaataaaatacttttaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggggnaaaaaccccctgggggggnnggaataccacgttcgcaccaccatgcctggctaatttttgtatttttagtagagatggggtttcattgtgtcggccaagatgttctcaatctcctgacttgtgatccgcctgcctcggcctcccaaagtgctgggattacaggtgtgagccaccacgcctggcctgaatccagcttgtaactcattgccatgttctccaatttatattcccagattcttctcttccctttttatagtgcccagcaaaataattttcccaccttgggtgtttccattacccagataacataatagctatctgcctgtgggatctaaagtgtgacatgaagggctaaaataatgaacacattagaagaagccaattcatttcttaggcttatggcaacacagatgtattgtttatcactaaatctgtctttgccaactcattgcaatgtggctgtatgaaaactcaacggggcagaagaaactcatcctagcactcgataccccacaatgtgctgctgtcttcagaatgtttcctgtgaactagatatgtactttcaacttgtttttaaaatagccaaggatataaatgcctaataatcagtgaaatcgctgaactaattattgttcacatgcatgtcatttttcccttcctactttacaatcataatgacataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttggggnnantaaccnctcctcggtggggtggaaaacaagttcttacaaagaaaatgtttatttaattcactgttattttatttttaatctttaattagtggtgtattttattatgtgcctaatactgtggcatgttgcaaataggtatagtggcatactgcaactaaatataaatatattggatgctcatgctcaaaactttctgttctggttgcatgatcagaagtatttggggattgctaggctgccaggtcaaacccacgttctgtggtgtggcttggcccccctccatcggcctgtccgactttgctcctttcccaggctctccccaaatctggattccaagctcctgccatagagagcttcgaaattcagctcctgggcgcttcctccatgaggttttctttccttcatttccctctctgtggatcagcatccctgcagtgagggcctctcctctgtggttttaccttaccagcctttctatgtctctccaatagcatttatcacaccacaattgtaagtaaacacgtacttaacccgtttccttcattattgggaaaacacgttgaggacagaatcctggtcttactcaacattgcgtctggttcctggcattccgagggtctcaggaaatatttcttgaatacttgaacgtacataatagtgttcagctttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctaaaatgnggnggaattcgaattccaccatcctgagttgatttttgtgtctggtttgaggtaggaatctcacttatttctgtggatatccagttgtcctagaaacatntcactgaaaagactattattttccccagtgagttttcttggcacctttcttaaaaatcaataggccataaatatgagggtttatttctggactctcaattccatcccattgatctccatgtgtatccttgtgctattacaatgctgtgttgattactgtaacagtgtaccaagttttcaattcagaaagtttttttttaaaatttgtttagactattcttggtctcttgcatttcaatgtgaattttaggatcatcttattaatttctgcaaagaagccaactgtaacattgatagagattaccttgaagctgtagatcaatttggggagtattgccatctcaacaatattaagccttcccaaccatgaacatgagatattctttccatttatctaggtctttaaatgatattctagacagtgtacataccttgtacttctcttacatttattgctaggtatttaatgccttttgatgctattgtcaatgtacttgttttcttaattccatttttggattgttcattgctagtgtgtagagatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggtnnnaaanacncccttccggnggnggaatnccccgattgaaagacatattatgtttctttcttccaaaagctaagtgtacatctaaacaaaaaatataggtttgttgtggaggtgggactctttacaaaatgttccctcccaaacataaaaatgcattataaaaatacaataattaagacagcatggagtagtgttaaagtccataaatactctaagtattaaattcctatgtacactttaattttaaaacgtattcattttttattattaaaaaatgatttttttaaagtagggaaagtgcagattatttagtaaatgtgttgagacatttgttctcatagttaggaaaaaatggtagatacttgagatttacatgtggaaagtgaaactataaaattgaaacaaaatgaggtgattatttctatcaccttgaaggaccttttaggcatgacccccaaggcagaaacatttgaccgcatgcaaacgtgaaattcatccttaataaacaacaaaaatggagaagcaaacacacacacacacagttaaaaagcagaggttgagctggaaagaactatttgaaacacatgtgacaaagtatgaatatcctcaccaaaggcaaatcagaaaccaggcagaggagagagcctgngaatcctacacatgcctgcggctgtagcatgtttgacttgaagagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactggggnanaaaccccccctgnggggggnggnaaaacccgngggtgatattacaatattaggaccggtggagtatttgaattcgctctctcgagatgtttaaggttacagatatcaaaacaaagtaccaagaaatttaagatttttggtatcaaattaggtgtcccctgtcattgtttatcaaataagaaatacttaaatgaactgggcagtccgctcagtgaacatgaccagcaaaatcatagtaaaaccatttggaggagtggtaaataaaaagaagcatacatttcatattaatttagatctgattcccactataatataaaaacttagggaagactattcaagaaactaagaagacaaaacataactggggaatagaaacatgcagacaaattagaaaaatcttcttaaattccaggaaagcccattgtttctacatgtgaaaatctaaatgaaaagtacattcctctgaagatatgtagattgttaaaaactgataagataaccatttaagcaaataaaaacttttgtgcaactgcagtctaaaaagatactgaacctaaaggatctctctctgggcagattctaataaccttcaaataatagtaattgctgtgtcacttaatctcctctaaagcatagaaaaaaggttgaaattttcttagtttatttggtaattctagcataatcccggtatcaaaagctacaacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttgtgtnataaacccccctcggtgnggtggaaatacctcaatgctgcactcatccttgcttttcanatgaagaaactgagacttgcatggattaaggaacttgttcaagggcaccacacacttagaatcaacagcttgtgagtccagttctctttggagcctcaatgcatgttcttaatagctaaatgattaataaatgattaagcccaaagaccccgtccacgtgtttgtatttctctacctaaatcaatacacatatatttcagtgcatagtaaattgatgcattgcgatcatgttgacacaattctctatagtcgatgagtctgtttgagtctatcaatataatgatatgatatttgtagattcatataaagtaattcatgtggctgacatgtattctttggttctaaagacagatggctagatttttggtttggtgtagtttaaaaatacacccttgatgagtgtaataccataatgaagaaggcacctcattgtttgaaagtcaaggttattaatgtatgcaaatataccaattttacagatatatatctaacttttttttttacatttacatttgggatcttagaatatttcccgaatgtagcctcattctcataattattcttttcatttggattaggtttatttcttctctatgccaatccgttttgttcctcaaggagatctgacatatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaaccttggtggggtgggaattcaattgtagatgaatcatgagtaaattaagactgtgggaaatctttaatctgtctacctgtcacttgtcactaaatttttctgtgctggttacatagagcatatttaagttctcaagtttaaacagtattcagttttgactcatagtttgcttaacatgatttatttccttcacgtgcaattatcatttagttgaacatgatgagcagtatttgttaatgtcctactgattagctgtgtggctgaaatgaatagtaaaataaatgatcatgttcttgacattgatacttcacaggtgagtttagtttcctgtcctctcccttgctcttaatcatctgtctcctaattctttgtaacaagggcactttgttttcaggttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccgtgagtttgatttaattggtagatgccgttttaaaattggtatttaagaacatggatttactttntaaatgttgctggtactccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcttggnantaaaccccctctgtgtggtnggaatatctcgccctgcacatattctatgaccatgacacgcatctcatactggtataggtaataaggtcgtgattaatcagttcatgcttagtgctacaagctgtggttataagaacctaaattattcaagtcatttgatttgctgaaattatacaattatctcagatcaacaatctgatgtgagccaaaaaacaaatatgaactttgtagtcaagcattaaaattccagctgtcaattaataggcatgttatcttgtgtaaaagagattaccagttgactatccaataactaacccctcattctttaaataaattctatttttggagtaatatacttaatagactaaaatttccaccctccccatggttagggatggcctaagatacttaagcagaaattgcaggatgacacttttggaaaaattccataagagagccaatagctgacatgtgacttttgtacttcctgaccctttgccctgcccatggagcctggaatctggatctggcagggagggctcaaatacagaagttctgaaccaaacagaggtcttaatgatggcagtcatgagcccaggacaaaagaacaaaaagatcagagtccagttctcttctgaccacaaacaccagaactgcctactctctagacttccttagagaaataacagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacctgggtanntaaacncccctgcgtgnggtggaaattcggacctcccgcactacccacgcggtcgcggggcgcgatctctgcggggggcgagggccccttcccgcgtccgccgccgctgcgctgcgcccccgggagccttgggagccggacgttgggaagaggacggaactccggaggaccccaagtgaggcggcgaccgcgacggccgggctctgcgaggcccgggggtcctcgcgggtgctggcggcccggcccttggcacctgtggagggaaaggggcggcggggcggtggcgtcctgggatggatgctctcgccgtcttcagccccggcggcctccagggcaaagccggctgcacccctgcgcagcctgttctctgagcgcttttcttttcgtttttaagttgtggccagagagaccccgctcgcatagaatgtaccgctcaacggtttttaggcgtgtggcgcggtggtggttcccacgtgcacggcgtggtcctgagctcagcgccggagggacgttaggtggaagcgtctttggcagagctggtagcgaatcggagaggtgatttccagcgagtgtggttattggaagcacacacttgctttctgactttaagaattcaatatccagactgaggtggttttgaaactggaaggagataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggnggntataatccntcctgggtgtggtggaaaaacccancttgtgagaaactctttagagtacagacaatggcagaacgcagctctatttatttacttggggaatatagaaggaaatgtcaatatttatgtcaggcaaacatgagccatcaggaaggtagagaaatcattattacttccccttgttcatggcacatgggccatgtcccataaatgtacaagcagactctcacctcaggttctgccagtgctttcccttttgtctgaactgtttctccctgggtgttagtgtggctcattctctcactacctctggatctcagtgcatgctggttactgacctgtcacctctcagctccaaacctaccctccaatgctctgctcagcattcctgggctggcctctgcagagaatgcttctcctctgccaaccagttatgttgggcaggggctcggtgctagagagaaaacacgaggttcaagaagggcctccttctacctctttgcttgctgtccctgttgcagccaccccagcaatagcactgtccagccagggacacttcaccccaacatcagcagtgaatccagcttccagcttctttagcactcccagaagcagcttctgatagaacagaagtggggctcctcctcaagctcgttaggttcctgcattcactggatagcaccccctcttcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacacatttcctgtggtggattctctatgcccacctgagactgtgcacctggcattccgcttggcctgcttcctcccagcctctcatctccccatccgtccagtcatccatcaatccttcttggtcttttgctgccaggagcctaattggagctgtcggcggctctgtctctgggaggggacacgatgatacatctccattgggcctgtctgaagagcatatggaggacacacaccctggctgccggaagagggcactgtactctcccagcagcagaagagcagacccttcaaggattggatgctcctccctgtcttgacagtggccttttcctcattaggctcctccaccaagattcgtacccagcttacaatactgcaatatagatcttatcatccagccagaaagaaaccaggtatgccctgggtcctaggcagacatcgctttagaacctctatgctctgtaaaaaggggcctcttttatatacatggaacatacatcaagtgtacaaatctttttttttttttagatgtaaaaaaataaagaggctggagtgcagtggtgcgatcttggctcactgcaacctcctcctcccgggttcaagcaattctcctgcctcagcctcctgagtagctgggattacaggtgcccaccaccacacctggctaatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccactcctcggtgnggtnggaattcttcatttctttttagttttcaaaatgtcctccttttcaacttctgtaactattaaaagattctgttgtgtttattcactcttgtttttcttttagtttacttttcattactgaaagaaaagtcttttatttataattctttcctgaattatatcatctcatttctgactttttctaattctgagttatatttttctttttcatcttgcactttttaaaaaaaaaaaaagagcaacattttcttctgatcgatgcatatgtttttctggtgtgctctccctctctgtaggtatgtttttctgcttctagcttattttatgtgattatgtgtatgggtttatatctcagttgcttctgtcgtttatctcacatggagttggtttttctagaattggataaggaggcatgtttccaagctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacttggtaaaaaaacactcctcctgnggnnggaatctccctgccaaaaaaacaagtgattctttcgattcagaatgaccctcccattctcatcctgacctgtaaaggcacaattttcattgaacaacaaacaactatacctaaattcttaatttcattttctgttatgactttcctatgtatattcaaaatgagaaacttttgccaaatttcgttttgcagttacttctcatgcacataaacatttttctatcctctcgctaacacttttcaaataaactatttgcttaaactagaacacaaaactcctgtgttccaccaagtgagctttactgtattttcttattcttgaaaattatttaaagctgcactcagaaaaaaaaaaaaaatgcaaaaatccccaaccttccagaaatttctacggtacttttttctgtggccccgaggtagaggcagtctggcagtgacgaactgggttcttgggaaaagttctgctaaataaagcttgtttgcaggtatattggaagcttttgggaaaagaaagaaaactacattgaaagcctcattcatattaaaagaaaaaagatatacttctaaacatttttaattttgaaaagaaaaccgttttatgtgaagtgctctttcatatgggtaaagaaaaaatacctagctatcccctggctggctccgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggactgggggnantaanccncccctggggggggnggaaaaacctgcgcttccttgtnaatataactgttaattaaaaagagaattaacataaactttcacaaatgtttaccaaaaaaagaataggaaggactatttcccaagttttttaatgaggctagtattaccatgacagtaaaaccagtcaaatattttacaagaaaactgtagaccaatattcctatgaatacaggtgcaaaaatcctcaacaaaatattagcaagctgaattcagaaacatataaaaaagatcacacaccatgaccaagtggaatttatccaaggaatgaaaggttgatttaacatctacaaatcgactaatgtaatacattgtatgaatagattaaagtacccaaatcacatggtcatttctatgaagaaaaagtatttgacaaaattcaacattctttcatgataaaaaacactcaacaaactagcattggaagggaacttcttcaatctcaaaaaggaaatctataaaaaaaatccacagctaatatcatactcagtggcaaaagactgaatgttctcttcttaagatctagaaggagagaaagttgtctgctctcaccattcctattcaacaatgtcctagaggttctagccaggctaattaggcaagaaagttgaacaaaaggcatccagattggaaagacagtagtaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggggntaaaaccntcctgggtgtggtggaaaacccactttttcccttacatgagttgtcttttcttgatggtgtcctttgaagtgcataagtttttaactttgacgttgtccaacttatctttttcttttgtttcatacgctttttgttgcatatctaagaaggcattgccgactcaaagtcatgaagatttacccttctgttttctactaagagttgtattgctttagttcttacatttaggtctttgatccatcctgagttgatttttgtgtctggtttgaggtaggaatctcacttatttctgtggatatccagttgtcctagaaacattcactgaaaagactattattttccccagtgagttttcttggcacctttcttaaaaatcaataggccataaatatgagggtttatttctggactctcaattccatcccattgatctccatgtgtatccttgtgctattacaatgctgtgttgattactgtaacagtgtaccaagttttcaattcagaaagtttttttttaaaatttgtttagactattcttggtctcttgcatttcaatgtgaattttaggatcatcttattaatttctgcaaagaagccaactgtaacattgatagagattaccttgaagctgtagatcaatttgggggagtattgccatctcaacaatattaagccttcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggnantaacccccncttggggggnggaaaaaacctctntntnttntntatcatagatagatagatagatagatagatctcctgtatctttccactcagatctaggatcagccatttctcagtaaagtcccattttgtttatttgtctttgtttgttcattttagttggggaacagatttcaagatcacagtatggaggctggcattgcccatatctgtttgtctcttgtgaattctaggccttttcaggggacagagctaaacaatatatgtttccatatctaaagctgtaacaaaaaaaaatctcccaggttcatactgttccttccagtttcacttgggccctacaagtttttcaacttgatatttcctgttttatactagtttgggtggttttccatgctagcaatcctggttctcaagaccacagagcttgatagaatcctagataaagcagcttcatataattattcatttgctgcattccaccaccacacacatagctgtctcagaataacaataccaatactacttccactgaaaatagtaagaaatcaaaacaaaacaaaacgtgtgcagatgtttccccaccagctttccttttgcaggtagtcttcctctatttcccttgtcagggcacacagtgattccacaccaaactttccttactatggcactgaattagacttatctacaaataacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctgggnataanccntcgtcggtgtggtgggaatcacgacgtcctttgngaagagcatggtaggtcttctactccatctcctagactgagaactgaaattgtgctgtgacaaatcagcacttgagccaggaagtccaagaaaaccaaccctgggcctgcagtcttgccagggtgaccctcgctgtcagagtctggtttaaatctactgtcctgggttgtcttgttgcttggacttagactcaatattggcttaaataattattttttgtctccgctttggtttgctattttcctagatcagtattgcttttcaaatggctgtatattgttgagactttttttttaaaactgcattcatcagcagtgagaagctttaaagttttattagtatcataaaaacccttcccaaatgaaactacttttgatgaatgtggttggatttttctgaagccgtagaattccaaaggctgcatgcgtgtcttaatttcagtagcacacttgttaaattgggtgaaagagcaaatctatgtcaacaccttaacaaggaaaaagcctctgaacataactcagaaaagagttaactgacaaacctatgataggtttgctttaattgtgctgacttcttatcatgtagcaagccgggacaccacataaaataactctaaccagatactntacacacaaatacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacttggntataaaacctcctctttgtggtggnaataaacctcacctgtgaagtatcaatgtcaagaacatgatcatttattttactattcatttcagccacacagctaatcagtaggacattaacaaatactgctcatcatgttcaactaaatgataattgcacgtgaaggaaataaatcatgttaagcaaactatgagtcaaaactgaatactgtttaaacttgagaacttaaatatgctctatgtaaccagcacagaaaaatttagtgacaagtgacaggtagacagattaaagatttcccacagtcttaatttactcatgattcatctacaattgtaacttgtaagctttaaagctctggattgagaatctgatcaaactatgaacttccacaggaggtccatggacaattctggggacaaaacagagcgcctgatctcaacatgcccctgccccaattctgggcatccaagtttaactttctggagtttggtttgttttgtttttgagatggagttttgctcttgttgcccaggctggaatgncagtggtgtgatctcggctcactgcaacctccgcctcccaggttcaactgattctcctgcctcagcccccagagtagctgggactacaggttcgcaccaccatgcctggctaatttttgtatttttagtagagatggggtttcattgtgtcggccaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacaacctttgggggggnggaatacctggattctaccgtggggaaacctgtgcccggcttggccttattccttgtaacatggtctctgagatacaagcagatgatgaggagatgatggatcagcttcttagacagggctttctccctctgatacacctgtggagaaaataggtaagcgcaaacccctattcgaccttccctgtgcattttatcccacaaaacacctgccgctcagagaggcaggcggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagatgatctaatgggcgatgaagtaccgtcttgcttgcaaacaatttatcgcatctagaaaacacatgattagctgctttctggtaatacggtttgaacatcagcctgtctacaataaatttcagtgggtggnttggggggccgctatgcctttcattctttaggtgacctttgcttatccaagaggcacaagctcttttctctttagtttgggtagacatgaaactccttcatttatcttaagccagtctgcaagcaccagtgagaatgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttggtgnantaaccnctcctggggggggnggaaaaacccacctgtttgagaggagagaaagatacaacaaaaagaagggtgaaagggagggaggggaagaggagcagaaagagagggaacaaaccaaacaaggtctatgacaaatgacttcagagtaaggggtaggaaacaagacatgagatccttgagtcagagacagaagatgtggtcagaagcaaaaagagtataactggtacccattgcccaagctctaattccaaaggagcaaagtgaacgggaccagtgatgccacacacacacaggtggctgaattggagcaggggaaacctgggctgagggaccccggagtcctttataatgggcagtaaccttgtctgacttttgccctgaagcaagatattatttttatgacgctggcctgtaagcatgcctgccctctgctctgaagggagacaccatctctaccttctggggcagtctgctgtacaaacaacctcacaaacatcatctggacaaaggtagtcagtactgcttctcaccagacaggtagaaacacaagacagtggaccactgtctcacagcactattttcaaatgtattacattccaaaacctggaaatgaagacatcagaaaagattaaaatacctattctatctgcagtactaagagtacgaagctgagtaacagaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatagtgtaaaanngacctcgcttaantancctcgtcgtggggnggnaatacccccagaacctccttcggcccgcgccttcctcgccttcggcgctgggttcccgagagagccagggacacgcgggcagcgagcaacaggcgctcttttcccgggcggatgaacaccgcctcccgggcgccggcctcgtgtctgtacgccatacgcccagtaacggcggaaagcggcgcgcgccacgccctcattggctgcccagcggacggcggtttctgatgtggccggggcgggaccanaggagccccgccccacaggccccggccccgcccctcccngaccccgtctggcccctcccgggcgcccggcccgggccgcgcttgcctggcccgccccgtcctcccgcttccccccttctggtcccccgtgctttttctgtggcctcgccccctccccctcgtttcttttctgccttccctgcctcttctgctgtccccccctggcttccgcttttttgttgggctccctccttttcccccttgcccccttttcttgcctccttctcttttgtgtcgcgtttccgcctgcgctgggcccgtgtctttcccctccgttgcgcttcttcctttcgttcccttctctgctttcttcccccgtgcccgtgtccccccttcccctgctcctccccgttcctccctccctccccttttcttccccccttctaaacaaaaaaaaaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatcttcctgtggtggaattcgccctacanatgaactgcaagagggaggagagctctggagggtggacatccccgtgagtttgatttaattggtagatgccgttttaaaattggtatttaagaacatggatttactttttaaatgttgctggtactccattgtatctaaaattaccatatttgtattgaagctgaagctcgtgatgatcgttggcatcgattgttaccatgacatgacagctgggcggaggtcaatcgcaggatttgttgccagcatcaatgaagggatgacccggtgagtgagactgggctactgtgggtggcagtgaggacataaagcagggttctggaggttcaggagtagtgttcattcttcgttgttatccttccagtttctcaatcatatacagcaacgaatttaggaaagaaaaataatgacctaccctagctcttgaatgactttcatcctgtattcgtcaaactgcatttcagattttttttaatcacatgtattggcgagtacatcttgttaaatgtgactctctctaaaaatgtatttgtttaataatatttactggccactgaaatgtagtttcacattttgatgtanaaaaaccacttcagtttacccagtcacttgtatttcaacataatagcattatttttcagtgcttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaacgctgggtgngngnnggaattccatatacacaaacacacacatacacatatgcacatatacacatacacatacacacacacacacgcacagttgtgataaaaatgcttttctgaccataagctgcactccaaaatgtttggaaaatgctgttttgaaggaagagtgagaaggacaggaattgggatgggcgcagggacaaaaggcaccgtgtgtagagtggacaggccacaggctgtggggcagcagacaggaggctggcacagccagggccacagaggaagggaagcctctgccaggccagcactgcaatcccaggtggcctgaactcctcacagcagcagggccgggtgatgggaaacagcaggaagagccacaaggaggggccatccaggaaggaggaagggcagggctgtgcagacatgcaaaggaggccgatcagaaacagtggggcaaacccagggggtgagcagccaagacctcagagccctggcagcggaggagctggtcactgagtcgatggagctgcctgagaacacaggaggtgaagacagtgtgtgagagatggtcatggagctcgggggcttgagatgccgaggcccctttctctttgaacagagaaacaggtcctgaaacctaaatctccacctcccccatctccatggaactagctgaaatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatcttcctgtggtggaattcttgattcctgtccctgctattgtgaacagtgctgcgatcaccatattgagtgcctgtgtctttttggtgaaacgacttcttttcctttgggtatatacccagtaatggcactggtgtgtcaaatggtagttctaagttctccaagaaatctccaaactgctttccacagtggctgaactaatttccgttccctccaatggtatatacatttttaagtgtttcttttctttgcagtcaccccaacgtctattttttgactttttaatcgtcattctgactggtgtgagatggtatctcattgtgattttgtcttggatttctctaatgattagtgatgtggagcatttttatttatttttatacattttttaaatatattttttatttatattttattatctgcttgtatgtgatcttttgagaagtctattcatgtcctttgctctttttaatggagtcattttttgcttgttgatttaagttccttgcagattccggacactagacctttgtcagatgcacaatttgcaaatattttctcccattctgtaggggtgttgttcactctgttgatagtttcttttgctgtgcagaagttctttaattaggtcatgcatgttaatttttgtttgtgtggcaattgtttttgtggtcttagtcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggtgnnaaaaaccccccctcgtggggnnggaatctctcccctaccttcttgagggcgtctgcttcccttctctcctcacctgctcctccaggccactctgttcctccaccctccaggcaccgccatccagaggctctacaagcagctccctctgcctggcccctgctcctccagctacctgtgtgttctgtccctcactgccttccagtggtcagtaaacatttgatgaatgaatgaatagctgtatattcactagtagttgacgcctgggccatgtgacctgtaattttataagtaaggattacaaacactaaaatctttggaaaagcagtagatattggccagtagtgccctggaaggggacaaacgattgttcctcctgagaggcacatttgtcagagtggggctgagtgggcttcacccaaagcatggagtgcagggcagccaaggggatttatcctcagttatccccaggttcgacacgtgcacccagctagaaactctatttcggagctctccctttagccctggccaggaatggcaagagctggtgcagctggtggcccagggatagaagacaaggacccaccccagatcgcccctctgtcccgcagggagagatagaaataagtgtttttcttgtctcttgtttggggcagcctctattttatgctctctcttggagcagttcagcctgtatcctaactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctttaggaaaagcgcttgggttaattaaacaaccctccctgnggnggaaatcttggtggctcttagcccctcccatgggtgagacataagaccctttctttaccatggccaagagctaaatcagtagttctcaacctttgatgttcattagaaccaccaggaaggggccccagcatctgagattggtaaaagttctctaggtgactctagcgaggctgaggtcaaaaaccaaatctctggcccttgctactctaggcatggttgaaagtgtggcagccccgtcaccttgttccaaatgcagaatctcatcccccaacccgtgcacgcacttttggaaccagaatctgcattttgactcccatgcccgtcagacatgggaaactccacgctggatgatgtagccctgcctctctccagcctcaccctcagccctcttccagcctattcccagcctcagccatcctccctggggcttcagtgccatcttcccagaggtgctgccatatcacccccacccgcccctcccacctcattgctctgtttgctccatagctcatgtcactgtctgaaattacactttttttctgggttttttttttttttttgagatggtgtctccctctgtcacccaggctgaagtgcagtggtgtgatctcggctcactgcaacctccgcctcccaggttcaagtcattcttctgcctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggggtantaacccctcctgggtggggtggaaataactncaattgtagatgaatcatgagtaaattaagactgtgggaaatctttaatctgtctacctgtcacttgtcactaaatttttctgtgctggttacatagagcatatttaagttctcaagtttaaacagtattcagttttgactcatagtttgcttaacatgatttatttccttcacgtgcaattatcatttagttgaacatgatgagcagtatttgttaatgtcctactgattagctgtgtggctgaaatgaatagtaaaataaatgatcatgttcttgacattgatacttcacaggtgagtttagtttcctgtcctctcccttgctcttaatcatctgtctcctaattctttgtaacaagggcactttgttttcaggttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccgtgagtttgatttaattggtagatgccgttttaaaattggtatttaagaacatggatttactttttaaatgttgctggtactccattgtatctaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgnggnantaanccncnctggtggggtggatacccttatttccccagtaataaatgagctgcgttctgccttgtctgtactctaaagatttctcacaatctggcattaagcctctatgaattgcctaccttctacactccttctgaagctaatcaacgttgccttaaaagctcaacattgccttaaaatttttcaaaaggtcatagagactgataatgccataaaggtttggtttatttctttagcctccatctgggattttccttctttttcccgcctggaatagatgcaggtctggaggtgtggcagcctccttgcagccacgaggtcaccacatatatgaaagccatgcactaaggagggtggagcgggaagatagtggagttgctgcatcagccaggcttttccatctcatgacttcttgttatgtgagcaaaacaaacccctatttgctaaagccactagagtcaggtttttgttttgtggagacaagtgtaattcctaacagatacttgcaatatctgttggtagggctcagttttggacattcgtttgtttccccagtaccatagaaaaatcatttttttagaaaaacattaaaattttagacattgtcaacataaacctggaattatagaattgagttgtgctctttctaaagagatccacagttcttttatttagtaatttaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcctcactgtnggtggaattccagtgcatagtaaattgatgcattgcgatcatgttgacacaattctctatagtcgatgagtctgtttgagtctatcaatataatgatatgatatttgtagattcatataaagtaattcatgtggctgacatgtattctttggttctaaagacagatggctagatttttggtttggtgtagtttaaaaatacacccttgatgagtgtaataccataatgaagaaggcacctcattgtttgaaagtcaaggttattaatgtatgcaaatataccaattttacagatatatatctaacttttttttttacatttacatttgggatcttagaatatttcccgaatgtagcctcattctcataattattcttttcatttggattaggtttatttcttctctatgccaatccgttttgttcctcaaggagatctgacatatttaaatcaagggaatattaatacattcctaaaaactgagttgataacagttgagagctagataactgataatactgttcaaatttggcttttattaatgcactctagggacagttgtgtttgagtcaacctccagctaaaatgatagaaaacagatgtccttaaaacaggctatgtgaaaacaacagaaatgtccattcggaggaagatgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcgggtnatatccntcctcgtgtggtggaaataaccagtgtcagcccaagcagtcgacttaggttctccttccctgcaacgctgtgttcccactcgctgatggagctgggtaggcgcacccaccagctgcaccagggtccactctgcacactcaggacgactgtgcacaggtactcattcactagggtggcaacctccttttcaagagccatttctgccagtccttctgggaatcaaacccaaaggaccctaagaaacagagatgacccagcaaggccaggagtgtgtactcctagtagccctacaattcagctcaagggaatgtgacgaacttgcactatgacctctattcatcatttcttgacaatttccttcacttcaggtatgaggaaatgacaataaagactagaaaacactgtgtgctcaagtagtaaatcgcaggaaaaaaagagtaggaaagaagcagtccaagtcagagcctcctttactgcctgctgcacacaccacaccacacctccccacacagacagaaaggccaagtcagagaacaacatacaataaggcttctaaagcctgaaaacaaagtatcattatttgacaaaatataagcattaagagtcttaagggaataggaaagaacattaactttcatttccaaaatattaaaaaatgcgtggtcttttaatctgaaacacaactatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctaggnnacgcgattttgtgnanntaaacnnccttgggtgnggnganatacccgcgttgcatgcacattcagnatttataagnaacttattatttcagctttccggatcagtttgaggagtgtcttgagaatttaaggcaaaacagacatgtttgttatttgacatttgcactngaaatctgtggctcggggctttctggatacagtgatgtcccaaaaattcagaaactgggtattaaagctgttgaaaaatgttacttctcctcccttccctccaattttaaatttatgcctatcaaaagtcatgctctttttaccaggtgactgaaatgatatttaagttgcaaatctggccttaaaaacatatcagtcctttacttgtctatcttaatagatgtctgtttttcaaatgaaactttctgaagctccttgctgcatgttcttctgaatctccctgtgcaggtctgtccaaagacctaacccaccgccatcagtaccacacatgctgtggtttgggaatgttgtggtttgcttcanactttgtctctgatcctcttatttggatgccctggcgagaagttcccaccggaataagtaggacgtttggttcttttcttcttcttccttttaggaaggctccagatgcctcacaattggtgctggcctaatcctttgttttccagagtttatcatttaccccctgcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggtnnantaaacccccctggggggggtggaaaaactcaggggcccagcagttcagatggaaaagatactgggccctacagactcccaaactcaccagacagaacttcccaccaggacaaacctttgcactgggaatctaaactggggagaggacacaaagacaggtaaaagcatattgtaaaacaagagataagaaatctcagaaataggccaccatgtctttaagcataacatgaaaaaatagaagagggaggttgtattagtctgttttcacactgccataaagaactgccctagactgggtaatttatgaaggaaagaggtttaattggctcacagttccgcatggctggggaggccccaggaaacttanaatcatggtgtaaggtgaaggcgaagcaaggtactttcttcacaaggtgacaagaaggataaatgttgagcaaaggggaaagagcccctaatgaaaccattagctctcgtgagaacccactcactaccacaggaacagcatgaaggaatctgcccccatgattcaatcaccttcacctggtctctaccttgacataagaatgatggggactatggggattataattcaagatgagattttggtggggacacaaagcctaactatatgagaggtctgtaatgtggacctcanaagatgagcttggaaacatgcctccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatcatctcncctgtggtgggaattcagcaatttatcaaaagatataaattaaaaataaaaactctgcatgctttgtaagtgcatgactcatttatgagtggagagaaatctctaggataggatattttttcttcgaggctggaatatttaaagctgcatttcacaacgaagtttggtttacacgggtatttactatttgaaaatatctgtgggtggttttaggctaaaataatcatctatttccaaaaccttgatatcaggttttatatggcagtagtttcctgcttgcatgaacggcacgcgtgtctcccttcggggagacctgactttgatacttttgagtcccttgtgtctgaagcaggcgctgatgggttcttcccatttgggtttatgtctgtgaccattttgcagtttatcttaaagaggagctttcagtgagagaacgtgtgctttgcactcccttccctgagtcatgctatcctaagtagtccctgtgctaatcatcacagaagggatgctcatatcatttacggcacaaattgggacctcttgagaatgaaagagaattgcttttcataagtcgcaggacagcaggtgtcagccaggactgtttgagcaaaccaggatgcattgtcacaccggtcctgggggaaccccccggtccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttggttnnnnaaaaacncccctcngtgnggnggnaattctcaaaataatatcagccctgaaaaacttcctgaaagcacagatgcaaagagtgtcatccttttcaagccttttgatgaagttgaaacaccttctatccctctcagttatgtgtattataacgccttttattcagggtaactgactggcctcaccgtttaaaagcccaggcaagctttctgcttgttttaataacttgtttttcacagaggacaggtgaaggacctggggacccttttatgcagctaatttctccaacatttgcctccaaaatggaagtttttcatcctaacctacattgtttcctttgggtccaaaaaaaaaaaaaaaaaaaaaaaaaaatccaaacaggtagagctgtatttctctacggtactcgaattctaatctacactataaaacaattgggaggttcagatttgaagacagaacagcttactgtacctttcgtcttatgttaaatgcccttcacccataattaacaaattgcctatgcatttaaagcatactgccggagagacttctaagaaccgtgttctctggcaggtgctaggatatcgagaaataaaatagagctccggttcgcctgcaactttaaaactttcttctcatcctgccaagttgcttgaggaatcatagtccaaacaacttaaggagttaaagataaataaataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtttggtttaaaaaaagaacttgattaantanccacngtaatgtggnggnaaacacctcgcccccgcacccgtccctttcctcggcctcacctccactcccggacccccagccgccgcccccgcatcccggcccccgcacacctagcacctcagcctggccccgcaccttggaccgctgccctcgccctagtcctggtccttgcacctcagcccgaggccaacagccccaacggctcccgcggagatccgtgcgcgccgccgacctcccaggacctccttcggcccgcgcccacctcgccttcggcgctgggttcccgagagagccagggacacgcgggcagcgagcaacaggcgctcttttcccgggcggatgaacaccgcctcccgggcgccggcctcgtgtctgtacgccatacgcccagtaacggcggaaagcggcgcgcgccacgccctcattggctgcccagcaaacggcggtttctgatgtggccggggcgggaccannagagccccgccccacaggccccggncccgccccttcaagaccccgtctggcccctcccggtcacccggctccggcccccacaagccaagtcccttccttttcctctcgccgcccttctcgtctctcctggctccccgcggcttctcgcccggcccccccccgtttctccttccccctaacacaaagtccccagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgngtnnnntaaacaatcctcctgnggtggnaattccgtatcagcatcacaaactgtgtctgttttcattacaaatcagtaccatgattccagctgctgggngagaaaacagaatttagctataatacccagaggcgctgtccaggtttattacacctaaatacgcacagaagcacactcatggctgtgctcttgagaaactattcattgtaagtttcactcttctaaaagatgaaagaccttcagctccatccgttacctctagcaaactaatgcaggaacagaaaaccaaataccacctgttttcacttataagcggcagctaaatgatgagaactcatggacgcaaagaagacaacagacaccagggcctacttgggggtggagggtgggaggaggnganaanagcanaaaaaataactactgggtactaggcttagtacctgagtgatgaaataatctgaaccacaaaccccatgacacgagtttacctatgtaacaaacctgcacatgcactcctgaaactaaaagttaaaaatgataagaccttgaaatatatccattactaatgtcaacaactaacatgccttcagttttcatatattactattcttggcaattcccttagttccaagaaaagcactgaaaaataatgctattatgttgaaatacaagtgactgggtaaactgaagtggtttttctacatcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttggttnanataacncccctcnggnggnggaatagcgggaattctgtggccagagagaccccgctcgcatagaatgtaccgctcaacggtttttaggcgtgtggcgcggtggtggttcccacgtgcacggcgtggtcctgagctcagcgccggagggacgttaggtggaagcgtctttggcagagctggtagcgaatcggagaggtgatttccagcgagtgtggttattggaagcacacacttgctttctgactttaagaattcaatatccagactgaggtggttttgaaactggaaggagataaagctgaaaaccagagttgtgctgggaaacctggacgtagagcgctgagccccccaggtatttagtgaccagcacagcgcgccgccgtgggtttcaggccctggagatgatgagaatcagctggagggctgcttccagtcggcttctaactcgggagggctgagagccgctccccaccccgtaatttctgttcccagccagtccagatgctgcccgtcagggaccaggctttgagaactgacgtgctgctttaggaatatttcctgctggagatgagagttcagcttgtcactgttttttaatcactgtttcacaccgttgtttgtaaggtgtcaagcgacggactgggtgcaaaggcatcaattgtgattcgcagcctagttggagaagctatggagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttaggaaaggacttggtttactaaaccctcctccctgtggnggnaatcagtgtcgattggtgcactcataaactttgagctaaacacagggtgctgattggcgtatttacaatccctgagctagacataaaggttctccacgtcctcaccagagcagctagatacagagtgtcgattggtgcactcacaaaccttgagctaaacacagggtgctgattggtgtgtttacaatccctgagctagatataatgactctccacgtccccaccagactcaggagcccagctggcttcacctagtggatcccgcactggggttgcaggtggagctgcctgccagtcctgcgccgtgcgctctcattcctcagcccttgggtggtcggcgggactgggcgccgtggagcagggggtggcactcgtcggggaggctcgggctgcacaggagcccatggagggggtgggaggctcaggcatggcgggctgcaggtcccgagccctgccgcgtgggaaggcagctaaggcccggcgagaaatcgagctcagcgctggtgggatggcactgctgggggacccagtacaccctccacagccgctggcccgggtgctaagtccctcattgcccggggccagcagggctggccggctgctccgggtgcggngcccgccaagcccacgcccacccggaactccagctggcccgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataacatctttctgtggtggaattcccacagccgtggtttggcttctgccgtgtgacattctcgctctccctggaggttccctttgtgtccctcgtcacaggctctgcttacatgcgtgtggttgcttcccggatgtctgtgctgcactctagacggtaggctctgtcaagacaggagcagtgtctgctgtttgtccatgattcctcaggagagactcccaggagactttctcctgtgcccccttcttgtgctgactttcctatcataggaggtggggcatcaacagacggagcctttgctctctttttcagaaggaccctggaccctttctgcatctccctttgcagatgtcagctgccattctaatgggngggggggcggtgcagctgtgacatccccacagcacatacagctgtgaactcccagctcctcactgagcacacacccgcctccaccgtcctccggcaccgcccacgagtcctgcctccctggggtccaggatgtcgggctgtgggagagcctccttggcagctcatgaggaagaactggagaccttggtgccctgcaattcccaggtcatgactacccaaagagtccacagttgagcctgagctccctgcccaacacaggccaaccctgacctgtcattcagccccagcgtctaccagcatgccagcatccaagagtcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctgggntntaaaccccctctgtggggtnggaaaatccccccgagtctggctcaagccctggtctaccctggaaagcctcctctgaaggccgattggtggctcttagcccctcccaatgggtgagacaataagacccttatcatttaccatggccaagatgctaaatcagtagttctcaacctttgatgttcattagaaccaccaggaaggggccccagcatctgagattggtaaaagttctctaggtgactctagcgaggctgaggtcaaaaaccaaatctctggcccttgctactctaggcatggttgaaagtgtggcagccccgtcaccttgttccaaatgcagaatctcatcccccaacccgtgcacgcacttttggaaccagaatctgcattttgactcccatgcccgtcagacatgggaaactccacgctggatgatgtagccctgcctctctccagcctcaccctcagccctcttccagcctattcccagcctcagccatcctccctggggcttcagtgccatcttcccagaggtgctgccatatcacccccacccgcccctcccacctcattgctctgtttgctccatagctcatgtcactgtctgaaattacactttttttctgggttttttttttttttttgagatggtgtctccctctgtcacccangctgaagtgcagtgggtgtgatctcggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaatgnggtggaattcgtggaacacagagttttgtgttctagtttaagcaaatagtttatttgaaaagtgttagcgagaggatagaaaatgtttatgtgcatgagaagtaactgcaaaacgaaatttggcaaaagtttctcattttgaatatacataggaaagtcataacagaaaatgaaattaagaatttaggtatagttgtttgttgttcaatgaaaattgtgcctttacaggtcaggatgagaatgggagggtcattctgaatcgaaagaatcacttgttttatttggcaggggagggggagcagcagaggcaaatggatggtaatgtggggaggcgctcatgggtcagggctgcagccacttccttagaagcagcgggaggaagggttggagccatttaactgcaagaggaaatggtttctgttctttgagtactctgtacagtttgggcttccacttttagactaacctgtgaagacagaaaattacactcacactggtaatggagagcttcctaacttgtttggtacaattttcggtcataaaacaaaagcaaaacatggtttttctcttatcatcaccagaaaagggagattgctgaagtgactctcagctcagtctgggagggagttggggctggaatgagtaattaaatgtgacttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggttnataaacaacncttggggggnnggaatctcggctaagatagactgtttattatctttattcctgggggaagtttcttatctgtgtaagcctaagttttgtcatttataaaatgaaaataatactagctaaattagataaaatgaacaaattcatagaaagacaagaactactaaaactgattcaagaagaaatagaaaattgggtagacttataacaagtaaaaactttgagttaataatttaaaaactacctacaagaaaaaaactcaggtccagatggcttcacttgtaaatataactgcaaattaaaaagagaattaacataaactttcacaaatgtttaccaaaaaaagaataggaaggactatttcccaagttttttaatgaggctagtattaccatgacagtaaaaccagtcaaatattttacaagaaaactgtagaccaatattcctatgaatacaggtgcaaaaatcctcaacaaaatattagcaagctgaattcagaaacatataaaaaagatcacacaccatgaccaagtggaatttatccaaggaatgaaaggttgatttaacatctacaaatcgactaatgtaatacattgtatgaatagattaaagtacccaaatcacatggtcatttctatgaagaaaaatatttgacaaaattcaacattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggtgtataatccctccttggtggggtggaaatccctgggagagttcccaggccactgaggataaggttcaagtgttggaggttgcagtgtctttgcatgctgctgagtcaagctggattttgacacagcctggttttatttaagaaaagctggaataaataacagggtcaggggtgcattcgggtgtcaggagttatggagaaacaaccacaatcctggtattcactcgatttttatcgggagaccacagcatctcctatgctgtgttaaatatactctagaagatcttgggccagaagccagaaacaaacatttctggtgagagcaaatggtgtaaaaatgggaggggaataaaggaaaaggaaagggaaattctcatgacacctttgaacttgaatttcctgctttattcagctgatgtaactgaaaccgatgtctcctttctccctaaaggttccacatgtgtggaaccagggcattttctttttctaagagggtaagactgcacgacctcctctcctttctaaggaacatctaaggtaactttttaccttagtgacaataaagttagcagcagcacattgaagtgtgaagcacggngggggtctatggaatacaattcaataaataagatcagggcgctagaggttgcaaatcacttgatatttaccatctcgctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggttanaaaacnccctcctgtggtggaataccgcttcacacttcatgtgctgctgctaactttttgtcactaagtaaaagttaccttagatgttccttagaaaggagaggaggtcgtgcagtcttaccctcttagaaaaagaaaatgccctggttccacacatgtggaacctttagggagaaaggagacatcggtttcagttacatcagctgaataaagcaggaaattcaagttcaaaggtgtcatgagaatttccctttccttttcctttattcccctcccatttttacaccatttgctctcaccagaaatgtttgtttctggcttctggcccaagatcttctagagtatatttaacacagcataggagatgctgtggtctcccgataaaaatcgagtgaataccaggattgtggttgtttctccataactcctgacacccgaatgcacccctgaccctgttatttattccagcttttcttaaataaaaccaggctgtgtcaaaatccagcttgactcagcagcatgcaaagacactgcaacctccaacacttgaaccttatcctcagtggcctgggaacgtctcccactcctctgcctgcagttagagttgagtccaagtcttcacaccttgaaaatcactcagagacgaagtgtccagacttttgtaaatgtcctgccccatgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcgtcactgnggtggaattcaaanaaaatttttaaagtggatgacaagttctatcagatattaaaacacattataaaacaataataattaaaacagtgtagcactgacacaaagctagatagacagttcattacaagagaatcaataactggaaaataaatacacacacacacacgtacatatcaacatatgattggagtgcttgtcgcagtattgtccatggcccaaccaacatccaatatcctcttcctccttcctaggagaacctgactttattgaatccatttcccattcaaccatggacctgaggctggccctcactggttttaggaatatgtcactcccttgctagtgattagctcatacaaagatacaatacacatttctggccattgagacatgagaagaggcttgctactattcccagaatcactggctttctaagactgtttactgtttagtagagatggggtttctctcatctcaagtcttcttttaactatcttcctggaaattcttttatctattagcgtatgtaaaacacaccctgcaatggctttctgagaaagggaagtaagtgattaattacttgcatgtttcaaaatgtctttattctaccctgngcttgattgatgaatggggttttggtagggcaatctgtggtggaaatcatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggttnnntagccgcccctgggggggnggaaaanaccttcctctgtagggagacaccatctttaccttctggggcagtctgctgtacaaacaacctcacaaacatcatctggacaaaggtagtcagtactgcttctcaccagacaggtagaaacacaagacagtggaccactgtctcacagcactattttcaaatgtattacattccaaaacctggaaatgaagacatcagaaaagattaaaatacctattctatctgcagtactaagagtacgaagctgagtaacagaaaaaaacttgttacaaaactaaaatactaatcacagtgctgattagattgaacaatacaccagaaaatcacaactaagcttggttactattttttaaaaacttggggttcatgttaggagctctggtttccaacaacatggtaaattaaccctggctactaagtggaagttaaattgtcaaatggcactaacttagaaattttataaaatacacttctaaagaactcgtgtatcagctatagagagagagagctggattacaatgaaagcacgacaagcttgcaggatgcagggaaagcaatgcttcaagggaaatttataactttatacgagaaaagacacactaatgaacttaagatgttagataggaagaaaagataactgaagaanagagataaagagtagaagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtccgtgtnggtggnaattcactcatatcctcgagagctattgcgaacttggtattccttctccccacggtgggtccttgatcaggaggaggtgcagagttcaggtcgtttgttccaccacaggagatatactgcatgcttgataatttgctttcagtgtacatatcacatatttcctatccaaaagcaagacacgtgttctgcaaaaatttttgttttttgagggggatgagaaacaatctggataaggctgaaattttcgtgagaatagtagggcataatacttgtatctgtaatttccctctttaagttagtcataagataactgtcactgatgataggacaattcattgtgataaatacttgttttgagttaatgtaactggtaaattgatttttccctaaacgaggggttggcaaacttctctctgcaaagggccagatagtaaacatcgtaggctttgaaagccatgtcatctcttggcagctcttcagctctactactggaccgccgaaacagccagacacagcgtgtgagtgagcggtcatggctgtgtgccagtagaactattggtggatgctgaagtctgaatttcagataattcatgtatcatgaaataatcttttattttttccaacctcaaagatatttgaaaaccgttggtaactcataggccataaaaaacagcaggtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattggtttnttaaacctcctcctgtggtnggaatcgcctggcctggnagcttcctgtaggctgtagatacacaataagtacgtatggatggtgagcaagattttgttgattcaggtcattttttaaatagtaaatacattcaacgaccaatcttccacggtgagggagagcgtgtgctgtgactgaaagccacatgtcaccaccagtcccatttgaatactgatcgtcagcgctgtgaactaaagcagaactaatacttttacctttcactcttctcctgaccccatttgccaagataaagatggaaagaccccggcattgtccagtgggagggaaaaatcaagctccgcagaacttttctaaattggattagcatctcctgccgtatgcgcttatttattcagggaatttccaagtcagtgttgcagacatgaatgtggcaggggattgcacgctttcaggatgaaagtatttgggcttcctaagtgcgtcgacgagaagagaccagttacctcacgtttcttcttattttatctttagcctctaaacatagcacacagtaaatcgtcttggacatctagggatccctttcttcagatgattataaagactcagctgaaattgtcgttatccttatttcacggggaggaaaacagaactgttaagctctgcctcttgctgctgatcagccaactgaagccaggtggcggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttggttantaacccccnctgcgtgnggnnggaaaccccacctanacgttatctcacctgtcttagtcagagggtggaaagtatcagggctctgagcaccacacttgattctagctttgcttctttccagatctgagcatctgtgctattgattcaactttctcagtctccatttgttgctgccaacgctgggtaccacaagtgattccctcatatgggaagtgcctgactcacaattatgaggtttgcatgctgtagctatatagtgtaaccaaaacattagattgtggatctaataatagaagcctgcaacttcttatctaccgagaaagcatggaagaactgctaactcatgcccccatgcctaacaacatgggtttctcaacttttaaaggattagagtcatctgttgatcttaggaaccaaaaactttggtgcaactccaaataaaagtaacaaacatatatttttccactgctatactagcataattcccacatgtcgggggaggaacccagtgggaggtgatgaattatgggnggtgggtctttccatgctgtccttgtgatagaacaatccacacaatcctcttttaccgtcctaggattcacaggtgattttcttctcttgacactgtctcaaggatgactgtaggatgctcaagtttctggacagatgatgctgctctaaagcagtgcttcccacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttggnanaaacctctcatgggtgtggtggaaaaacacgggaaactataatagcatctatctcttggaaacatgaaaagtaaaatgagctatatttaaaataaccagttgtatcaactatacgtcttcaaatcttaaatgccgtccattttaaggcccaccattaattatataccactactaattaggttgacagttttcaaacagaaccccaagtattttgacattcttctgtataagaagtggggttgggaggggaaaggcttccagatagaaaggaagaagtaaaactatctctacttacagataacatgatcttgcaaacaaaaaagaaatcctaaggtatccacaaaaaaaccaatagagtccacaaatcagctcagcaagtttgcaggacaaaaatatcaacatgtaaaactcaaaaaaatctctacacactagcaatgaacaatccaaaaatggaattaagaaaacaagtacattgacaatagcatcaaaaggcattaaatacctagcaataaatgtaagagaagtacaaggtatgtacactgtctagaatatcatttaaagacctagataaatggaaagaatatctcatgttcatggttgggaaggcttaatattgttgagatggcaatactccccaaattgatctacagcttcaaggtaatctctatcaatgttacagttggcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgggntataaaccntccttcgtgtggtggaaaaaaccaattgttgcctttggcttgcggcactgcgaagtgagagtaagtgaatgtcacatcgtttggatcaagacccatttgcagcacaagccctgttttgttcagcggcttgtaagggccggttaaagagtttgatacataaccaagcatgtaaatatcgtttgagttaataccatcgatcgtcatttttgaaccgcgtgaatcagtgaacaagtaccatttgccgttcattttgaaaacattcgcgcgctcgatttcatcagttaccgtgtttgaagtgatcagcggcttcattacttttttcaatgtgtaatcattatttaactctatgataccgagggcgccgttcgctaactcagcatcgcgttttttagcgctctgctgaagcttctggctttctttacggaagaagttcgtgccgccgccgtagtacgctttgttaaataaagattcttcgccttggtatccgttttctgttcccgtgttggcttcgaatacaaggtatttatggcctttgtcttcaacgtagtgagggtctctcagcgtatggttgtcgccggatgtataattgccttcatcgataaactgctgaacgttctgatatgtttttccgtctccgtcaaaaatcgttttgtgatcttccactccgttgattttgagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtaactgnggngaattcgatggcaaggctgagagaaataggaacacttttacactgttggtgggaatgtaaattagttcaaccattgtggaagacagtgtggtgattcctcaaagatctagaacccgaaataccatttgacccagcaatcccattactgggtatatacccaaataaatataaataattctgctataaagatacatgcacatgtatgttcatgcagcactattcacaatagcaaagacatggaatcaactcaaatgcccattgatgagagaccagataaagaaaatgtggtatatatacaccatggaatactatgcagccatataaaggaacaagatcatgctctttgcagggacatggatgaagctggaagccgttatcctcagcaaactaatgcaggaacagaaaacttaacaccgcatgttctcacttataagcagaagttgaacaatgagaacacatgaacatggaggagaatgacacacacactggggcctgttggggggtaaggaggaggaanagcatcaggataaatagctaatgcatgagctaatgcatgtggggcttaatacctaggtgatgggttgataagtgcagtaaaccaccatggcacgatgtaacaaacctgtacgtcctgcacgtgtgtctcggaacttaaaatgaaactaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgggtgntataaaccnctgctgggtgtggtggaaatatcgctggcttatttcattcagcgtgttttcaaggttcatctacattgtagcggatgtattgtattcctttttatggctgaataataatccattgtatagaataccatatttggtttattcggttgtctcttggtgaacatttggggtttttccacctttgggctattttgaacatacaggttcaagtttttacgtgacatatgctttcaattcccttgggtatatacttaggtgtcaaattgccaatcatgtggtaattctatgctaatgtttttgcagaacaaacaaaactgtcttccaaagtgctgcaccacttacaatcagagcaggaatgtatcatggttccaatttttccacacccttaccacacttgttattgtctgtctgtttttttattacagtcatcctagtgggtgtgaagtaatactcattgtagctttgatgtgcattttcttaatgacaaataacattgataatttttttttgtctttttttttttttttttttttgagatggagtctcgctctgtcgcccaggctggagtgcagtggcacgatctcagctcactgcaagctctgcctcctgggttcatgccattctcctgcctcagcctcccgagtaactgggactacaggcgcccgccaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttgctgnggtggaattcgggaaatacttggcgggagtgctttgttttaagatgggagggactattttaaaggtccttcaactgatacctgcaagattccacagggcaaagatattgtaaacatacatttaacactcactgcactttagattatatatttacagagccacacaatgaatttacatctgctcaaaatggaaattgatcttttttttaaattcagattcagtgactgcaaaaccctatgcagaaatatctgagtaatgaagatgttagcaaacccagcatggtccctgggcgtggctgctgtgggtttgtttgtttttacatttacactgttagaccatgcattgaacactccctattagaaccacagaaacccactggaaagagcctttaaagctaatcttatctgatttgttcttacatctcctttatgtatccccatcaagaggtcattcaacctgtgcttgaaaagctctgcggaccaggtattgacacatttcagaagtggcttgctctgtcctaaagcacttctgatttctagaaagctctcccttatgtggaattgaaattggcttccctataccttcttctgcttaggggtgatgaatgtaacttttcaggtcaaacttcctgggttcaaacccctgctctgccactaacacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacaatcttcctgtggtggaattcgaattgggtggggagggtagtgctagttggtatccggaacgacacctatgttttttggcacctgcggttgctggatggagttagcgttcagcagcaagagaaagacggggaggagaacaagcctggaaaatggagtggctgaggtgggagaggaaggctcttgctgactgaacaactttgtgttggtgctctcctgcctccccgccagcaggattcactgggcctgtgacatgtgaccacctcctgatcagtccacagcccgcctcccaaaatggtgccaaaaacaccgcactgcatcttcaaggaaaaacataaataattccctgccaaggcattccagcctgactcaaaggaggtggggtttgtttgaagaaaatccagctctcctgggctgccacccacctgttcatccaccagggacctcctccttgaagacacctggatgttttggacttggagtcattgacccagtttgcggatggtaacgaaggggcaggagttgtattcacaaaacccactgatccagaaaaccacgatcgggaaggattttcaatttcaatggcaggggtgggtgggggtggttgtnnnnnnnttnttntttnntgnntttnnggttttntttttttttttttttttttttttttattaataaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaattttcctgtggtggaattctgaaccaaacanagtcttaatgatggcagtcatgagcccaggacaaaagaacaaaaagatcagagtccagttctcttctgaccacaaacaccagaactgcctactctctagacttccttagagaaataacagtggcttaaaatatttcagtccttgctatactttggaaaccagttatttaatatgagtgtcaattccttcacctgaaaaattgagaataagcatcacaggcatgtcagaagttttaaatatcacgtctaaagcactttacaaggcacttccatgtttgtttctgtacctcatgatttggagggggctctacctaaaaatcctttaaacatgtaactgttcatacttgtctctctcagtgagctttttatcccagaggcttggtttgaagtattgatggcactgggtgagtaactacactaaatcacgcatactgaatccaacctgatgacactgaagggtcataaaggctgatatttttccttaaaaatttttaatttgtcttaaaaaaattcagttctggacgcaaaaatccaattgccagtttctgaatataaacaatgatgaaatcagttctgcttgagatatacagtactgctatgacacttagccaaagcttgattttgtcacttgatgaagagg

SEQ ID NO: 719 - DNA, 1243 bp, Homo sapiens
  misc_feature (1)...(1243): n = A,T,C or G
atgcgcgngtccttccagccccgtggtgtcaactaagggaacacaaatttctaaatatttatttatttattgttttgagacggagtttcctcttgttgcccaggctggagtgcagctgggtggtcttggctcaccacaacctgtgcctcctgggttcaagcgattcttcttcctcagcctcctcagcctcccaattagctgggattacaggcacctgccaccatacccagagaatttttgttttactagagatggggtttctccatgttggccaggctggtcacaaactcttgacctcaggtaatccacctgcctcagcctcccaaagtgctgagattacaggcatgagccactgcacccaccctccaccttggttatttttaagcactaaaatttgatacttatttctgaatgaagtcatctcttaattgtattattttacttatattctttaaattgcacagattcatgtaattcagcacagaagtgggatccagagagattcctttatcatgtgatacatgacaaatacattcaatgttatatttcaatctaagaaataagtaaatgactgtacagataatcactctatacctactttgtccaacccatgggtggcagagtgtattcaacccgctacagcttttctgaatgcccaccaacccaaatttcttaactttcttctaacattctgagattcttttgggagattttattcccgatgaggggattgttaccggccttctggggggggccagagacgagtctgcttttaaattgagcgcagggagagccaaaaaactggcactgtcccttgttccataacccggaaaaaaacgacagtcccacttttgcgcgcccgtaagtccgacttaccaattacatgctccgaaatcatggaccctaggaagatctcgcaaaaccttcgctgaatcgagtggtaaagtcgaccctgggttgatctcgcacggcgtcgtacgctcacacaccgctcggcgcagggtcatgcggtattcataacgcacaccgcaatacgtgatacatcgcggacacaccgtgaagcaccacaatccgtagccgtgactgtcactctacggaactgacgcagctgtctcgtacaagcggtcgactcctctagtgatcttggcaatctcaacggagacagtgacacgcgtacatatacgcatcgaactcaggaacgctgttcggatatgtgtgcagatctgagcaacgcgacatccct

SEQ ID NO: 720 - DNA, 1138 bp, Homo sapiens
  misc_feature (1)...(1138): n = A,T,C or G
cgagtgcagtcgcgnacgtgcgcggtncttccgcaccgtgtgaagaccgggctcgcggtgtcagcagagtggcccttcctccggctctggaggacagacgtccgggctcgcggtgtcagcagagtggcccttcctccggctctggaggacagacgtccgggctcgcggtgtcacagaggggcccttcctccggctctggaggacagacgtccgggctcgcggtgtcacagaggggcccttcctccggctctggaggacagacgtccgggctcgcggtgtcagcagaggggcccttcctccggctctggaggacagacgtccgggctcgcggtgtcagcagagtggcccttcctccggctctggaggacacacgtccgggctcgtggtgtcacagagtggcccttcctctgcctctggaggacagacgtccgggatcgcggtgtcacaaaagggcccttccttcgggtattgaggaacaagcttggggggaccgggggggcaatgagtggcccttcctccggctcgggaggacggacgtccgggctccgcggggtcaaatagggggccatgcctggggtctggagacctaactctgggcttcaggggttcacagaggggcccctcctccggttgtgggggacagactctcgggatgagggggtgacaacgacgtggccttgtgtggagttaggggcaaataagcgctagctaccgaggctatcccacgcgacccttctctctcgctttggtgactaaatgtaacgcgttcgcgcacggagccagagaaccgcttcgcattgccgcaaggacaaactgccggggacagcgcaggaaccagcgattgcaagcaaagatttaggtgggcattcatacggcgatctcacaagatgaccgcagggctagatataacgttatagggttgtcacacttcgctgtcatcaatgtgctgcagggttcccgacggctctctacggtacggcgagatgtctgcgagctacatcacagcgacataaagaagtgagtcagagccgtgctgaggtacgaacgcgtatgtaagacaacaagcagtctacatgtcaggctgcgtgtcgtggccgatgggtgctccggcaagagatgacgccgtgcgctggccgcg

SEQ ID NO: 721 - DNA, 1159 bp, Homo sapiens
  misc_feature (1)...(1159): n = A,T,C or G
atgacgcgcccttgcaccccgtggtgaagactgggtggcccaggctggagtgcagtcgtgcgatctcggctcactgcaacctccacctcctgggttcaagtgattctcctgcctcagcctcctgagtagctgggactacaggtgcccgccaccatgcccggctaattttttgtattttagtagagacggggtttcaccatattggccaggctggtctcaaactccttacctggtgatccgtccgccttggcctcccaaagtgctgagattacaggcgtgagccaccgcgcccagccaactttcaattttattagctgagtttttagcacaacattattaacttttaaaaacaaacatgtttgttttgaaataggcaaaacaacaaaaatattttgttttggaaagtaaatttatatgatcctgtaaatgtgtatgatatttagtaaagaaaaataaagatgagttgccatcttggaagagcaggctcactgaacagcagtgcttgtttcctcctccttcagaagggtcacagttggtggctaggtaacccggagaagggttttcctggggtcatcataacttgttctcattcacatacctttatccgtattcttagctcattttgcctatttanaagacaaaagtcttttaagaaagtnttcttaatttaattcacatttcccttaatgaatccaccaagacccagcagatgcaaaaatctctttgtgagtacacttttttctgccctaaagaaaaaatgttaccttctgatacttgaaaaaattccacaatttaaccttgttttggtcattccgaagcttggcctggtcccagaaaactttttccttggcaagaacctttttttctgtttttaaccctgtaataaaatcctccttttccttccaaattttttgcaaaacctttaaaaccctttttaagggcctgtcaaacccaattggggtatgcaagcagctaagaattttattgtttgaatctaaaaaataggccatatttcctgagaggagcttccaacttataaaaggtaccattgaacatgaatatgggcctcagagaaacctatttcttgtattcccagcgaagaaaacctttattttttgttgtaaggattgctatgttaccaaaatttcctcccctttct

SEQ ID NO: 722 - DNA, 1093 bp, Homo sapiens
  misc_feature (1)...(1093): n = A,T,C or G
ntacgcggtccttcanccctgcgcgtatcttccagcccgagggtgaagaccattgtctttaagatgagaaaataatcgttccttcctgggaatgttgtgagtattgagtgaggcagtgcaggtcaagtgtctattaaacactagccacagttgtatcgctgtgtggcagagccagtctgacaaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaaaaaaccacatgcctttgcctcaagttgcttaaggtggaaggaaatgattagaaatggaccaagccggacctgcacttttaaaataagtgtatggcctcacacaaggaaaaaatcccgggacctgggaatttgaaccttacagtgaacttcattggtaaagcaaatcgcgttactgatgaggaccattgatttcttctcatgatgaaccacgcagttacgacctcgttgatgaccgtggaaatcgaagatctggaatggactcgggaacacggatgcggacaaatcgaacatgcttcattgactaacaatatatgctcgaagtagtatgaggaaacgatcgatccatgtacgatcgtagtgatgtaatgttccg

SEQ ID NO: 723 - DNA, 1087 bp, Homo sapiens
ttgcgccaccgcggatccttccagccccgtggtgaagacccatattaaatctacacccataataaatgatttttttttctgttaatcttttcttagctgaagggttgaaaaatggtatattattgttttaacacgttattagtgacgtttaagattctttcccaaaatttatcaaacttgtcatcttaggtgggtcatggtttacctggatccccatagaatgtaactgtacatggttatattctgtgtacagtttgtgttgtacccatttttgtaataggtttttctttttttttttttttttgagacagagtctctgtcgcccaggctgtagatgatttgcacaactctttactgagagaacccctgagctcattttacaatcacgagtccagacttggggtctgctggcaaatgctactacttgctgaaacatcggcgcttagcgaagccacatgctctatgctgcagcctggcggcagtcacgtcttgataacacgaatgtcggagacgccccccatctcctggacttacgtgagaattaaaatacacgccgactgctacatgcgcacatgaatccacaattgttgtgtccttgacttaacagctgcacaaatgacgattcaatcctttattacccatttaaaggacaaactacaccccacaaaccataatcttgggcctcaaccctcttgatgactgcctttttttgtaggggatcttgacccgttttcgccaaaaaagaattaaatttcccggcctgattaatttcggggaaaaaggggggatttattacacccagcctcaaattcccaagctccctctgaggaacaaaaaacccttgagctggcaccggagggggcccccccaatcaaaaaaatccatggcattgttccgggcaacttggtggctgaaggtctgggctttcctttaggaactccaaggcctatcttctgggaaaggctctgtaaattcccctttttcgccgaaaagtccctataacttgcaccgaatttcaaaggggtttgtaaacctaaatatggggctatactttccgccgccaaatccaattcgcaagatataatct

SEQ ID NO: 724 - DNA, 1227 bp, Homo sapiens
ctgacgcacgcgcggatccttcagaccccgtggtgaagacggatgtcattcttcctttatgtttagggggtagtcctcaagcaaatgtctgcagatgagctactccctggggctcctgccaggacccagcaggcgggatctagcctagtctctctggattctcccatttctttttgtttttttctcatttgagacaaggtctcgctctgttgtccaggctggagtgcagtggtgtaatcacagcttactacggcctcaatttcttgggctctaaggatcttcctgcctcagcctccagagtagccgactatagggaatgcactacaatgccaggtaaatttttttttttttttgagacagagtctcactctgtccacccaggttgaagtgcaatggtgtgatctcagctcactacaacctctgcctcctgggttcaagtgattctcctgcctcagcatcctgtgtagctgggattacaggaatgtgccaccatgcctggctaatttttgtatttttagtagagatggggtttcaccatgttggccaggccagtcttgaactcctgacctcaagtgatctgccctcctcagcctcccaaagtgctaggattacaggcgtgagccaccgcgcctgaccttttctctctctctctctcattttttttttttctgagatggagtctcgctctgtcgcccaggctggagtgcagtggcgcgatctcggctcactgcaacctgtgcctcccggtttcaagctattctcatacctcagcctcgtaagtagatgggactacaggcacccaccacaacgccctgttaatttttgcatttctagtagaaacggggtttcaccatgttggccaggctggtctcgaactcccgaccttgtgatccacccaccttggcctcccaaagtgatgggattacaggcgtgagccaccatgcctggtccctctttttttctattattattattttttttgagacgggctctcattctgttacccaggctagactgcagtggtgcaatcatggctcactggagcctcgaacacgtaggctcaagccatcctcccacctcggcctcccaaagtgctgggatgacaggcatgagccactatgtgtggccaaatttgaattttcaagtaaaattagaattttggaaagccagcatgaggttgtcagtttcccactctgattcaccacggggctggaagaatccgcgtca

SEQ ID NO: 725 - DNA, 1182 bp, Homo sapiens
  misc_feature (1)...(1182): n = A,T,C or G
agagggatttggaagccgtacgcgtccttccgcaccgtggtgaanacataattaaattcgccaggaagagaatcgagaaaatgccaaagcgcaggcagctcccgtgggccgaatgtggcaggcagttgcagccagtattgcccaatgcgcggagccaacggtgacatgcgggtcaaaaattcagtcactaaatcatcgcaatgccgtaatgctgcctgatgcgaaatggtcgccggaaacttaaaacagaagcggaagtcatctgtggtctgctcacgccagcgcaggacaacctcgggtttcggcagggcgtaaagcgtggtgttgccctccacgcagttaaagtggcgggcatactcttcaaggctggtgatccccaaccgcacccatttaggatgcgaccattgcggtagaccgatgtaaatcataacgcgttgaggatctcttccacgctacgcacacgggcgatgcgcgggtagatatggttgatactgttattgtgctgctcggcgctggcggcactacaggcgtcttcggcaatcaccagattaaagccaagttcccaggcattgcgggcggtggattcaacaccgatattggtcgagatcccacataacactattgtatcgatacctcggcggcgtaattgcaactccagatccgtaccgtaaaacgcaccccattgacgtttgatgatttcgatatcgctgtcggttgcacctaatgcagcatgatgttaccaacaattttcgggcacactttacccggtgagggcgccatcgaccggctgttgataatgttgagcgtaacagggaaacatgccatacgcaccagaaacacgggctgaccggttgggcgaaaattccctgaagctttccggcgccatttactaccttattcgcgatatgatgaccaactgtacgaaggaaagaagcctttcttgtgaagtcatctccagccgaccgatggggttttatcttgatattaacggttaattgacgatggaatatccagaagcgggcgttgcccttcatatcaatagatcgcgaggaggagataacgatgatcatgacgacagggacagcgacgacgttgaagggaactatagagtcttcgttgagcaagaatgaaatcatctatagaaatcaattgcggacgtagtggaagtatttgtgtcattgt

SEQ ID NO: 726 - DNA, 703 bp, Homo sapiens
  misc_feature (1)...(703): n = A,T,C or G
gacggtgcgcggaccttccgccccgtggtgaagacgcccaaagattttttttacaaaaaaaatcacatgtgaaagtgagtaaatctatttcaaaatggcaatgttcaactaaaaatgcaaaaatggtagctttatatttttcataagaaatgtggttttttaatttaattgaattttattgtttttttttggacacagagtcttactctgtcgcccaggctggagtgcaatggtgcagtctgagctcactgcaacttccacctcctgggttcaggcgattcacctgcctcagcctcccgaaagtagctgggattacaggggtgcaccaccatgcctggctaattttgtatttttagtagagtcggggtttctccatgttggtcaggctggtctcgaactcctgacctcaggtgatccgcccacctcggcctcccaaagtgctgggattacaggcatgagccactgcacctggccgaacttttcatactcagttatattaaagtccattggtctacctggtactatgaactgatctttcatctgtacttgattctataggtcacatattgatcattgaaaacctactggttcactgagtcatggagatctttcaaatgtttaaacgtttcattatacaacatccaaaaaactcagatttgttagtagaggtcttnacttggggcggaaggaccgcgtcacatat

SEQ ID NO: 727 - DNA, 2318 bp, Homo sapiens
  misc_feature (1)...(2318): n = A,T,C or G
cgtctcacttttttctcacttacgacttttccgtctgtgtgtagtcatgcatgagttgcttgtttactcgctatccgcgactctggtacgttctgcttcagacttatacgttgttattctgttcgttgtgtactctgttccctttcgtcgtctctcctcagtgttttctctgcgtgttccacgctctgcttctatcttcgtatgtcgagggttctttaatagtacggttacgtgtttttccgtcttgtttcgtctgcctgctgatgtgtgcctgtctgatggcctcgtgcttctgcagttctctcttttgtactttcttcttacctcaggttttcctgcgtttttgccagcttggtctccatttgtccgttatctgttgttctcttcttccttatcattcgtgctgcccttttgtattcctggccttgacgggcttgctgtgtcccctcgtattccttcctttttttgtttttatttctatcgcatttttccgtgtctagttatctttttttggtgcttctttcgcttggcgttggccttggtgtccctgtttacgcgcattggtgcggcgtctcttgtgctcttgttatagagagcccatagtgttgcaatgtttttcccgcccctctctggtcccagtatggagatgggagctctcacaagcagtaaaggagagacgtgcggtttcgaggcagtgtctgtaaggggtggagagcgcggggctcggagcctcgcagttttttgttgggggcgcgggcttcgttattcccgaggcagcaatggctccccctcggaggtccctccgcggagaccgcctcgcgcctctcgcagtccccaatccccgcccctcccagccctcgctgaccccacaacgtggtcggactgcggtgcctttacttgggaggccgaggcaggagaatcgctttaagcagggaggcagaggttgcagtgagccaagattgcgccattgcactgcagcctgggcaacaaaggcaagactctgtttatgtaaaaaaaaaaaaaaaaaaaagacttatagcatggatccatctgcgtaaaatttaaatgcatacaaaaatttttaaaaagttgatggacacaaacaaatgtagtaaaataatgaagaaaagaaagcatgataaatatgaaatctatgacagaggggggaagggaggagggcaacttggggagcatggcaggttttgaggatattgataaattgctatttcctacactggatggtgggaaggctcatattattcctctttatacaatgtctatgttttctatcatttttaaagtatgaagttttgtataatttgtgtaactaaataggaaggggccttttattagtcgagaatgtgcctgcaaagcccaaagggtgttaattattggagggagggggaagtcatcgatggtgatgaactgaagttcagtccagtctatgtgtctcacttcctttactcttgagtctccagtaccttccaaacgatgtaagagtagtgatcctgatccctcccatccaagctctgggcgtggcctccggagaagaaacatgaaagtatacagagaattggccaggagaggtggctcacgcctatcccagcactttgggaggccgaggcgggaggatcacttgaggtcatgagtccacttgaggtctagaccatcctggccaacatggtgaaaccccgtctgtactaaaaatacaaaaattagctgagcatgatggcatacacctgtagtcccagctactagggagactgaggcaggagaatcacttgaacccgggaggcgaaagttgcagtgagccgagatggctccactgcactccagcctagcgacagagcgagactccatcctccccatcaaaaaaagcccaccaaataaccagtaacaagagttcaccttcatattttagagcattgcacctaaagcaatcagtagcaaccttggaaatctgcatggaaaacaatataaatgttctggaatgtatggccaccaccacaaaaggcacacatactattttacaagcactagatttacagtattgggggagaaaataaattcaaatgtaattaagaccaatccacacaccaagactcaattntgtgcaaataaaacctctttagacagcaagccttgccctctgtagcacttttgtcttcagccctacaatggaggtgaatacagcctgggcttctgggagggatgcactgtncctgaagaaccctttgctgaaaaggaatatgagctctgggcacaatgggttaaaaagtggatcacatgtcaagaaaggtatagggcctttttgtctt

SEQ ID NO: 728 - DNA, 1679 bp, Homo sapiens
ggaagaccatggataacctagatattagaggaaaagcaaaggtaataaaaataagtttggcattaaaaggaggagacaacatttattaaaaaaattagtcaggtatgtgccttgtctctgagcatcagcaggccaaccttatttaatagttctttgttaaaagctaagaatttataccaccttaaagctgtcaggggctttagggagcccgaagtgtaattcatcagagttgatgcttacgtgtgatgagcctgagcccttgaacacttgatcaggatttttcctctataatctttatttttggtgaatgatattttggtatgtggaaagtgcacataagctactcaaatccaaatgctgtctctttcttttagttttttttttttaacctagagtaagacaagtctatagccctttattctatcattttctaatttagtttcctatattcccattacacttaatctccaacccaggaagaagatgaggggagaggaaaggaatataggattcactccatctccctgcagcgtcttgcaggtcaggggtctcataatgaattgagtaagttagggaccagcacttttaaacattgaagtgaaatcaaatagaaaacatcgaagtggcttgcatgtagtcagcctaaagtatgtttttaatcatatataaactctatgtctatgtatgtgtatgtgtgtatttatatatctcgtgtgactgagttgcaacataatatgtttatcttaccgtatgtcatagtcaaaaaactctgaaaatcaatattgtatcttatggattattctcttctcagggccatctttccaagggatcccaggacgggggtagttggagggccacttttttacagcctgtgtgaccaaaatgccaatgcgtcttcagagcctcgagttctcagtagctaagtgtgtcagagtagaggaacaacataggtttccagcactcatacttctcacatagcaaaaatgaagaattaaacagagtctcttcatcttgacgtcacctgcgttcttcacacagtgctttcaataccatctctggatgccatctttgtagattgtttgtttgtttgacatttacttttttttttttttccaattcggtaatactgattcttgacttccccctctttttggtacctttgtgattctccttgtaccttccttctttccctcttcccccttctgtgtatatgaatagacattccatgcacatcaagaatatgggggaagtgatgtttctcccttctcagtgtgtcacatatggatgtgtacagcgtcagcttgtcccaatactggagatctttttctgactatgtaaactctgagtgagtgtgtgtgtgtgtgtgtgtgtatacacaccagctatgtgtgctgggctaaggcttcctcccctagttaaactggtattctctggtttctcagtgtactgtacaggtattatatttcgtatgtaattagtaagtaatttttgagagggtgctattaatctctatcctcatcaaactttcacttgcaaattttagcattcattagtggcttttgcctagtaatgtaggcttggaatgtttctcaaaccaggcctatcactccgcaaccagcctcgtccattttgtctcatcctcgatataacaggatccgcgctacaaggatccgcgccac

SEQ ID NO: 729 - DNA, 1033 bp, Homo sapiens
atgaacccccgctgatccttccagccccgtggtgaagaccccttgtaaggcagcattaaagatcctctcattatgaggtggggaccgtatctccacccgctgagttgctttggtcaatgggaaggaggcaagcttatcacaggcagaggcctggaatgtgcttgtgagttgaggcccgttctctcttcctgccgagcctaaaacaggatgacagaccccatggagacaggcctcaggggtccccaccatcccagctaaggtccaggcatggaagtgaggccaccctgcgtgtttaaggcaactggtttgttaagcagcaaaaggtaactgacagaggaagggaactcatctatgccaattctggagggtcaaggaaggatttatggtggaggatgatattgaaggctgacaagttagagaaaagggcaatgaattcatggaaaaggagcatgcttccacaggtaaaatatttctttcttttttttttttttttgagacggagtcttgcagtggcaccatctctgttcacttcaacctcggcctcctgggttcaagcaattctcttgcctcagcctcctgagtggctgggactacaggtgcacaccaccatgcccggctaattttttgtattttcagtagagacagggtttcgtcatgttggccaggctggtcttgaactcttgacctcaggtgatctgcccgcctcagcctcccaaagtgctgggattacaggttgagccactgtgcctggcaattatttctttaatgtctgtcttaaccaacacagttgggttcccacgtttgctgtttcatttaatttgttgcaatatgttgttttggttgaggtctataaagaaaatcctgcctcttgcagacaggtagtaggaaaagaaagagtattttaatggcctttccgatcactgtaggcattgttcttggacactgcacccaaactcagcaagtggcaatttcttaaagtttagctgcatcagggagtcttcaccacggggcggaaggaccgcggtggcgtcat

SEQ ID NO: 730 - DNA, 1772 bp, Homo sapiens
  misc_feature (1)...(1772): n = A,T,C or G
cacgcagtctgccgtggtgaagactgcctttgtcttatttgtttacttgttggtctgtgttctggtcgctggaacgcaagcccggcgggggcccggggaggggccgccccgttaatcccgccgcctcccacccgcacagcgggcgctcggcctgtattagccggataaacatattccttgaggcgaagcctgggaagtgccaggattagagcctgcagcttaacagaagccgtgtgtgtgtgtgtgtgtgtgtgtgtgtgtgtgtgtgtgtgtgtaaaagcggacttgcttcatgaaatttcccgatttacttcccttctgtgggcctgtttccccatcaatttatttttttgaaatggagtctcgctgtgtcacccaggctggagtgcagtggcgcaatctgggctcactgcaacctccgcctcctggattcaagcattctcctgcctcagcctcccaagtagttgggattacaggtgtgcaccaccacgcccggctgatttttgtatttttaatagagacagggtttcaccatgttggccaggttggtctcgaactcctgccctcaggtgatccgcctgcctcggcctcccacagtgctgggtttacaggtatgagccactgtgcccggcctcctcatcattaaaatgagcaattgagactccaccaacactttcatgtccctttcaactaatttctcctaaagatcataagcagaaatgaccaagagaggatccatcagttttctgaaatttgctggaaaatttacactcaggtttcatggtgcaggtttctattaaataggtcagtgatgctccgcttgggtttagcagtgaggagccctttgtgttcctggctctgttggatgaaccagcatcccagtatgggagaggaatgaaggaggtgatttcacatagggattagtgctattaagaaagcaaaactaggaggctgaggcaggagaatcgcttgaacctgggaggcagcggttgcagtgagccagttgatccgggatcacgccactgcactctagcctgtgtgacagagccagactccatctaanaaactgtgacctcatttggacaccgcctccttgcaaatcaaaaaacctagggcaggcagtcatggcggctcatgcctgtgatcccatcccttgggaatgctgtccttggaggattggtagagccacctacttaaggactgccatcctgcctggtccaatggcccataaacccaactttgatgcctggcttcgctattccggggggttgaagccccctgccttaatccctggcatgttggcccaggagaaacttatcgtcaatcaagcatgcctttctcacaaagcggggttggaatgcctaaactgctcccttccgggaccgggcggtgctaatagcttataaaaataaacttttttttctaccgatctagaaatggaatattattccttttttactggcccaaaatgactttcttgggtacgggaaacgggacttaacccaaagttccccacctttgaagaaccggaatttaaggaagaagcaccctcccccgctttgaaggaattccaaaatccgcgccagcaaggagaaaaaaatcccccgatgggggcccaccttattactcgtctacatattttggggcgcacggcactgtttagtgttttctccggtgcggagcgccacacaactcttgttagttccttggtaaaccacgtaaaagagccgcaagattgcgtcatgtgtctgctccactcgccaacgagtgcc

SEQ ID NO: 731 - DNA, 2390 bp, Homo sapiens
  misc_feature (1)...(2390): n = A,T,C or G
gaagactcgcactgcaaactgctaggagagattactgctatccgcatatctagatcatacagaatattatctgatacatgcgtgtgctttacttcacctcaggtctagtggggtatagataggatgccaatcatagccatcagtggcaacactgtgatactatcgggtactatcaacctatcactatttcgtagctcacgctatctgagtaacttaggactacatgtgatcgctggcatgcccagctacttgatacatatcctttaccaaatactctatgttatgattaccatctattgaagagaagaatttccaatcattttattacaaataatttttgcaatgtatacatcattctcatgcacactatcatggatgatctcagaattacagatcaacctactctacctcagctgctttgtcatgtaaggtacatgtaccattattcagaacgagtgggcccattttcaatttcctgttgtaaggttagtctgtcttcaatctatcacaggacgcaatggcgttgtaactaagattcataatttccagtaggagaatgatttgtcatcacattccatagtctcagggttgactgtttcgttggtcttgctattgaatgattaagggaacagccaggagattttaaacactccttacaaagcgttttcctctggagacctacttggctgctgcttaatcttaatgtgtgcaattagaagttgtaaatgtattcagaatatatgggcttagagagactggttgtggctctgatagctgacagtggcagataacggcttaagggtagatgtacgattaatctgcgtctctgggttttatgatcaggcatctgttcgcatttgtgccatcgtttgtctttgtcgtctctcaggctctggggatgggccgtcctcatcaaccttactctatcttcccttggcctctggagcattggaaacctgtgactgtgatttgtccctcccacttggagcttcagacagtgaaaacagaaggtagagtgaagttggtagacactattagtgatcagataccgtctgccttctcaccaactattaaccttgaaatcagggggagtgggtgggaagggtttcatttaacactgcatataaacagttgagtgattgattagtcaccagggtgtgtagtgtgcttcttaaatgtctgatgtccacgtggcgatgcattctcctcttccggcatgtcacaggttttctgaccatactcaattctatctctaagccccagctaaagaatgagtaagtctccttaatttaaaacatcaaacccctcttatgcttaccattatctcacatacaaacaggtcaactaagaacaaataaataataaagcaggttaagtgtagtaaatggcatggttgtaattttttcacacgatattgacaatagctattctgattggaagatagatgtgtagacatcaaattagttacctggtctttgagtttttctgtgcatttctagatacattttaaatgtgatgattccatgttctatgaattttgcctttaaatttcaataaccaacacatctaaagtcatgattcctttcaggctatcaaacctaaaacgtatgaaagcttaaattgactgggtaactccttcctgtttttctgatttctgttttattgtatttctagttttattgcttatttctctctctctctctctctctctctctctctccatctctatctctatctctctgtcaactctatttgtatttctataatggaaactcaaatttgcctaactcagattgtagcacttttcttcctcaggctagtcctaggaaaactcacttgttttttgtatggaaaactagtgttagtagaagcctttattcttgcatagcccccaaatcagctttttcagctataatttagtaagtctaatgtgttcgactgaagtactttttttttgtaataacaagtgaaaaataatgaagagtgtgtcctggcgcagtggctcacgcctgtaatcccagcacttcgggaggccggaggccgaggcagcggatcacttgagggtcaggagttcaagaccagcttgaccaacatggtgaagtcctgtctctattaaaaatacaaaatttagccaggtgtggtagtgcatgtctgtaatcccagctacttgggaggctgagacaggagaattgcttggacctgggaggcggaggttgcagtgaggtgagattgcggcattgcactccagcctggacaacaagagtgaaactttgtctcaaaaaaaagaaagaaagaaaaaagaaaataataaagacagcttctagaatagtcttcaccacggggcctcaaggatccgcgtatgtgtcaaganggtccgcgcgtggcgtcat

SEQ ID NO: 732 - DNA, 1074 bp, Homo sapiens
cgggaaaggcgctacgtcccttcaacgtggagaaagcaaaatactaggtgaggagagagccagactcgaaagaaggacacttcggcccgccctttgggaacaacaggcctttgggccccttccctggggatccagcaaggggccacgtccttttccagtttatccctcccaacgagttcaggagttacccccccccccagttcatgcctttccctgtttcttcttcccactcacatcaggcaggcatcaaataggcccgagccccttagaaggtttcccccagcaacccagcatcctccccgaatcaggctctactctctcctcccctgctcatcgcaaaaggacttcaggaaatgaaagtgtggcacacattcaccgtctccatctcccatggctgcccactcctgggcttccacctgccactactcctgcggaacaagatcagacaagatctccacggaccttcaggtgccaaccctcactgcccctttggcgtcttgagcagatgggcctgttagcaacatccagcctcgctaaccagcccttctgcttgggaaattcctcttcttcggcttccctaagttttctggatttccggggccctctgccttcccagcctgtctcctttctgatcatgttatatcccagtttgccccacccctagtgcaggactaagcaaacttcatcccacactcagcttctcatcttcagcccggaagcctctcggagtgcccgtgggttgcaactgccctaattcaacaaaaacttacagtgtgtcgtctgacaggcacctcgcagtcagcatgttaagactctcctgccccagccgagctggcatcagccagcattccacgtgcagggacctgcccacagtgcacacagcggcacaagccaggcccctggaagtccccctagtgctcttctctccccgctgccacagcatcgcagggtccttccagatagtattcagatctatacacttttttttttttttttttttttttgagatggagtcttgctctgtcgcccaggctgtcgtcatagctgggctggaaggatccgcggttgtctcac

SEQ ID NO: 733 - DNA, 1624 bp, Homo sapiens
ttggcgcgcccctttgacgcggatccttacattccagggggaagacagttaaacacaatcttattgggaattaactctctcctggtacttctggctttagagaatagtgtgcactttgttttcccattttacccctgagatccttggagcccgttccccattagagtgttttggagctgggagagagtgcggagctgtctagtggggcctgttcattttctaaataatgaagcaggcccagagcaaggaagtgaaactcgttagtacaagagctggggatgccaggtccatgttcctgctgtgaccggcagatgtgagggcagtggcagggagtggagggacagtggtgtcctgcaggggtcagggcctcaggctgtaaagccaagactgcctgggtccaagtcctggccatacctcaggcacccttcacactctctgtgccccggcatcttcctctgtgcaatagggccctgaagagttttaacaccacatggttaatgagggagcacatgggacgcggtgcactgggcactccctgtttcctactgtcaggggacagagccagggacatcctcctctcatcaccaccagcaccgccctcccccaacagctcttccttaatccaagagctgacagctttcctccgagaatagaagcctgcctcagtcctgccagtgactcagtttaaaccagcagggttttattaacagcatgggtattggctgtcaggtcttgatgtttgataaattagctgattaaaaattcacacaatccagtgcattttttcatatgctatccagtggcatagctagtgtccctcccagtgtcacgtagagctgcagactctccccacacggagattgccgagctggcagctgcgctggggctctcagctcagccgtggttcacactgtcatcacagatcttccagccacgccaaaattacagtagcccagtttcactttgactagaaagtccctttgtcagctgtttcagtacattctgtgacatttagaaataatttaggtagctgtgttgggtgtgtacaattagtaagtgatggaatgagttgaagcagattcaatacagtgagctggtttcttacctccaaacttaatttgtgaccaaataattgattgctgggaggggaagaaaactaattccttcattttatttcccaaagtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaagtgagtggtgacaaacaggtttaatttcctttatcttcctatgaagtcttaccctagcacttgttttggccatttctaaagtaggtaggactaggtgattttttttcccatgagtctacagaatcttggaatttttggttttagttatggagtcattttggctgctttaactatgtctaaagcctctctgaaacagaagctgagaacaggtacgcttctggtttttcaggcccctcttgttaatgtaatttctcctttggataactggccat

SEQ ID NO: 734 - DNA, 2550 bp, Homo sapiens
agaggtcgccacgcgaccttcagccatatatgaagacacctaattaataccggtggtagtattacaatacatgaatcatgctattcacctacaacattttgagagagtgatatttggccataacggaagccttgaaatccccaatgcaagaattataaaagccataatctctcctgactaacaaaatttgccatcattaacaaaagtataaacaaaaacatcaatattgtaaaacttaaaaattctctgaaattagtcttagatcaaaaagaaaaccaaaaccagtttcaatattcacagaaaacaagaaagagaacattaaaacaaatcaaagcacacaagaactgaccaaagtagtaataacaagcaaattcatagcattaaattatcttttcattattaaatagaatagaataagtaaaagtgaatgaaagccaggcccagtggctcacgcctgtaatcccagcactttgggaggccaaggtgggcagatcacaaggtcaggagttcgagaccaacttggccaatatggtgaaaccccgtctctactaaaaatacaaaaattagccgggcatggtggcaggcgcctgtaatcccagctactgtggaggctgaggcaggagaatcgcttgaaccagggaggcggacgttgcagtgagctgagatcacgccactgcactccagcctgggtgatgggagggagaccctgtcttgaaaatgaaaaagttatcaaatttcttctcagagaggtaatggactccagatgacttcaagctaggcaaatgcttggaactccttgagaacagaaagataattattgtccccttaaaatattctcctgcctacagagaaaaagagagtacaccaactctttttaagaagctgtatcacctcactgaaaccgccaaaaacaaccgcagacgaaggccgattctagacacagacgcacacgtgctcaatgacacagctgcaaagtcaggtcagaggaccaacatcagcctcttttaacagacagggtttgtcttctaaaacgcaggaatagttaaatgtcaggaagctaatacaataatataaataaaatacatgagaagccaaaggcagccggggggagatgcaattatccttggataccccccccaaaaaaatccaacattcatgctggctagatgtttaatgtcatcacaaatacctactttaacaagcaatgataaactttcaacttaactgtgagctactagtggcagtcccattaaaatcaaggatgagactaacgttgaatcaaagaaaaagagaaaaagagatataattattacaaagacagaaaaagaaactatattatttgaagacaaagaatgaccatttgaaaatagttcactgaaactcacagaattttataaaatcccatatatgaggaactgaaaatacataaagtagttaccaataaacctaacataaaaggtagagaacctaaagaaatgtataaaactttccaagattccataaataaaattataggaaattttttttctttttgagacagagtctcactctgttgcccaggctggagtgcaatggcatgatctcagctcactgcaacctccacctcctgagttcaagcgattctcatatctcagcctccgagtagctgggattaaaggcatgcgccaccacgcatggctaattttagtatttttggtagagatggggtttcaccatgttggccaggctggtctcaaactcccaacctcaggtgatctactcgccttggtctcccaagggaaaatcttttaaatgggaaaaaatccataagctaagagataaaaatttgaaatccttaaataatcatgatctattacgtaacaacacaaaaaaagaaaaacctggccgggtgtggtggctcatgcttataatcccagcactttgggaggctgaggtgggcagatcacgaggtcaggagatcgagaccacgatgaaaccctgtctctactaaaaatactaaattagctgggtgtggtggtgcacgcctgtaatcccagctacttgggaggctgaggcaggagaatcacttgtacctgggaggcggaggctgcagtgagccgagatcacaccactgcattccagactgtgcgacaaaacgagacctcatctcaaaaacaaacaaacaaacaaacaaacaaaaaaaccagaaatacctgaaagctgtgtgccgtggctcacgcctgtaatctcagcactttgggaggctgaggcgggagttcgagaccagcctggccaacacagtgaaatgtgatctctactaaaaatacaaaaattagcagggcatggtggcacagctactcaggacgctgaggcaggagaatcgcttgaacccaggaggtggaggttgcagtgagctgagactgtaccactgcattccagcctgggcatctgagtgagatcttgtctcaaaaggaaaaaaaaaaaaaagaaaagaaaaaaaatacctaagactgggtagtttttaaagaaaagaggttgtcttcaccttcgggctggaaggatccgcgccac

SEQ ID NO: 735 - DNA, 2624 bp, Homo sapiens
agatggatgtacgcgtctttccacccgtggtgtattctccgaactggcagtgggcctgaggccatggggatgagtgcatggtccaagaataacacagtgggtctgtggtgaatgggaaggcacagacaggtcctgcccgaacactttctaaaacaccatgtgggcttaaaacataagtctgtcagaagggagccccacgaggacccggatctttgtgtctgtccaattcgtcgtgtcgtcccggacatgttgtaggcctcaagaattatttgttgtcatgaagtcggtctggggcctcgctttctatttgtgtctgtagtttgtaaactttatgccaaataaagctgtattttttttttcgtctacctgttctgacaaggacaaaaagaagtgtattcctgtgagattctagcagccagatggtattttaattcacagtaaagttcatgatttgtgttgtgtctggatactatgtgtcatccatagtgaaacagccgttgggttggaaggtagcgcatgtggcatcgttgagagccgggtgtgaagcctggcctcagctctgccagttgtctccaagtctcattttcctcatcttcaaatgagcttgggttatttctccccccagcttactgtgaataataaatgaggtgctgtctgtgaatccatcaacaaaagcggctcatcacacaaggaacaattcatacatggcacctattggttattttggtttttgattctttttctctcttcttggtatttttgttgacacctcttccctttatgattgtttgtctgatacatcctggcctgtcctctcctttatttacaatctttgggttatattatgctttagttctgtgtattaaccgtaatactcagttttgtttattttttgaactgatacaagtggatgacttttatctgaaggatttggctcatttatcctgactgctgtgttgattatccagcgtcgcatcccatgcttgtttttactgggtgcccgcttgccatgtcactgtcactcagcctgaaccctgctgcttttcggcctgtcccagcctctccagggctctcagttgttcacaggcagggtcattttccccattggctttgcctctccgcctcgctcgtgactgggggcacccgtcccgatcctggtttccgcagtgttggctgtgtgtgcgcctttgccgctgctcatctctctgccaacagcctcaccaataatcaggcctatttattttctcattttctcttctcctaattcttgatctcatcatttgtgtctctcttaagccaacgtccccttaatttctttgttacctttttcatccttagtcttcagagtctgtgttttcttgaataataagacaagttctctggtagaactatgccagtagcaatagtagtatctttcccattcaggttataaaatctacttattgtcctccgcatgagtaaccttcccttgtcccgccccctgcagacactttggtgtcatccttaggctctcctcctctcctgtgaaggagaaaagtggtattcagctttcgtgtttatttccaaaatagacctgaatttctgcttgagttgcataggttctgttcccattcaaggagtggggaccagtgtagtcagctatggtcccaggggagcaggtgggagctgaggaccttgggtgtctaggggaagccattgtcacacagttcattcttcgtgtttgaaggcgctgatgccagggctaggggtgcagtgctatggttgctgtcagctgccctgtcgggaggaaggctgtcatttggggacagtccctattgtcactaccagccttgcctgattaagatgccctcagatgccctttccagaacaactaagggctctaaatagtgtgctgtccttgcctgggtctgcgtttatgtttctcccgtggagggcggagtggaacgattgggtttcccttgacactcttccagggtggggctgcacgttttctgatggaagtaagctgtgggttggctcgaaagtctctctctactttgatcctggagaatgttttcactttgcttggcatttcagttgagatttgaggtggaaattccccagaatggcgttctcatcgccctatggatcataacctgctcctttggcatgcttaggttttaaaaaggaaattgtctaatattgccaatccatggccctctgaacaaaacctcgattatacctgtggtttaaaatgaccatattgtcccttccgctttaattgttaggggcctggacctaacttttatttagaaatgcgttatagggactaccctggcgggtatcttaaccgagagacttcgcccctgcaattaaagcgtgttacccttgtttttccgggggcttagattcggataatagaaccggaactcgtcggctttgaatgccattcctacaggaacttcgttccacattctacgccgcgctcgagcgttcctcctgatcaagtgtggtagagctaccttccttcccagaagccccctaggactcttgaaactccatctctcttcatgtccaagaagtaagcttcccgcttgcgaagctaacaacagtagtagcttctaagatttaagaggacgacgccg

SEQ ID NO: 736 - DNA, 3419 bp, Homo sapiens
aatctttacctaccctagggtcacaaagatgtttttctttctttttaaaatgtctttagaagttttagtgctgtagctctttcatttaagattataaatccatctgaaattactatttgtgtgttgtatgaggtagggatctgtttttttttcttaacaatatccagatggttccggcgtcatttattggaaatgtttttctttgcccattgaattgctctggtgccttcgttgaaagtcagtttactgtatgtggccttccattatctatgcctatctttattccaatatcatgctgttttgttggtatagggtaatagtaagtctagaaaccaagtagtgttagtcaataactttgtttcagaattattttagctattctaggttttttgcatatcaatttaaatttggggctcaactcatcaatttctgtaaaatcctgttacattgaacctccacctcctggcttcaagcgattctcctgccttagcctctcaagtagctgggattacaggcacgccccaccacacctggctaattttctgtattttttggagagagagggttttcaccatgttggccaggctggtcttcaactcctgagctcaagtaagccatctgcctcagcttcccaaagtgccgggattacaggcatgagccacctcgcctagcctcctgctgcaaacttctaagaagagactgaagatgcaaaatcaattctctgccctcagcaaacagaaagacaccccaagtctgttttcatgctaaagacttgaaacaagaagacatacatgcagccaaaaaacatatgaaaaaagttcatcatccactgatcattagagaaatgcaaatcgaaaccacaatgagataacatcgcacatcagtcagaatggcgattattaagaggccaaaaaacaacagatgctggcgagcttgtggagaaataagaacgcttttgccctgttagtggggatgtaaattagttcaaccgttttggaagacagtgtggcaattccacaaagatactatttgacccagcaatcccattactgggtatatacccaaaggaatatatatcattctgttataaagatacatgcacgtgtatgttcattgcagcactattcacaatagcaaagacatggaatcaacccaaatgcccatcagtgatagactggataaagaaaatgtggtacatagacaccgtggaatactatgcagccataaaaacgaacaagatcatgtcctttgcaggaacatggatgaagctggaagccgttatcctcagcaaactaaggcaggaacagaaaaccaaacaccgcatgttctcaacttataagtgggagctgaacaatgagaacatgtggacacagggaggggaataacacacactgggacctgtcaggagagggtagggctgggggcatcaggagagcatcaggaaaaatagctaatgcatgctgggcttaatacctaggtgatgggttgatagatgcagcaaaccaccatggcacattgttaacctacataataaacctgcacatcctgcacatgtacccagaacttaaaataaaagttgaagaaaagataaacaaacacatgtccataggtatataaaggaaaatgtatacagataccaaaccatcacattgtacacctcacatacatataatttcattaattgtacctcaataaatatggaaaaagtaaaaaaaaaaaacaaaaaacaatttatttatgaagaaaagaaagaagcagcattgtttcccaggttggaagctgtcactaagactgcttgtggtggatggccacagtctttgcagcccttcccatctgaagtggaacagatcactgtaccccaagacccggggctggcctgggacttccaatggctgtcagtggcagtggccatatgtgatttccaagcctgggcgggggaagactttgtgcttcccactctccccactgccccgttcacaccggtaccctctaatctggccccgcgatctctgttctcattcttaagaatgaggctttttggctgggcatggtggctcaccaggatcacttgaggtcaggagttcaacatcagccaggccaagatggtgaaaccccatctctaccaaaaatacaaaaattaactgggcgtggtggcgggggcctgtaatcccagcaattcaggaggctgaggcaggagaatcacttgaacccgggaggcggaggttgcagtgagccaaggtcactgcactctagtctgggtgacagagcaagatgtctcaaaaaaataaataaataaatataagaggctttttctttttttttctttttttttttgagaccaagtctcactctgtcaactatgctggagtgcagcagcacgatctcggctcagtgcaacctccacctccccggttcaagcaattctcatccctcagcctcccaagtagctgggattacaggcacacaccaccaccccgagctactttttgtatttttagtggagatggggtttcgccatgttggccaggctggtctcgaactcctgacctcaagtgatccgcccaccttggcctcccaaagtgttaggattacaggcatgagccagtgctccaggccaagaatgaggctttaatctggagactcccggctgcatgaggccctggacacattatgagctcatgcaggacccagagagggtggggccggctgtaagttgtccaattgagcccagaggacacacatgaagctgccctcgcatggccaaaccccatcatcaggagaaaggcggggtggctgctttacgctgatgcatattttttgagtgaaaaactatgtgtaattctggaataaaagccgcgtgaagaagaggcgtaatgttgagacaacatttggttcacggtccaagatgcctatggggggacgctggtcgtttacagagggggggattcttggcaggacagcagtggaaattgtactttcatgggcgcacgctcttatggacgtgttgaagctatgtagtcagaaacgcgaagagggtagacggcgtgtggagtgggtacgcacggctgagtgcgccgagttgtgagctcctttgtctgcgtagcgctggagtgaagaatgtaggaatgacgcactgcagaggcagtgccttccggagtgggtgcgtcttgggtaagagagggagagtcgacgatgcgctgagagaataggagtgtgcggatgatcgttaggaataatagcgcgattcacgatagagatgccgaagtggaaggacagtaatgtgtggacctgtagatgagcgaggcaacgggaggtaaccgctgggatagagagctggagggtgcagtcgcacttcgttgtagacgttaatgatatgggcggcgtcggatgaggcgcaacgttgatgcaggggtgatacc

SEQ ID NO: 737 - DNA, 4149 bp, Homo sapiens
atgacgcgtccttccagccccgtggtgtcaatagggaggcatgtgtagaagtagcaagaatagtagagtgagccctttatgtgcccatgacccagtttattgttcctcaattcttatttactctacttcctcctgaatacacacacacacctacactcacacacacacatacaatgttttcgagaataatttcaaaaattaccaatatcatgccatttcacctataattatgtgccattttacctgcaaatgtactttgataaagactttttttaaaaaacataaacacagtggtacaggtaacttttgtattggcagaccacagtcagtaaggaagaaataaagaggggtttaagagcgttcatacaacctaacatttttatcaatacagtttggaagaaatcaaggaatagaatttggagggggaaaaagagaggaactgaatcatttggttctggatgtattgacttagtgacaaatattggactcgggtaaatatccagaatagagctgagaatgtaggactgtcctcagaggagggcacagttggggacacagccatgtgagtcactggtgtccaggtgatggttaaagcatgaaaacagtctttttttttttgagacagagtctttctctgttgcccatgctggagtgcagtagtgcgatctcggctcaccgcaacctgcggctcccggattcaagcgattctcctgcctcagcttcccaagtagctgggattacagatgcccaccaccacacccaactaatttctgtattttgaatagagatggggtttcaccatgttggccaggctggtcttgaactcccaacctcaggcgatccacctgcctcggcctcccaaagtgctgggattacaggtgactgccactatgcctggctaatttttgtatttttaatagagactgggtttcaccatgttggccaggctggtctcgaactcctgacctcaagtgatctgcccacctcatcctcccaaaaggctgggattacaggcatgagccaccgcgcctggcccatttcccaccctaaacactcagctgtcaggtattacaccacttacgccgtttcccagaagctaagggtgcaggtcatgcctctgtttggtcaaggccgaatttcctagtacacacccactatatgtcatcaatatgaaagttactagtgacatcatattttacctttttgtgtgtgaagtctttgaaatcctgtgtgtattttacactcacagcacatcttaattcaaacagggccttagacgtgccctggatcagccacgtggccacgtgtggcgagggctgttgtgtgctcagggcagctctgtttcaggatttctgaaacttactcacacgatatctgatcctggaggacacatgaacggacatgtgcccagtgagggttagtttgtaaccggtgagtgaacttcagcccccagggctgctcttgtggaaatgttgtcttgggagctgggtttatgatcgcctacctatctctggctgaccttcacaagttagtttgattggatttcagtaaagacggttttatctcttttaatttgaaatgcctttgtttatgctcaagtcattattttttagtgttgtttatatcagccttaatttgacattgtacctactttgtaaaatatacaatcctagtgggctcctcaccaggtcagcatgctaggctgttaatgcctagcacgcgtgatcaacgtaggttatgttttgggatggcattactatgttggtttgtgatattataatatatcttttaagtgttttttttttttctttattaaaggagtctcactctgttgcccaggctggatggagtgcagtggcgtgatcgtggctcactgcagcctcaaactcgtgggctcagacgatcctctccccctcagcctcgtgggtagctgggactacaggcccatgccaccacacctggctgaaattttgacttttttttttttgtggagataaggtctcactgcgttgcccaggctactcttgaactcctggcctcaagtagttctcctgcatcaacctcctaaaatgctagaattacaggcgtgagcgtctgtgctggccagtttctgatattataatattgatttgacattttcaagaatttgattcatttcacatttctgatcctgaaatatatgttgtgggaagtttgaaaatattttatgtaggattttgatttcttgctacaatatgtaatagatattcaggatgcaaacttgagtacttctagttctagtccacgtttagagcgctttgtctaaattcatcagaatttcaccagaaaatgtaaaaatttcaccaagaagaaaaaaacacccacgaacaaattaaatgtgtatcttaatggacgcttctaccaggagaagcaatggttatggtttaatatgtctccattgggctcaaaacccctcatgcctgttttcacactcttttcctaataagcattcttctaagaggacattatctaaactcaaatatttatttatgagctatatttaaaaaatcctgtttgagtaaatattgcttgaagcagttatcaaattcaaacaaaaaaaagcacagtgtcattcataatggcccatcaatatgctttgcaaaggctaagttttcaggtgttatctttagagtgaggtttttctttttttttttttctttgttttttctggaaactttgagtcacccccttctggggcctaatttatctactttgccttggcacttgtgaaagaaaagtaacttcttcaagttgctgtgttaggcaaaacctaaagtgtaattttactttgtgtacatttactcatcaaaattcttttggaaattaaaatatagaaagcaggacagatctcattggctgtcacaagtgcagttcctgtacaggtgaacttcacaagtcaatgcatatgttagcgctggcctaatcggaatgagcttgcgtgtctccttatcccctaaaagtctgcagtaaaaaccatcgctggcttttggactacttaatactttctcccctttcctgcatggccccattggctttatgtctgattacctcggaaagtcatcttggcagcagctgaaactacacagaccataccttttattagagttcccaccctcctggaaacataaaaatgcattgaacacgtgggtttcacctctagactacctcttttctgtgccaaccctctcacctctgcaggagaagctccagggattgatcatgtcccaggaagctaatctttttttttttttttttttgagaccgagtctcgctttgttgcccaggctggagcacagtggcgtgatctcggctcactgcaagctctgcctcccgggttcacgccattctcctgcctcagcctcccgagtagctgggactacaggtgcccgccaccacacccagctaattttttgtatatttagtagagacgaggtttcaccgtgttagccaggctggtcttgatctcctgatcttgtgatccacccgcctcagcctcccaaagtgctgggattacaggcgtaagccaccgtgccccgccactaatcatttttaatagcttctatgaaggtgagccctcattggggatttctggatggaactgcaaatgttctttatgtctgtgtgggtttttttgtttgtttgtttgcccccatgtgagatccctgggaattgagaagtttgaaaggaactcagaagtatgaaaaacgcatccattccagagcatagatcttgagtttactttttccatgacccggggctcaaatgtgtggtaccatcacaagtattgtttgtaattcattaaattgcccaggcagagcatggtaggggaatcttctgaataaaatgaacaatcattctgagttgtttactccatacatttaattgtttaaaaaaacaaaaatcttctctggaaatttcctgttgatgttcctgtttcttgagtcgccccagtagatggggtgccacactctcatccttttattttgtgaagggtcacgggttgttcttttaaatttatttaactatttattttttagacgagtcttgttctgtccgtcttcaccatggggctggaaggatatcgcgctggaatgatccggcggcgctcac

SEQ ID NO: 738 - DNA, 3223 bp, Homo sapiens
ttaaaaacaaaaaaaaattgcgcggcccttccgcccgaggggaaaccctacgtctcagcctcccatagtgttggaattacgtgcatgagccactgcaggcagtcggactaagggagtttaaacaaagaagccggagcctggccctcttcgggcttcggtggggcccagtaggcagccaaaactcacactgagacggcggctgctctccaggcgggtttgctcaggctgcccccgtgctccctgccctgggcttcagtcctggagaggacccggtttctcaacccgtgcatcgttggcactttgagcgacgggactgtcctgtgcgttgcacgatgttcagcagcagctttggcctctgctatccactaggggccagttccaccccctagcacctcaggttaacaaccgaaaatgtcttctagactttgccgaaggactcctgggggcaaatacgcccccattgagactcactggcttagaacaaggcaagctccagcctgtttcaggctttcccagagactgcccctacaccatctatggttgcatggctggcttctcatccttcaaccttccaccgaagtgttgacttcagagaaacatttttttcactagcctgtccaaggcccgagtatcccattccatcatgttactcttttctccttattacctgttacattttttaatttattcgtttatctccccaacctgcatgtgttaacaggtgtaagcttcctgatggcaggattctcttgtgttttgttcctcactgtgccccctgcctctgggacagcgcctggcacatagtggagtgaaagagtgccgcccaaaaatggccctcagcatggcttcagaaattgagaccccggcctgggatggtggctcacgtctacaatcccagcactttgggaggccgaggcggacggatcacgaggtcaagagatcgataccatcctggccaacatggtgaaaccccgtctctactaaaaatacaaaaattagctgggcgtggtggcaggcgcctgtagtcccagctactcaggaggctgaggcaggagaatcgcttgaaccagggaggcagaggttgcagtgagccgagattgtgccactgcattccggcctggtgacagagtgagacttcgtctcaaaaaaaaaaaaaaagacaaaaaaaaaagaaattgagaccccggcctgggatgatggctcacgcctataatctcagcactttgggaggctgaggcaagaggattgcttgagcccgggaggtagaggctgcattcagcagtgagggcatcactgcactccagcctgggtgacatagtgagaccctgtctcaaaaaaaaaaaaaaaaaaaggcaagaaagaaaggaatcgtgatccacagctgctgcaatgattcaattagtgtaagaccacctcctcttccttcatcattccctccagctaagatgagggtggagccagtagctgggaagttggcttgccagtaggtcatctggagaagtaatcctgccagtaagtcttgaagttgcatgcattctctttttaaaaaacttttttaaatgtccgacagatagactgatggtcagcacagtgctgccacacagcaggcaatatatatttaatcaatgtctaaggagagaataattgaatgcccgaattggacctttgccacctgtctgttgatgcttgtcatttccagctgtcagctcaaatatcactttcctaaccctgccacactaggttagctccccgtttttatggccttggaactccctatacttttttcccacagcaccggttataatttatacttattttgtgcaactattgaatgcctgtcttcaaagctgggatggccgggatctttgttttaaccacgattgtagttctagaggctggcacagcacttgccaatgataaataggtattagattgaactggatgagtgaatgactgaccatttgttgaatgtaaatgatgcaagtcaccttatgttctcatatatgtgtgtgtatacacatatgtatatctgtgtgtatatatgtatatatgtgtgtatataagtgtgtgtatatgtgtgcatgtatacatgtgtatatatatgtgtctatacatgttcaagggcatatattagtattttaacttattattggatactaatatatgtccttgaacatgtacatatagacacacacacacacatatgtgccattttttttttttctttttgagatggagtttcgctcttgtaacccaggctggagtgcagtggcacagtggctcatgcctgtaatctcagcactttgggaggccaaggcaggcagatcacttgaagtcaggagttaaagaccagccgggccaacatggtgaaaccccatctctactaaaattacaaaaattagccaggcggtagtgttgcgcacctgtaatcccagctactcaagaggctcaggcaggagaatcgcttgagcctgggaggtggagttgcactgagccgagatcaccccactgcactgcagccggggtcatagagcgagactgtcgccagtgtaaatagacagacgaaagcggttgaagtgagacttccgcgatagggtgagatcgaatcatgaggacaaggatggttacacttggcacagggtacagacacaggagaccggagggtggtggagtcacgcccgcgagtccgacctcagagtacgagacgttcgtggaacgcgatacgtcgtacacgagcgtggcgagtcaaaagttactcgtgatggtctggcgagggcatagccgcatgcagtgtcaagtccacggggcgggttggcgacggggttatactgggagcagtggtggatcctttacgcacggaacaacggggtaccgtcagcgtggcgacgcttcagggaagacagaggcagtgctcatcatggatgatgagagggtcgtctttgcatgacacggacatagagtaaaggcgaggagcattatcgctgcggtagtcggctgcagatccccccaggtatgcacgagatctgtcggcagtgcatagatgaggacgcgagctgaggccgagagcggacttgctgcgctgcggcactacgtcgtgctagacgctagtataggtctgcgcactacgatgcaacgttgcgtggctacgccaggagcgtacgacgcgcggtgcagaatggagaaatgctcgtagcttcgcgacgataacgttgtcactgtcccc

SEQ ID NO: 739 - DNA, 4125 bp, Homo sapiens
  misc_feature (1)...(4125): n = A,T,C or G
taaggggcacaaaagggcgggtcttttttttctcagggggaagaaaacttttccaaaagatagtgggaagcttcccctatctcaccctgggccaaaaatttgtcacaaggtttcctcgggaagagtccttggcaaaaaggaataaccaacccttggttgggttggtcccatccatgattccatacctgggggtgggaaccaatatcccccggaaccaaatccaatccaagcaaaaagccaataaataacctgatgctggttgggtagcctgtttgccaaaatggccccaattctcccccctttcggtatccccgttccttccaatatgcttttccagctcctcaataaccacgtggagcctatttcaaaactatgcccttttaaatgtgaggcatccctacaatgggatattacccatagccctaaaaagaaggaagcattgatacataccccagtatggatgcactttgagaacatcatgctaagagtgaagaaagccagacacaaagggcctcctattctatgattccgcttatgtgaaatgtccagaatatgcaaatccatagagacagaaaggagatttgtggttgccaaggtctgtgggggagagccggggggattggggagtttgggggtaatgactagaggtgaagggtttctttggggataatgagaaagttcccaagttgactgcggtggtgtatgcataacactcaatttactaaaatctgttgaattgtattccttaaatgagggaaataggtggtatgtgaattacacctgatatagtttatgtccccacccaaatctcatcttgaattgtagttcccataatccccacgtgttgtgggagggaccaggtggagataatttactcatgggggcagtttcccccatcctgttctcatgatagtgagtgagttctcaggagatctgatggttttataagggatgctccctcaacttcactctgcacttctctttgccgccaccatgtgaagaaggacatgttttcttccccttctgtcatggttgtaaacttcctgaggtctccccatccctgcagaactgtaagtcaagtaaatctctttcctttataaattacccagtctcaggtatgcccttagagcagtgtgagaaaggactaatacaacatcttaataaaggtgttgaaaaataatctacacctcttgtctcagagctggccttgtgacttgctttgtcctagaggagggggcagaagtgatgctgtgtctgttctgaggcctccagaaaccttacacaccgctgacatttctcacactctgggggttgtcatatgaacaagcccagactggcctggggacaatgacacatggacctagtaaccccatttgccccagcagacagcaagtcacccagcaggcatgtgagtgagcccatcctgggttactcagccatctctccagatgactggactgtgagcaaccaaccaagatccaccgagccacccaactggcccatattctcaggatcaataatgagcatgtgttgccgagtccctaccacttgggaccaccaggtgacccaagtaataacttacacagttccatccttaattcttgctcaacagcttcatccagacataactcaaacatcacagctcatctatttcaccaattcatcaattttagaaccattttcatcacccaagaaggaagctcagtgcctatgaacagccactccctgtttctcccttcccagtccctgaaaaccatgaatctactttctgtctctctggatttgcatgtctttggcggttcatataaatggtgtcattcaatatgtgggtttttttttttttttttttggcgactagcttctttcacttagtgtaatgctttcaaatttcttccacattgcagcatagcctcataactttttatgggtagtatcagttatttatttgcttccttattctctatctttctctagtaaaattgaagatccatgacttcaggagtttgcttgttttattaattgcagcttctaccttgcctagaactgaactttgcacatagaatgcttctcgaatgaatgaatgggtggatgaatgaatgaatgaataggaaaatcagtttgtttccctcctcctattaaaaacaatgtcgaatgaccaaagaacctgaacaggcactgagttaaaagcttgtctgggccagggcatgtctcgttgccacagggggcaggccagggactcaaatccagctcagtccagctccaccagctctctgcactttcatgaagccacggggacaactgcttctttccccagcttcacatattttgattccaggcttttgcaaagcaatgttctttttgctgttgcataccaacaacaaaaaaattcttctttttgcttctggcaaaattgacaaaattgacaatggaagacaaaggaagttttcttacttggtaaagaaactggttttgctttaggtgggaaaggtttccccagctccattccctctcgatgtgtgttaacagggacgggggaggcctcactccctactgactacccgtgcatttactttaattccagggtcctgggtgggaatgaattacagggttatttaagcttgttttgccataagccttgacaaagtctttcttttcacaaaaatgtccttcattttcaaaactctgtttggcagtggagggtgcagcctgtaatccttttatgctgtggtggtgtctgtcctccacgtgactagaaacgtctttattggcaacattttgtctgggtaatgggggaagagagagagaccctgcctcaaatcacctggatgagaccctggttgcaaggggtagtcctatccaaactaacgctgaggccctgggcttcgtgacagcccgtggcacgttctcagttgtttctagcatgtctagcaaacctttggaggtcagagcctgtctactcaggggtgttcacttggagaagggcaaacacgttggggagagtaataatttgcagacctctggagaaccattcggtgctccagagctgacacatcccccacgctgtgactcgccaagccattctgtaatggatgcacgtggtgcacacctataagaagcattttcaggcctagggccaaaagaatatatcacaacgaagaaaaatggtggcaagatacatgggccaatagccggtaattcaccagcgttgaaatcatagccagccattaaggactctgtgaaggaaggagaagggaattcgaattgtagtgtggtctcttagctaagtgtctccggggctggcccagaggtgtgaatgccttaaacctcccagtagctttgcctggtgggtgggactcctgtggcctagctgaggacactgagatgaggaagaattggtggaatttaaaaaaaatacctatttccatgttttctttgcatacaatacctgcttgctgtaaaaacacaaaccattaaaaatatatatatatcaagtagaagcaaagccattcctcaccgcagcccaccaagagacagccactgagagttgcttgtcatcttcctggcacatatacatcagtgtgtgtataaaatgcattattgttntaactcaaatgggattataatctttatattggtattcatctaacttgaaaaaaaatcttggtataactaaattttttacacctacacaaaaagtaagagaagagtatgatgatgttcacccactgagctttaactcttggtcatgttctgccgaactacttttatctgccatatctcacttaaaaaatttttttgtttgtgaaatggtagatcccaaagttaagagaagcctatcatgaacctttcctggggtcctaatttaagaacaaccgtttcagcaagttttaatattgaggccaaaccttaaaccctttctggttaaaccttcacctctggattttttaaagggcaatcccggacgtgggccagggggccaccataatccctgtattcccccggttctgggaagcgtgggactttaaacacgcccgtggaaattaagaggacccctttttcacaaaaaaaaaataatagtcggggtgggggcttcctatggacccccactattgggaggcaaagggg

SEQ ID NO: 740 - DNA, 2664 bp, Homo sapiens
ttacgcggtccttccgccccgtggtgaataccgtgttaagaatatgctttaggcttgagcctaataaggaggcagataaggtcgggtggctgattgagaagccaagtttagggccgggcgcagtggctcatgcttgtaatcccagcactttgggaggctgaggcggggggatcacaaggtcaggagttcgagaccagcctggccaacacggtgaaaccccgtctctactaaaaatacaaaaattagctgggcatggtggtggatgcctgtaatcccagctactcgggagcctgaggcaggagaatagcttgaacccgggagacggagcttgcagtgagctgagatcgcgccactgcactctagcctgggcgacagagctagactccatttaaaaaaaaaaaaaaaaaaaaggtagaagaagccaagtttaggaagctatgattttctgtttttctcagccgattactgggagagacaaacctctagcacaagtactgatttaggaataagacccttacgtgggtggctccgagtcaactcacttggaaaatagcttgtgtgctactcttcattctcagtgcatttcagcaaatgctctttgaggacctaactttgagtgccatcatattagagcaaggggtgcagacataaataagagaatcttctagtctataaataaaacccaagaccttatgatacatggcatgacatagaagggaaaggatttacttctgagagacctggagaagatttcagaaacaagggatgactgaatagggttttgaagagtgaataagagtttataaatatatcctcgaaaaatgaaaaatagaactaccgtaggatccagcaatcccacttctgggtatatgtgcaaaggaaatgaaatcagtgtgtggaagagatatctgcaaccccatgttcactgcagcactattcaaaataggcaggacggggaatcaacctgtgcccattgatgttaaatggatacagaaaatggggtatatatatatatgtaatggaaaacgaaggatattctgtcgtttgtaacaacatggatgagcctggaggacataatgcgaaatacaataagccagtcacagaaatacaaataccacatggttctcacttgtatgtgaaatccagaaagtcaaattcatagaagcagagagtagtaggatggttaccaggtgctcaggattgtgaggagattagggaaacgttggtcaaaaagcacaaaatttcagctaggaggaatacattcaagatttattgtacagcatggtgactgtagtgaataacaatgtattgtatacttgaaaattgttaagagaggggccaggcatggtggctcatacctgtaatcccagcactttgcaaggctgaggcgggtggatcacttgaggtcatgagttctagaactgcctggccaacatagtgaaaccctgtctctgttaaaaatataaaaattagctgggcatggtggcactgcctgtaatcccagctacttgggaggctgaggcaggagcatcacttgaacctgggatgcggaggctggagtgagccaagatagtaccgctgcactctagcctgggtgaccaagtgagactctgtctcaaaaaatagaaaaaaaaattgctaagacagtagtaggttttaagtgttctcatcaccaaataaatgataaatatgtgaggtaatacatatattaattagcttgattttttttttttttttttaagaaatgggatcttgctgtgtttcccaggctggtctcaaactcctgggctggagcaatcctcctgccttggcctcccaaagtgctgagatgacaggtgtgagctactgtgcttggcctaattagcttgatttagctattccacaatgtatacatattttaaaacatcatgttgtacaccatatatatatacaataataaaaagagagtttgcaaaaatattttatctacatcatgttatagcagaggacttccagaatttttcaattgtaatcatgggtgaatttataagtcttatttttttgagacagagtcgagactctttcgcccaggctggagtgcagtggcacaatcttggctcactgcaacctctgccttccaggttcaagcgattctcctgcctcagcctcccgagtagctgggattaaaggcatgtgctaccacacccagctaatttttgtatttttagtagagatggggtttcaccatgttagccaggctggtctcgaactccatacctcaagtgatccacccgcctcggccttccaaagtgctgagattacaggtatgagccaccatgcctggcccctctcttagcaattttcaagtgtacaatacattgttatttactacagtcactgagtagcttggccaaaggcatgcctgttctaggcggagaagcagaattctaacctggggctgtctggagtgaaagtcctgtgatttctccagataggtcaaattagctttgacatatatgagttattgctgctggtctgattgagtaagaaagggctgtcatcttaagtactaaatatgttcacaccttttaaacaacctcgttgatagtgtgtatcttttaggtgtctatttttctgtctttgggaatttcactgtcttccccttcgggcggaaggtccgcgcct

SEQ ID NO: 741 - DNA, 3974 bp, Homo sapiens
taagacgcctctccctccgttctcccaccttgctaactaaggcccattatgctgattaatagctcacaactgttgttgatgaaaagagtcaaactctgtaaaatattaagagatttattctgagccaaatatgagtgaccatggcctgtgacacagccctcaggaggtcctgagaacatgtgcccaaggaggtcgaggtacagcttggttttacacattttagggaggcatgagacatcaatcaaatacatttaagaaatacattggtttggttcagaaaggcaggacaactcaaagcatgggggttgcggggaggaagggcagttccaagctataggtcaatttaaacattttctggctgacaattggttgaggcttgtcttaagacctgggatccatagaaaggaaatgttcaagttaagataaaagactgtggagaccaacgttcctttgaagtcttacggtggctgcccttagaaacaataaatgacaaatttttcctcttcagatctttaaaaggtgctagacttttagttaatctcttcaggattgggagggcatggaagaaaaagatctagctatgttaatggagattttttttttttttttgagactgagtccccctctgttgcccaggctggagtgcaatggtgtgatctcagctcactgcaacctctgcttctgggttcaagcaattctccttcctcagccacccaagtagctgggattacaggtgtgtgccaccacgcccagctaattttggtatttttagtagagacggggtttcaccatgttggccaggatggtctccaatgcctgacctcaagtgatccacctgccttggcctcccaaagtgttgtgattacagacgtgagccaccaggcccggcagaaattctttacagatgcagattttcctcccacaaaggatggctctgcagggccatttcaagatatggcacagaagcatgttttggggttaaatattttgattttttttcttgtctcataatgttatgccagagtcagactggaaggtaagtcacgatatacagtgtcaaataaaacccatctgatgggattttatggtttgtagggcatgactcccagaccccttagacaggaatttgggcaagataaaaaaatcagagcttagtcctcactatgttccagacactgctttaaaaacgctgaaagtgtattaactcttttaattccattcacaacccatattggcatccttattatgaaaaagaacactgagccacaaagcaaacttggtctggaccttgccatttttcaacagggaatgggcttggaaggcacgagaaggctttccctgacctctgatctgggatcggtccccacctatatgtccccagaggattctgtgcttcccaggccaatacattcatgaggatttagcaccattacttatagatggggtgttgctttacaatgaccaacttgtgcaagaatagaaccccttctttttttctttaaattcagtcttacctaattctgacctcctattctgccaggctgatgggaactccagatttacgtatttggggaactccttcaccaagtgtccagggtcagttgaaggtggtctccggggtctttggcagagattttggaggagaacatccagtcctcactgctcattgctgattagatcacagggactctcagtcaccaagggaacctccctccccgcccgtccaggacaccagcatcatttcctcaaggagactaagctttcacaaggcagaagatgtcttcaagcaacttctgcttttttctttttcttcccccagcaatccttcctgaggtgaaggacaacaaacgcctggtctgaataaacatcaaagcctgaatagcagcctttattctgcttctgcacagccaggaaaagaaagaacgaagtgactaaatggccctccactccagtttagctgaagtcaaccttctgcataaaccctgcccgcctccttcccctttgtagccccaaggcctagcaagacaggcactttcaaaagtgcaccaccaacagaatgatgggggagtgaatctcaggacggcagctaacatagttattttttctattaattcacctctgagttgggacaaaagtaacgtgaccttgtgggtggatgtgagtttgggcccttggaagatgtgggtttacagctcaagttaggagcaaaatattaaataacaggtaatatttcctttttgcctgaagcttctaactctgtgcccgttcaggttcttcggtcactcaacattgtttttgattttcttttctgtttttgaaacggagtcttctctgtctcccaggctgttgtgcagtggcgccatcttggctcacgcaacctccgccttgcaggttcaagcgattcttgagcctctgcctcccgagaagctgggattacaggtctgtgccaccacagctggctaaattttttatttttagcagagatggggtttcaccatctttttttgttttcttgttttttttagtggtaattacttcttaagcacaaagtgttttccccaccacatgtacaagccagatttggcctctctctctgacttatttcctagcactggccccaaactctctatagtccagtgaccctggctgcctttctgcttctcacacagctcaggacctgtgttctcaccattattccttcctgggaccatccctccagatctcagtgacagcctcttttcggtcttagcttcaatgtcatctccggagacaacctcccagaccacattctctaaagcatctcagccatcatcatgcctctcaatcactttatctagttttgtcagaggcgtctgaaccatagtaactcagtcttgaataagggctgggtaaaatgaggttaagacctactgggctgcaatcacaaatggttaaggcattctaagtcacagaatgagataggaggtcggcacaagatacaaggtgataaagaccttgctgataaaacaggatgcagtaaagaagccagccaagaccgaccaaaaccaagatggcaacgagagcgacctctggctgtcctcactgctacactcccatcggcaccatgacagtttacaaatgcatggaaatgccaggaagttaccctatatggtctggaaaggggaggcgtgaataatccactccttgtttagcatatcatcaagaaataaccataaaaatgggtaaccaaggccaggcgaagttgctcatgcctgtaatcctagcactttgggaggccaagaccaaaggatcacgtgaggtcaggagttcgagaccagcctggccaacatggtgaaaccctgtctctactaaaaatacaaaaatcagctgggtgtggtggcaggcgcctgtaatcccagctactccggaaggtaaggcaggagaatcgctggaaccggggggcggaggttgcagtgagctgagacctcgccattgcactccagcctgggcgaaagaatgaagctttgtctcaaaaaaaaaaaaaaaaaaaaaaaaaaaaaggcaaccagcagcccttggggctgctctgtctatggagtagccagtcttttatttttttactttcttaataaacttgctttcactttaaggacttgccctgaattctttcttgtgcaagatccaagaaccctctatcgggttctggatcgggacctctttccattaacagttttgttttattttttagagttttgatctgccacccagactggagttcagtggtgcaatgtcacttcgctgcagcctcaacctcctgggctcaagtgatcctcctgcctcagcctcctgagtagctaggaccacaggcatgcatacaccacatcagctaatttttaaattttttttgtagagatgagggtttcaccatgttgcccatgctggtctttaactcctgggtcttcaccacggggctggaaggatccgcggtggctcat

SEQ ID NO: 742 - DNA, 3364 bp, Homo sapiens
  misc_feature (1)...(3364): n = A,T,C or G
tgaggggtcgcggtccttccgcctctggtgaatattatttctgctttggataactggccattctttttcaaaattgatctccagaggactttacgatgaccaaatcattgacctgtctgttttcaaacttgagccattgtctatttctgggagtcactgtgtgtcgcatctgagtctagcttaggggaggggcaggatgcttagagtgtttgagagcacagttggtccacatataatgatactgttttttatacctagatgcagacaacatatgttttacagagtcttcatttgaggattccagaaatttcaaatattacaaccactcctcacacggtaagaacaattgtaatgatctgaacattgttattttggacttatgtaataaatggattccttctaccaactgtaaatcttttataaatgttaacagcaccgacacaaaagcattgttattgaaatagagtttttacttattttagagaatattttttcattggttgtatcatttgctagattaggttgactaacatcaattcaacattacttagtatttttcacctgattattttcccctcaaaacacagaaaagcaaatgcagattcatttggaaagaaatcttttcccagttccgttgtctctaaactgaagaggttgtaccttgtggagaggaactgttctttacgtgcatttctcccattgagacgttggttctctagacaggtgatggcctgtattgcggggagtaaacgcctcctcctgtgtttcaccccagctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggtaagaggcattctgctccgttcctcctcagggcccgactgcagcagttgtggattcagaatatagtgctcacacgcagtcgtgccccaggttgttcaggaagtgcatgtctgtaaaagaggatgtgtatcagttattttacagcactaatcctttattttaaagtttaagattattttcctaaggatacgtcatttttctgctggtactaaaaccattgggttgctctgaaaagtgacatttggactgagttaaagggaggtttttctctacctactgatttagaattaggctattgaatgctgaatagatgaatttttgtaaattaaaggtactgtatcatcctcaaggatgagaattccaccttcagattactaaccttaggtttattaacaagtgtcagggtgcctgcgagtcctttgaattttttatgtaaaattctgtgtgcatttttctggtgacaaaaatgtttctagattgttacaggctcctgggcagcatctcctcccgctacagataaacctgataagaacaaatgcctaagtctctaaactctgatgaggagagttatccttttgaggatttccattctgttttcataatttttatgtgctgaaatgagttgtttatcttttgctgataaagctgggtattgctgactttctgaattattttggagttctcccttcattaatatttgaaaattattgactgatgaaacagcttagttacataataataaaagttgatattcttgaaccaactatgtattatctgctgtcatgaggaattcagtgttaagcattgctgaaatggaatttaatattctcaaacaatgctgccttcatagcagctttcatctacttttgccagactgaatgtattgatatagtacttaatagatttaaagaaattagtccctgggcttaagaaatctctgttctagagactgggacattttagaagactattgcattttcttttgttcaaatagataattaaagtgaggtcgtgtctgaatgaagtttttgctgtgccttctttataattcagcttctcttccagagctgtggcacatggggaaataagcatgggcagagaagaactgaatcaccgcagggctctagctgcaggctgcggttcagcagagtgcgcctgcagaagggctgtctgcaggaagtctttgcactggaggctgtgtctgcctgcctgtcctacctccccaaagcgcaggctcagctttggcctcagacctctctctccccccggggctggagtgccttctctgtgccccgtcaccacactggttgatgccaaggaagggagtcctcgttccctccctgtgggaaaggagacgtccttggtttccggaggcttttccagtagatacttggtttgggctcctttcctaacatcctctctttcagtttcataaatggctgaatcacttctgtgggctgccttgagagccatgcagtccattctggtggtttcgatatgtgtttgtgcaggatacaagtgccagaccagtcactgttgagatttccccattgcactccgtcagttctgtctttaaaaagcgctagcaggccgggcacggtggctcacacctgtcatcccagtactttgggaggccaaggcaggtggatcacaaggtcaggagtttgagaccagcctggccaatgtggtgaaaccctgtctttactaaaaatacaaaaattagctggccatggtggcgggcgcctgtagtcccagctactcgggaggttgaggcaggagagtcgcttgaaccgggaggtggaggttgcagtgagccgagatcgcgccactgcactccagcctggtgacagagcaagataccgtctcaaaaaaaaaaaaaaaaaaaagcgctagcaaaatccacagcacatcaagtccagtatgtactgactggagtcaggcagcctctgcacagtgcttgccttcttactgagtgttggcgcctatggggaggcatgcgctctgacctagtgtgacagcagcagctccagagcctctgaattggtgacatggaagtggaaagttcacagcatgtgtgcgtcctgaaacaggcgttctttcctaagtgacccagtgttgggaagaagctttacccgccagtagttgggaagagttacatatatcttataacttgacatgagtacaatctattaaatttaataaaacacctgcccatgtttgatgaggtttcattcctagctctagtgagtattatttagagacattaatggtctttgagtagagatttgaaaccatcatagcaaaccaaaattttaatgggaaagaaacttgattttgcttatagcttaccacctacacccataataaatctacacccgtcttccntctggggttggaaggagcgcgtcaggggcgcgtat

SEQ ID NO: 743 - DNA, 3726 bp, Homo sapiens
  misc_feature (1)...(3726): n = A,T,C or G
ggaaagggctagttgacacggcgtcccatgcgtactctacctctaacggtcagatatcaactggttgagttcgtaactctcccctggagtccggcggtacgctatatgatccctgttaattggacgcgtcccactcgggtcgtatgcaacctatggagtcttccgcccccttggagacggccgttccgtcatgttcaccccaagtacccatcagagctttctaactgttacatgtacctgtccccggattgacacgccctaccatatatagcaagttcatgacgtcggattaaacattctagaaaacgttgaaccccctagggacacccctactaaaggagcgagcgattctaatatctcttttgagtttgggcaaaagttcctccaggtttggagtaagaacctccaccaatataaaattttccagagggaaaagtaagtttcactccccaccccagatttttttttttttttgaggcggagtctcgctctatcacccaggctgcagtgcggtggcgtgatctcagctcactccaacctctgcctcccgggttcaagtgattctcatgcctcagccttcggagtaggtcggattacaggtgtgccccaccacacctggctaattttcgtatttttacaaaaatagagacagaattttgccgtgttgcccaggctgatctcaaactcccggcctcaggtgatctgccctccctggccttccaaagtgctggcattacaggtgtgagccaccgcacctggcccatcccagatctgtagtcttccaggtctctttcccagaggtgacaacagttattattttgtgtactatcacagatgctctgtgcatatagaaatgtgtgtttatggcttttgtttttgtgcaagcatcttttgttcaccaatatgcgttttttttttggccagtctttctatgtgagtacacacacacacacacacacacacacagagctccaaaaaaaaagagttggtcttcaccaatgcacaagtaagttgcttctcaaactgtgctacttttagcagccttgctggagccatgtgtattattgttgagcttaatatctggaggctgaattcatagcagtggaattctagggtgagagtgacctagatagagagaaagaagatgagctctgctaatttacatgacaaaaacaattcaaaggccagtaaaaggaaagatcagtatcttctcctttaaatatcttgatagaaatagcttgtttgagaaatctaactgggtgaactccagttagatctggtctgttgggtgatttgtaggccatagtctctctgaaatttttaggtgacctttgggagtcctttcggggagtcgcttttgataagcacatcattcagcctgagatgggcagggctaatgccctgtcctgcccatctgcgctcatgaaatgttcatcaaggaagcagggagtggactcacacactgcctcccatccgcacaggacgcgtcactcggaatatacatactccctttgcaaattctttcccactttatgcgctcagcatcttgtgttattttggcccttatcctagttgagcctgtcataatttatcacccctgctgtactgaacagttcttgaggatattatcaaggttgtctgtacctctctctcccctgttgttgtcccaagctagcacggtgcctgttggtgttgatgaacaataggactcagtttggagagccctttttttgtcatgaattttgatgatggcagattagcccatttcctaggaatgataagcttggctttgattgatagatgaggctaacaatattttttatttgctaaagtttaaaatgaattaattgaaagatagccctgacgacagtggttggggcctcccgtgattcctcttggtgttgtgtttattgtagtgatacctattctgctatccaggagaggtggatgcagctaaatgtacagcaacaaacagctccggcgatctgggaacttcagtgtttaagatccttgcttgggaatggttggtgaaggctgtttttagggctaaattctgctttgtgactgtcatcgttttgcaggccaccgaatcccttttggagtcatctttggtggaactgatgtaaatgaagatgccaaccaggcggaaaaaaacacagtcatgggcagagttcttgaggaagccaggtaatacctgcgagaatttcatccatgccaaacatttaaactgtgtgaattgaattaattgaaaccaaagaccgagggcaccaattgccgggaaggtttacatcttagcacttaaaaccaatttcatgtaaccttttctttcatttggtacatttttatttggccacaaatagtcattgctaacaggttattgcacttaagtcttcaactacagttaatattagataagcctctttagaatggtctgcatggagccaggcatagtgaggcacgcctgtggtcccagctgcttgggaggctgaggcaggaggattgctggagcccaggagcccaaggctacagtgtgctatggttgcaatccagcctgagtggtagagcaaagccctcttttcaaaaaaacaagtgttctggatgtagaaaacacgaatcacaggcaaactccagccttagcagcacacaaattaggatctagtttgcatcaggtttgcccaagtagactatctttggcatgggtcttatctatgtagctttctgagctatatatgccatttgcaagaagggtcaccaacaggatttctaaactgtggcttaggccttttccttgggtatggccctctagctgtcccagggacctgagaggtagctgctgtgagaacagctctacatgctctaagtggggcttcttacaggggtcactgtgataatcctgggggctgccctgcacgtctctgatcccagatactgatcatgggcagcagcctccaggtaccacaactaccttagtatgtctccctataattctaatgcccccagggtgggggaagttattatccccagttgagaattccttccagcgctgtacttcccaacttttccatgtcaatacggtgaaaggaggttcatcggaggctgttgttctggaccagcccccgcactgtcccccagcggactagcccaagacagaaaggagtcacttgtgctgagcgctatgtaatcaaactgaactttgaaatgggtcagccttctttctctcttatcttctctattcctgacagagtctcattccgttgccccagctggaacgcaangcacggaccaccaggtcattggcttcttcacgctatggggatgacgcaatatgccagtcgaccttctgggatcagctcaaattaggcccgcgttccaccttgttcaccaacattcccttcttgtgccctggatgacccatggattgtgttgcaaccctttaccgccaatacccttgcttggcgctcgggggcttcgccggcgaatggttttcgaaacccgaaaaggccagtcaatttgtcggctttcgcccaggcctttgtggattaacggggggacacttgaccaaacccccgcctaggcgaatccagctgccgttgaacaatccaaaaggctctccaccacccggaaccctttactcaactaccggcgggggccccctaaatatcgccccccttgtttgtcatggaaccttttactttttaaaccgtcggtcaataccgggaagagcct

SEQ ID NO: 744 - DNA, 2884 bp, Homo sapiens
agccatcctcggacacacgtgtgttctcgataaatcggcggcaacacacaaggaacaactgcaacatcaatggtacgccaccaccacgatcgaccgtcctaatgagaaacgtacacggccgtcctcaataagagacaagtccagatccacactaaaattagaatacaaaaagagacaacatgtcgtcatcatcaaccgataaaaatgcccgagctcgcaatgtttcggcaattaaaagctcattaaggcccacggaaagtcaccggccacggttcttttgaaggcaattagtccctggtatcaaaaacttactggcttacaccttgaatgtgcaattccacttctaaaaataaagaaatgtgtgcccagactacccaataaaatgttcattacaatgttgcataaaaatcacaaaatgattggaaatggcaaagacgtacaacaacaaggcagagatcaaatcagttctagtgtatgcatatactggaatgctacgtcgttattcaaatgatactgcagaggtaggattatgagttggaaaagtgttcatgacatattattgtattcattttctattgctgcgtagcaaataaccactactttagcagcttaaaacaatgcccactgatgagttcacaggcttcaggaggctggaagtctaggcgttgatatggctggcctctctgtccagggtctcacaaagctgcaatcaaagtgttggccagctgagatctcatcgggaggtcagggctctctttcgtgctcatgtggttgtggtagaaggtagttcctcgaggagatgggttgaagggccatttccttgctgcctgatggctgggggccgctctcagttcctggagtcggcctgcctccctcatcacgctgtcctcttcatctttggaggagcagtagagaatctccctgacatcaagtcaccctttgaatctttctgacctgaggaaatgctcagtcctttcaagaagacaattattaagtgaggctcatcctgcgtaaccttcctattttaaggtcaacccatttggggattcaagtctcatctgcaagttctctccctgccagcccctggactgacatgtgatggatttgggaggaggtgtgtgtgtacaccattgttgggaactctagcgggccctgttagaattttgcctaccacaattattaagtaataaagagcataataccaaaatgtacagggtgtttctatttcttgtagcaaaaatgaaaaacacaaacaaaacagaacaagagctgacaagaatactgtgtccatacagcagagccaaggaaacaccgtagcgtttccaccgcctgtattacctgctgtgtccatacagcagagccaaggaaacaccgtagcatttccactgcctgtattacctactgtgtccatacagcagagccaaggaaacaccgtagcgtttccactgcctgtattacctactgtgtccatacagcagagccaaggaaacaccgtagcatttccactgcctgtattacctgctgtgtccatacagccccgctgaagaagcactgtagcgtttccactgcttgtattacctctgggaggcatcgcaccttcctgtgtctccagctcttcgactgtgaaatggtgagaacagtccccagagtttaggattcgggaggattcattgaaggacactgaacagtgcttagaaaaatattaggctcccggtgcacacccagtaaagtggactattacgatgattgtatgtcaagtcaggaaaaacttgatgccaaaatattcatagtagttatctcagggaaacgaaattgtgtgagtttttttttttaatggagttttgctcttgtcgcccaggctagagtgcagtgcaatggcatgatctcggctcactgcagcctccgcctcctgggttcaaatgattctcctgcctcagcttcccaagtagctgggattacaggcatgcaccaccacatccaggtaattttgtatttttagtagagacggggtttccctatgttcaggctggtcttaaactcctaacctcaggtgatccgcccacctcagcctcccaaattgctgggaatacaggcgtcagccactgcacccaaccttgtgatttttacaattgttttttgcttatctgaatttcttaaacatatcttattatttaataaaaataagttaaaatgttaaaagaataaatacgagtctctgcccacaacaggttgctactgaaagctgttcaaatgcagcccatcatcccttgagtaaacctctgatccttacggctgtgccatgcactgttaagctcactgtctcctttgcagggacgaccgtctttgggatgagcggctttgtgctgcaaagttaagaattgggtctgcactgtcatcagaacagcagtgggaattgaaaccccgacttcttgccaaaagctcaaagggaagaaaccacttattctggttgactgacttcgtcatgttcattaaacaaccctcgcaggaactagatacttccagaataacagaatttttttttttttgcagttggtcactttcaagtgctattaataaaagtcaggaaaaggaaacataactagggcaaagaaaccacaattccacatgcacctgctttattcaaatgcggatttctctttcctccctctctttttcctcttctctctctctatctctatctctctctccatctctcaccctccctctctttccccctctctgtctctctgtcattgtctgtctcctgtatctctctctccctctctctctctctccctctcttcttacccctctctgtctcttgtccctgtctctgtctctctgtgtgtctgtcttcaccacagggctggaaggatccgcgcac

SEQ ID NO: 745 - DNA, 3046 bp, Homo sapiens
tcttccacccaaggggaagacagcctgcttaggaggctgaaggctgggggcctattagtcctgggggaagctgtgattagacgtggtcctttcacgcatcagaatcacgtttgctacgaagtctcgtagccaacatcagatttttagattaactgtaaatgttaataaatgaatattacactaacctacttttgaattctaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggtgaggacctttagtgccggaggtgtctgagtccaggcacaagcgtgagcgctcgggcattctgactgtgctgttggaatatgttgagacaaggatagcacagcacttctgtagtttttggcagtgtgtggtttagaatatgaatcgctaggtaaacacaccagtgctgaggttctccattctttgtgtaaaaacagtatcgcaaaatattttcatgaaagtttgttaactaccttgtaagtgccacaggacagagaagaagaaagcaatcgtggttggatagttcccagcggagccctcggccatgctgccgtggtggctgggctgagctcacagctctcagtgcgcttcgtttagatgtacgtaaagaagcagatctaatttttagaaacgtgttctcacaggcctcccttttcctattagtgagatcctgcagtggttgaacaagtgtattctgggcagatctgtccggctgctgagagtgagagagaagagaagatgagtgatatgcagaggtggatggatgtgtgggtagtagtcagtggtggttttcactgtagaaaactcatccagaattggctaatgaatttgtaaagggaataaatcacaacggaatggacttgtatttagaatacactacaaatctccgtgtctagttataaaaatctaaatttatagatgggcctgccaaaatagttttgaagtctattgcccttgtcacggtggctcatacctgtaaccccagcactttaggaatccgaggcgggtggatcacctgaggtcaggagttcgagaccagcctggccaacatggtgaatccctgtctctactaaaaatacaaaaaattagccaggcatggtggcacgcacctgtaatcccagctactcgggaggctgaggcaggagaatcgcttgaaccagggaggcggaagttgcggtgagccaagatcctgccattgcactccagcctgggcaacaagagcaaaactccgtctcaacaaaaaaaagataaagtatattgcctctgaaatagaatccttatgtagatttcccagtttagtgtgtgtactttgttttcaaactcccattccttgacaatataggaaaattttttctctaatctctttaaggaacacaaaagtctaagagccaacaaatcacattacctttaagcttgagagcaaggagtttaactttctgctcattgaatttattaggaattatcctaatggctaggagaatgaacagttggcccatagccattgattcttggtcgctagtaagcatcgtcctcctaatagaaaagaggttgtgcctgtctgcaggactcagtccctaggagaccccacgcttcctctgctatattaggtgaaagctttgatcccatgtgttaaagtgcccctttcacaaaaacgaccctcccttttctttcctcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtcccttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggagtactttcggtctcttttcctaacagcaccttttctgatacgaaacttactagataaattgtgagcttctattaaaaatacccatatacctcgtgatctatgtaaccggtaactactactaatacgaggcagggatactcttgcatgatgcacaaaaacagctccattcctacgtggcaaccgtgctcaatctgaacaagaaaccaaaaaagagtactcccatttaaaagagcttcaagtgaaataaaatggctgggaatttacttatccaaaaaagagaaagaactcttccattggaattataaaacactgatgaaagaaattgccaaaaatactcaaaaaactgatttggaaaaatattgttaaaatggtccaactaaccccaagtttttttgattaaacaaaattgcctatataaaactaatgggctttctttacaataaggcagagtgacctaaacttcatatgaaacccccaatacaacccgcaaatatccgatgccctttcttgaacaagaaaaaacacaacaggaggggacttcacgttgccccgacttgataatttaattacgagccctattttgtcctaacccgaaatgaacctggccttacatctccaacttatatgccccgctactgcgccttgtaacctccgagacataatgcgcccagtccaacacctcatcgtttctattacaggcagcca

SEQ ID NO: 746 - DNA, 2773 bp, Homo sapiens
catgcgccagcgcggatccttccagccctattatgaagacgaaagactaggaataggagcctggcttctagtttacaaaagagctaagtgactgacctaggccgatgactcacaatcctcgttttacaattgagccacctgaggagctttttcaaaatacacacgtctggtttccagacccagagattctgattgggtaagtcttgcctcagagataggaatgtgctctttttaaaagctccacagataattctaggatgcaatgctagttaaaagcccccaaaccagaccccactcaggagatgctagtataggttaatgctatgtgagaatacaagaaaaaattatgtttgtactttatataagcatatacagaaagtatggtacaatgaaaaacatggttatggaaatgccaaattgcttctttccaattaatttctggtcaagataataattaattgaattaatttctggtcaagatatactatcacctctattatttttctattctaaaagtggaaaataagatactgtattgctattactatgtttcaataataaaaataatattgattgggtactgctatgtcagagactgctaagtatgttaaatagaatgatcttactctgttttcttgtttattaaacaaataagctagactttttttttttttttttttgagggggaatcttgctctgtcacccaggctggagtgcagtgtcatggtcttggctcactgcaacctccgcctcccgggttcaaacaattctcctgcctcagcctcccaagtagctgggattacaggcgtgtgccaccatgcacagctaatttttgtatttttagtagagaccaggtttcaccatgttggtcaggctggtcttgaactcctgacctccagagatctgcctgcctcagcctcccaaagcgctgggattacaggcatgaaccaccgtgcccagtggcaaaccacttttttttttttttttttgagacagagtctcactctcgcccaggctggagtgcagtggcgcgatctcagctcactgcaacctctgcctcccgggttcaagcgattctcctgcctcagcctcccgagtagctgggattagaggcgcctgccaccacacccggctaatttttgtatttttagtaaagaggggaatttgccatgttggccaggctggtctcaaactcccaacctcaggtgatccgcctcccagcaaaccattttttaaggatagcccccaccttccgtcaagcagttggtgagattcccattagatgtccagcatttcttattcagcctgctatctagtggccgaaacatagaactacaggctattttcaaaaactgcaaagaaattttcttgaatgcctccaacaacgaaattgtgcagagaagaataccgttagcttttgccagaatgttcgtatggaacctggtcactcaagttgtttttccaaaacctcttaggttcaaagtcaatacgatttttgaacacaccagtcgtctgtcatgtacggggacatacgcccttgcagatttgctcccgcactttgagagaatgaacatgcctcaagcctgggcttccctggaagacagcctgagatgcggcctcaggagcaggagtgaggaacagggagtgaaaccggggagaaaggagagtaggagaaagagaagttccggagctggtggccaccctgggtgcctggggccggactccctgggtcctttggaggagccttttcaaatgcatctcagagctgtctgcttgggcacaagacagggtaggcgggggaagctatccattggtctcatcctccctccacgagcatgattccttgagcatagctgccagctcccgggttatccaagggccagtgctgagcaggtttccaggcatccccactgtggagtcagaggtgagttctggaaagtcatctaggtgaactgagggcactcctcgcatgggaagacccgaacagagacggccaactcagaggcgctgacctggacagacgccttgcacacacgctggaatttttcccaagacagaaatggtctgggaaccgccaatggggcacttcccagagcgttggatccagacaccctcccctcattcacccggttcttccagggactagtgttggcccctgtgagttccaggagccggcgtttccaaagctgcttgctgtgctggaggagattttcatcctgagccttggaccaggttggggcgggtcagatcctgaggctacaggaggccgagatcaccaacaggcactcgccggccgtgtgtggcatttggggacactctgctcagcttggagattattttcttcagttgaactaatagctcggtgtcctcgctagggctgctgcaggaccagatttccactgacttcgtggcttacccaactggaatttatgctccctgttctggaggccagaaatctgaaatcacagtattggcaggtctggcttcctccagaggctctatgcctcttccatctcctggtggctgccagcgtcccttggcttgtggcggcatcgctcccatctctgcctctgtcttcacttggcctcctctctgtgtctgtgtcctttcctgtctcttaaaaggacacttgtcgttggatttagggtccactcaattacaaatgatctcatctccattctctttttgttttttatttttatttttttctttgagatggagtcttgatctgttgcccaggtcttcaccctcatttcggaaggaggcgcgccat

SEQ ID NO: 747 - DNA, 5133 bp, Homo sapiens
tgcgcggtcactttcagccctgtggtgaagacaaaaacctgtgatttccttcatgatagagggaaaatactgggaaaaaaagacaggaaaatctaaagcttctgctgtctagtagttttttagaagatgtaggtgacagaatggaataatgtgtttcttgggcaaaaaatctgggggatcaataacttgagaattgatgtcgtattgtctgtgtgtcacgttaaatattcttcagtataaagtgttcagggtgtgtaagtttcctttaagtataacctgtgagctgctagcgagtattctgaataccctaatgtggcacctacactctagagatgtctcctaagcaatgtaacattagcaacccacgtcagaagatttgttcattagcataaagcatttcagaaattaggctggcgcggtggctcacgcctgtaatcccaacactttgggaggccgaggcgggcagatcacctgaggtcaggagttcaagaccagcctggccaacatggtaaaaccccatctctactgaaaatacaaaaattagccaggcgtgttggctggcacctgtagtcccagctactcgggaggctgaggcaggagaatcgcttgaacccaggtggcagaggttgcagtgagccgagattgtaccactgcactccagcctgggtgacagagtgagactccgtctcaacaaaaagaaattagtagtgtctaagatatgtggttcactgggaagacgacacaggcttttgaccaagaagtcagggagccctcacctgctgggcagcccttgaggggttgccagctctatttggtcttgcatccctgccataaccctctgtcatctggcttaactagattggctagtgtggctgccagtatggtccagtgtggactcgatccttcgggcagggtgcttggagaacacagagagttctgcagcccagcagaatagaccgttttgtgtgtgtgtggctgaatctggagtgagagttcctctcattgtagggcacacctggtggtgaggttggaaggaagaggtcagaagggtccccacccccctctgatcccctgagaatgaacatttgccaggagagccaggccgtcctcacggaaccggggaaattggtctaggtcagtttctaacggtgaagttcaaaattaaaagcagctctggtaagtgaaaaaatagagtctgacacctagagaaccaagttcatgtcacctgtggagggggataaactgcacaaggagtggatgtaaaaaatattcacgccgagagtaagttgtggagttgtttcaaagggtgcccccccgttatgctaaaacaggaggctagtccttggaaacactgaaatcatcttctaaaaccagggcgacaaactgctgcctgcccggggtgaaacgcagcctccctgccagttttgtaaataaagttgtagtggccccagctatactattatacgcttacgtgttgttcacatttctgcttttgcttctcaggggcagaatggagtagttagaacagaggccctctgacccacgaacccaaaggtatttcctctctgtctgcttccaggaaaggccttctgacccgtgctctacatcttgatatcagatattcactagataactgagttgcatgcctagggtattgtctgcagagctgccaagggtactggggaaatgcgtgaagatggtctcgggaagagaacaaaatagagcatttggtcctcctcggcccagagcagggaagcccaaggggcagttcagtccagccaggagtgtgttgacatcagaatgatggcaaatgttgtcacactcatagctggacttggtgcagcggggtggtgactgtgtgtttgttgtgtttctccatctggaacggagagtgcaaaggtgtgtttgtcggaatgggaagcattttagataatgggggcagatcggagcactacaggacacggaccagaaaggagagaaagcgaaggaagaaatgcaaacatcctttgcatccaaggcagtactttcccttccaggcccggctactttctggccgcatcattctgaattctctgtgtcaagcatttgggaagaaaaaaaaagtatgaggaaaagttttcaggttttctagattttcttttgaggagtcaaaggaaagtgtgaatgcagatgaagttcagacaaggaggctattttattttttctgccttcctgggttttgtttgttttttgaagatcttgttactaatttttccacgtccaaagatagccattgaggccagccgcggtggctcacgcctttgatcccagcattttgggaggctgaggcaggcaggtcacttgaggtcaggagtttgagaccagcctggctaacatggtgaaaccctgtctctactaaaaatacaaaaattagctgggcatagtggtgcatgcctgtaatctcagctactcaggaggctgacacaggagaactgcttgagcctgggaggtggaggctgcaatgagccaagattgcgccactgcagtccagcctgggtgacagagtgagactctgtctcaaaaaaaaaaaaaaaaaaaccacaaagatagccattgaaagttgttgctgggcgctgtggctcactcttgtaatcccaacacgttgggaggctgaggcaggcagattgcttgagttccgaagtttgagaccagcctgggctacatggtgaaaccccatctctacaaaacatacaccaattagctgagcatagtggtcccagctactcagaaggctgaggcaggaggatcacttgagcccagggaagttgaggctgtgatgagccatgatggcaccactgcactccagcttgggcagcaacagaatgagaccctgtatcacacaaaaagaaagttgttaatatcttcattcagcagatattttttgagcgtctcccatgggtacagtgctgtgtaggcgctacacacagagccggcgtcagcagtccctgtcctcaggaggcagccgctcaaccacagacagcttgcgcacatcagctcgatgctaagcattgtcacttggaagacaagtctagcattctagcatggaagacagacacaagcacgtaattacccaaacatttgtctgattgtgatacgatcagtgctatgacagagaagtgtagggtgatgacagagagaggactctgaatagagccgacctagttccagagggcgtagggtccaaggaagagcttccctttccccctctgagggttcactgaaaaccagctgggcaaagacagactcataggagacacggcacacacctgtgttggtcatagttttacatgacatgggagctttcagaatgaagacccagagacacgagagactggccagtttatgcttaggttcaacaaggtacggacagccacatgggaataggatgggatgaaaagggtctgatcgaacaccgatagactgcttggggaggcccagcaaggcgagtctgtctggattcatcttcgcccctctgtgcagccttctttccttctggtacaaggcaggcccgctctggaatgggagctttgtgacttgcaatcaaacaaggtagtttggataatttattatttttttttttgaaatggagttttgctcttgttgcccaggctggagtgcagtggcgtgatctcggctcactgcaacctctgcctcctggattcaagtgattctcctgcctcagcctcccaagtagctgggattacaggcatgtgccaccgcacccagctaatttggtatttttttagtaaatagagacggggtttcaccatgttggtcaggctggtcttgaactcctgacctcaggcgattcactcgcctcggccttccaaagtgctgggattacaggcgtgagccaccgcacctggcctgtgttgttttttatttctatatattttttaacattttgatctgtagttgcttggaactgcagacatggaacccacagatacggaatactgactgtcttcaaggtgatagacatgttcattaccgtgatataatcattccacaatgtattcatagtccaaaacatcacatggtatcccataaatatatataattactagttgtcaaactaaaagtaacaatgtaaattttaaaaataaattcaaataaacaaaaaataacatcagtgggtattatatcagaatatcagaaaagcaggtgctatgggcctgacgtgggatgtgctgggctttgggagttcacaggggtctgggaaggttatgtcactgaggggcccacagcgcagaggatagcaggtcctggcagaagcctcggcgtgtgttggatgtgaagcagagaagagatgcaatctggctgagcatttcaccagactcagcctgactgctgtgttgaaagtgaaaagagacaagctaagaggctttggcaatgaaccagggagggctggggtggtgacaccttccctctcctccagcctctgaggtccttatctgtcctgctaccagcagctcatggccttgcctcctctacagagaaagtcacagctgcaagacaggcacaccgtcaagtggccccccaccatgcccacccctctggcacatgcaggcctgtgggcctcttcctggagggccagcagaaggcacagctacttgtccagctcaccccgtccctaaaagggtcaggaattacccagccaccgacagtatgcgtgtcccatgtttcctgtccccattagattcgacggccacataaaggtttctgccgagcgcacttgaaaaggctcctccaaccaaccggagtttcctaccgcagatcgagcgatactgcctctgtggacctgtgtataccgaaaagaggacatctgagagaataaggtggggatgagacatagaccggcaactctgactccaaaggctggccccctatcggggcattcccacagcctaggaatcctagaccaagacagaaccgcagcaacgcggtgcaggggacagcttcgccggaatgctccgattggacgccttcgagtggcggagccacactggacggagatacacctgtcagccatcccggacaacagcccaagaaagaggagagcgagacggacgccacaacgcaagcacgttcccg

SEQ ID NO: 748 - DNA, 4663 bp, Homo sapiens
  misc_feature (1)...(4663): n = A,T,C or G
gccaatgactcatccagaggaaacatgtgacacagttctggccaatgatgagtaaggagagtcttccagcatctctgagaaagcatttcttccctcgtagagaaagagctgcaccttttgtctcctttttgaagggttttcgagggtcattttgaccatgcatgatttttgctttatgcaccatctatacagctatcactgtgtgtaccgagttgaaaagtgagtgcctcaaaagactcagaccctcagaatgtgaccttatgtggaaacaggatcttcacagttataatcatgttaggataaagtcctcctagattagggtgcttcctaatccaatgactggtgctcttctaagaagacagaaaaacaggctgggtgcggggactcatacctgtgatcccagcactgtgggaggctaaggcaggaggatggcttgagcccaggaattcgagaccatcctgggcaacatagtgaaacatcatctctacaaaaatgtttgaaattattagagtgtaatcgtgcgtgcttgtggtcctagctactcaggaggctgagatgggaggattgtttaaccctaggaggtcaaggctacagtgagccatgttcatgccactgcactccaacagcctgggcaacagagcgagaccctgtctcaacagaaaaaaaaaaaaaggattctaactactagatagataaagaagagagaaacagacacagaaatacctgggagaatgggagaacatcacatgaagacagagcagggattggagtgatgtgtctacaagccaagggaaactggcctgccaacacctggatttctaacttgcggcctccagaacggtgaggaaatacgtttctgatgttttacagcacacagggtgctttgttacagcagccctaggaaactaatccaccatgttattccattatttaagaaataggccgggtgcagtggctcacgcgtgtaatcccagcactttggggaatcgaggtgggtggatcactggaggtcagcagttcgagacaatcctgaccaacatggtgaaaccccatctctactaaaaatacaaaaattagctgggtgtggtgatgggcacctgtagtcccagctactcaggaggctgagtcaggagaataacttgaacctgggaggcggaggttgcagtaagccaagattgtgccaccgcattccagcctggacaacagagcgagactccatctagaaaaaaaaaaggagaaggaaggaaggaaggaaggaaggaagaaagaaagaaagaaagaaagaaagaaagaaagaaagaaagaaagaaagaaggaaggaagggagaagggagaaagaagaaagaaggaagaaaggaaaagaaaagaaagaaagtcagattctttaacaacaaagcccaagactggtcttcagggaaggaggcagcttgttaatgagccagcctggggaccagggtgcagagagacaaagcctccagagaggggaaggagggggaagccagagggaaggaccacagacagggctttggagaaagtccaggattaaaccctgctgaccacaggctcaatacccctcctgtccccacaggccacagccccctctcagcttgactcccctgacatgggtcatcatgtttctccacctgcaaatgagtgaccttcatcatgatggcttaaaaataaaagcagccagcttgcgccactctcctcacagagctgagcctttttattgtaggacagaaaatatatgatttctcattttacaggattatgggccattgatgcccgctttccatatgttaggagcatataaaaatttttgagggatgaaagtgaataacttgaggtctgcacacaataaagtaatgttcttttttattataaagcagtttggtttgagatgacaaaaagatgctgttaatatttgggtgggctgcatttttattcctttggtcaaggacaatgaaagacttactgggactcgggaaggtcattcaactgccttcccctgaggctttgtagcaactcaagtaagaagctggatgaaatgttccagggcatgataagaccctgaggtttgtcctcaagcttcctacttagttagtttgtgcacacgaatgtgtgcgcacacacagacacatacacatgcatgcacacactcacatgaacacatgtgcatacacaggcatacacacatggacacacgagcacggtaagagacacacatagacacatatgcatgcacacacacttatacacatgaacacacagaaacacacatagacacatccatacaatgcacttaggaacacacatccacacacacacagatacacacacagcttcctctccccaccacacctccccaggtctcacaaaatagatgtgatcagtctgcagggatacggcattccaccttgggtctattaccatggactacagctaaaatttggactccctgggacccaatgctgtttttctattgatcgtgtggacttcttaatgaaaggctcaaatcagatgaaatccctagatcctaacaaataataatactgttcccaccttgccttccttcctggggtcctgtcctctaggaaactgtggcaggccaaggaccctggccatgtgggtggggtctgtggaggacaaagcattagggaaaggcagctattgcctaagcccgtgggtactggggaggctgccccccaatccccccacagagaaggcacctgttccacctcccagcagggcagtcaggctggagatagattccttcagcttcgtagggcaattaatgacagctcgtgactgcttttccttatccatcaggatctcttctgccatggtagggctcttaacatacttggccctttttttttttcagatgaaattaaataaaataatattaaccattttaaagtgaacaattcagcggcacttgggacattcacagtagtgtgcaatcaccacctctgcctggtttcaaaaccttttcattacctcatgaagcagtctctccccattccctcacccctggcaaccgccaatctaattcccgtctctgcggatttaatgcttctggatggtccaagtaaatgaagtcatatagcatgtatccttttctgactggcttctttccctcaggttaaagttttcaaggctcatccacgttgtagctcatgtcgatcattcattctttttcatggccgagtaatattgcactgtacggacctgtcacgttttgtttattcattcaaccattgatggacatttgggctgttttcacctttttgactatcatgaatagagctgctatgaatattcatgtacgagtttttatgtgaacatttgttttccatattttggtggggagggaatctgggagtaaaattctaggtcaaagtatagttttgttcagttttttgaggatctgctaaactgttttggtcttttttaatttaaaacttttttatttatttttatttactttatttatttatttatttgagatggagcctcgctctgtcatccaggctgaagtgcagtgatgtgatctcggctcactgctacatccacctcccgggttcaaatgatcctcatgcctcagccctccaaatagctgggattactggtggctgccaccatgcctggctaatttttatatttttagtagagacggggtttcaccatgttgtccagtctggtcttgaactcctggcctcaagtgatccacctgccttggcctcccaaagtgctggtgtgagccactgcacccagctaatttaaatttctttatagttaaatataacacaaatacagaatgccaaaaaattgataaattgttaatttattattaaattaacaattatataaattataatttattaataattaaccatgtatataaattataaataatagattattataagatgaataccctggcaactactgccataccactcacacagaaaccctctttgtgcacccacacacacagttattctacctgcccctaagagtagccatcatccttatttttatacatcttttaaaaaataaacactgtaacttcgtaatcttctcattgttgaacataaagttgattttattcaatagctgcctaccattacattatgtggctgagccatcgcctctttgaccagtttctgtagttaaacattggggttgtgtctggtgctttgctgtgaccttcaagtaactctccagccctctaagagctttattcttctgtgaaatgagggatgggggatgtganggttancatctgggcacctgtaaggcaccctgaaaatataggttctaggggctaacccgatcaaaccctaggtgctcagggaaccccccgtgctggaccagcccacaacggcaactcccacccccttttttgcttaacaacatgaaccaacactggcttcacctcgttggtggtcttatgggccccttcgcgttaaatcctgatgggaacacagaggacgtgttccaacaaaccatggtgtggccgacagggtggcctttaggatcaactgtggcgagtcctggggaatttttcccgctcgagacttgacccactgttagaatgtcgcatcttggcgagagcgtagtgtccgccacacgttggtatggctcgcctatgtgctcg

SEQ ID NO: 749 - DNA, 2975 bp, Homo sapiens
accgtacgcgaccttccgacccgtgtgaagacccatgagtataggcctgtggagtcctaatgtaaagcccagaactccaagccaccaatgtcccatggacacttgtcactgatgttttctggctgtgggtgccacctccatggccagctcagggctgcttgctctgaggaggacatgtggatttggggctggtgtttcattcccaccttctcctgaagatgaacagcccgaggaataagatcctcttgtggtacatgggacagacttccttcaaagaaagaccaaagtccatagttctgaagacgaagattctggttcttggtttttgttttatctttaaatgtgtcataaaggattggctggtcattctcgttgctttctagtcatttaatcctcattcttaatttaatttcacatctcagagttgacctttcattcatcatttctgtctgacaggttgtttgtggacttcccctgcattggtgctctcagggcgtgtgtgctggggatgggccaggatctgtctgttgttttcaagaatgggaaatgtttcatgaaggaggcgtgtttgccagcagcccccaggctgtgccccctggctgcatggcagcctccttggttcacaccagtaaggagagttggagctcatctgtcgagcagcccttggcgtcctgggtagagaaataaaggctgtgacatgggaaatccacaggaagcccgctcctcagagagagttctccctgaatttgtgtggccttggaaggagcagcagctctcaggccaggttccgggggtgtctgtgccacccttatccctggccctacctcaccatctcgtgaccgacacaggaaatagctttctgtaaagtcacagcactgtgaagggagagtccccagagttttgttacattgtgtttttcttaccgacctcccagcaggctccttttattagtgttatttaagctggggagaacgtgcataccatagtaaaggtctctaatcttaagcacagcttgctgtgtttgcagtctggatctcagtggaggaacttttggaagccctccttgcctctctccttagtttactgcccccctcagaaggtaaacctgttctattccagcgttggtccccacaggttaccctcgcctgtcctgtgctgggctgtggctgtctcctttcacttagcacttctgtctgtgagcatctcccctgtacttctgagtactgctccttcgtacgagccgtcacgaggcatttatccatgctgttgtcggtgggtgcccagatgttggcagtgtggggctgttgtgaatacctgccctgcctgtgagcctggggggcgggtgcgctcattccttggggacccaagagtctgtcttgtcaaatgtcaaaaccctagtgtttgccatcttcctgtgtaattatccttctgtctgtgaagaggcccaggaatgcacggcaggttttctcccaggcgacttaggcgtttccgaataccctgtgtaatgccaccctgagacagaccctgacgaggcgtggtgtgtctgcctgcgggcttggaccgcacctccactcccgcagggccgcgcagccttcagttcatgtggcctcagccttcagttcacgtggcctgccagctttagctcgggaagttttcagtgactggtacatttggggagactcgtatttcaaaataggcacataaaatgatgtcgtttatattttgatgacaacctcgtctcagtagcgtcaaatgccagtgttgggacagcagtgacagctagtgccaggctccaggaagctggggtttgcatttccactgagtgcccaggacagagcctggtaggtcgtaagggttgaacgaatagtgtaaaacatctgttgaaaaaataaagctttagtctggtagaattcagggtattagcagctgtctttctaaatcagtagacacaggaaatgatcttctttaattggtgtgaatgagcactctttaaaaatgtgtgagatctcaccatacagatgtgtgggtttttttttttttttttttttttttttttgagatggagtttcacgtttgttgcccgggctggagtgcagtggtaccatcttggctcactgcagcctttcacctcccgggttcaagtgacaattctctggcctcagcctcccaagcagctgagattacaggcgccagccaccacgcctggctaattatttgtatttttagtagagacggggtttcatcgtgttggccaggctgattctgaattcctgacctcagttgatcacccaccttggcctcccaaagtgctgggattacagtcataagccactgcgcctggcccagacgtgtattatattgtgtttatttgataaatgcactgttgaacatgcagtatatgttcatatagaaaaaggaagtgccagaataacccacctttattaaggtcttcacaagaaaggaagattccctttttataataatccattgtaaaagtgtttttttaaaaggaatatagattggtttggcttttgtctcatattcttttatttcccttggttaacatttacctccaagtcgcaaccttggtttcttgctgaaaatcttaggtgcgaaggtttgcgaacgaggaggattctgggtggcacattggttcgcaccgatcttataattggtttcattcgatcattcctcatgtgattcgtttagcatgtctcggaattgtctcgtaagtgttgatcttgtcgtacggtatgaagttatataattctcgggctcaagttggtatgaaatgtataggtcccacttgtgtatatttgagtgttggttatgcaagcgatggctctactattgaacgattcgtatcgtgttgatcgaggtggatgatcttatttacatgcgataggtcgtttgacaactgcgaaagtaattggcgtttcgattgacccgtgcccgactgcctgtgtgtcactccg

SEQ ID NO: 750 - DNA, 4763 bp, Homo sapiens
  misc_feature (1)...(4763): n = A,T,C or G
gcctggccgtcgacatttaggtgacactatagaaggatccgcggaattccatcaaatcagctcaggctcactctggctgggggaagcaatctgccatggtcctggggcatctttgtgtgtccttgctgcaaggatagcgtcccctgatactgagcactgtctgcagatggtatggaggcaaccaaggaggctgaggtgcccacagagtgactgccacgcacctgcgaactccacagggacgaggactggttcgttggccgcgcgctaccacaggcctgcagccctgggcttcccagctgcggggcatcctgctttgtgggtagccactgcaccgtggcatttgggagagagaagcgggctctgtgatgctgaggctctctccatttcctgtaccctgtgagtgacaaacgccttgctctgattccagcttgttgtctatttttggcaacttgctggccagcctccacattgacattggggcctagttcccgctcctctcctctgtgaggctggggcccttccccgacggccagtgtctcagcaacagcacagggtgggggagtctggacatgtgggctctgacccctaaagtgggaaagtgagattcatcatgtgaggcttcccttgtggaggctgaacaaagatgtccatgtcctgcagcctggaatttgtgaaaatgtcaccttcatggccaaaggaacttggtagctgtgattgagttcaggattgtgagattctcctgggttccccaggtgggcgtggtgtagtcacaggggtccttgcaataaagggaagcacatgcatcaatcagaggaaggtaagactcccgtaggaggacacagagagaggacacttagctggtttcaggacgcagaatggaccatgagcccaggaacgccggcagcctctcaaagctggaaaagacaataaaagagctcctgcccagagcctcctgaagaaacgcagccccacagacaccttgaggatgagcagccccttgagatgcattctgactcctgacctgcagaactgtgaaatgataagtgtgtgtcatcttcagccacttcagttggtggtatctgttacatcaacaatgggaaactaagacatcccctaaatgtaaaaaggctattcgaaagataatgtataaaaactagaaagcacaggctgggtgtggtggctcacgcctgtaatcccagcactttgggaggccgaggcgggcagatcatgagctcaggagtttgagaccagtcgggccaatacggtgaaactccatctctactaaaattacaaaaattatctgggcatggtggcgggcgcctgtagtcccagctactcggcaggctgaggcagaagaatcgcttgaacccgggaggcggaggttgcagtgagccgagatcatgccactgcactccagcctgagggacagagtgagactctgtctcaacaaaaaacaaaacagaacaaaaacaaaaactagaaagtgcaagccgtgcatggcctgtgaagtgggcaggacagtggcatcattctggaagatgcccttgccttgctctggagggaaacagaggcacagacccaggtgagggggacccagttcctccagggtcagttggggctctctgctcctctccactgctggatcttccactttgtaggcacatctgggcctcaacatgattaaaatcagtctctctccaccacagccctctcccctgaacccctccgccctcccatgtttctctccagcctttcctccaagccaactgggaactcgcctggaaaaaatagaactctctgtagatggaagaggatggaagtgaaagaaaaaaaaaagttctttatttggagccatgcagtgaaagcaattatttgatatttctggagtacattttgcctttgctttatgaaatagagaaaatggtttttaaaaatgcaaaatatggttactatatggctatgagacacatgtttttaataagatcggggtgaggacaggtgactgttttcaggtatgtgaatagttgctgcaaatacatcataaagacggtgcctggaaggtgagctgtaattacagatcctagaatgtcatgtgatgattttttaccgagaacacacattccccaggtcccaggttactgacacataagtctactgtttggcttttgaccatattttcagtaattaggtaggaggatgcaggactgcctgggatgaaatgatggaaagttctggagtccagtgggtgtatgtttccatcaagctccacaactctctggttattttaagagtgctagagtttgggttgtaagtaacatgaattggaattatgtgaatacaaaaagaaagttgagaggatcaattatcagcaaaactttttaaaatataatcccttaaagtcaaaaatgtatcaggagtcacataaatttaaagctgtcaaataaagtccattgagacctgcctgctgtctactgacacattttggtaccgtattttaccaggtggacaaaattagcccccaacagttgtcaggaaagtcttgaattaaatgttgaagtacacccaggtattggaaatgcatgtttccccaaagagtaattatgttcaattctaacacaaattcttaaatacagaaattctagtggctgttaaacatttgacaagattttcaattgcgctaaggatgggagggaaaaaattatgacaaataatttggggcttctagggttaccaaagattaaaacatggccaggcgtggtggttcatgcctgtaatcccagcacattaggaggctgaagcaggaagatgtcttgaggcgaggagttcaagaccagcctgggcaacatagtgagacaccatctccacttatataaatataaaaaattaaaatgtaaaacatgataatattccaggcatatgctggacactgtggtcctgtgaatggatgtgaccagtttggagggcaatttagaaatagccccaaatgtcaaaggaaaacctcagctcgcaattctactctaacaatatgaaatggtatttgaacacatgtagtcttcccaaccaggggtgctcacgtgaatcacggaacatagaaagtggcttgagagactattttatcaattctctcgagggtggttacataactaacacctttctagacccctgggagaaaagttcattccttacatacaatggatggctcagggcaagagagtgtaattctcttgggaacactggttgagaaaactgtagatgtctaggaattcattgtcaccttgtttgtgatgctgaaaaatgggaaatgactgatgtaaatgcttagccaaagggataaagacagaatgctacattcatataatggattaggaagcagctggtgactatgtgagtatatatggatatatactgatccattaatacttccatgataagtcgataaatttaaaagaaagttatacccactaatatgactttatttgaaaagacatatcagcggggtggctctcacctgtaatcccagcacttttggatgccaaggcaagaggatcgcttgagcccaggagtttgagaccagcctgggcaagatggtaagaccatctctataattaataaattaattaaaagatcccagcaagtgttggtgagaatctggagaaattgggatgctcacgcacagcttaatggaaacgtaacatgcagtttgttgctgctgtggaaaacagcccagcggttcctcaaaagttttccatatggcccagcagtttcactcctaggtataaacccaacggaaatgaaaatatatatccacataaaagcctgtacacgaaagttcacagcagcattactgacaatagccaaagagtgaaaacaacgcaagtgcccttcaactgatgaatggatcagcaaaaagtggggtatccatacaacagaacatgactcagccataaaaacaaatgaagcactggtacatgccacaatgtggatgagcctcgaagacgtgagatatgggatgccagacacaaaaggctgcgtagtttacaattccattcatataaaatataaagaatatgcaaatccaggagattagcgcttgccaggggctgggagaggggaaatggggaaggggtaatgggcaaggggtttctttctagggtgatgaaatgttcgttgattgtgatgactgtatagctttgtgaatatgcttaaaaccattgaattgtatactttaaatgggtaaaatgtgtgatatataaattatatctcaataaagctgttgccaaaaaaaaaaaaaaaagaaagaaagttatgggtgaaacaggatttgattttttttttcttttttgagacagggactcactctgtcactcaggctggagtacagtggcatgatcacagctcactgcagcctcaaactcccaggatcaagcaattctcccaccttagcctcccaagtagctgggactgcaagtgcatgccaccacgccagctaatttatttatcttttgtgaagatggggtcttgctatgttgcccaggctggtctcgaatgcctcagcctcccagaacactgggactacagggattatagtgagccactgtgccacgtcctgtatttgccttttaaaaaatccaagggtggaggtttagcaggaagggtttagggttggctctatgataaaaactgctgaaactgtgttcttaagtgaggaacacaggagagctcgtcttcantctgatgctggaaggaccgcgtcatgttttcat

SEQ ID NO: 751 - DNA, 5510 bp, Homo sapiens
  misc_feature (1)...(5510): n = A,T,C or G
ctgacaccagccgcggttccttgacgggccctggtgaatacctcttcatagcagactctcttgggtcaaattcctgctctcctgcttcccacatgagcaatgcaggcaaggggctgtatatctccatgcatgttaccttgtctgtgtaaatgagaatagtcgtgtctgcctgcagaacagattgaatttctgtggtattgagccatgaagctggcagtactttgttagggaagccccagtaaactcatacttgcagacatagcaacaattatagtggcacggatgggtctgattcagaaacgctgcattccaggtggtccctgggtcccctttcttgtaccacctctttgcatggtcccctctgatgacccagctcacaccccactgtctgagggtctgaggcttgtgccccacatcagcttgtgactatctctgggcaggatctggtcagtcctccattcaaaagccaccatcaaaccaaccctctggcaaagtggtcctgcctgaaattcatgtctaggtgaaactgactggcgtgaaccattccctggatcagagaccacctatgggtgttgagataaagcaatgtgggcagggttgtgtgttaagttggtaaactactccccagagtgctgggagcttggctgttgagggctgtggacttggaggaaggcctgagatccagacaaaagtccaaataggtaaaattggtggattagtctgttctcacgctgccaataaagacatacccgagactggctaatttataaaggaaaggaggtttaatggactcacagttccacatggctggggaggcctcacaatcacggcagaaggtgaaggaggagcaaaggcacatctttcatggtggcaggcaagagtgtgtgcaggggaactgccctttataaaaccatcagatctcgtgagacttattcactaccacgagaacagcatgggaaacacctgcccccatgactcaattacctcccacagagtccctcccatgacatgtgggaattatgggagctacaattcaagatgagatttggttggggtcacagccaaaccatgtcaatgggtaacacaatatgtaacagacatctgttaatttgtttaagtttccttcctgttactttggaaacactattccaaggcagggtgcaatggctcacacctgtgatcctagcactttgggaggctgaggcgagacaattgcttgagtccaggagttcgaagacagccttgacaatatagcgagaccccatttccacaaaaataagaataaaaattaaaaaattagctgggcatggtgatgcatgcctgtagtgccagcaactctggaggctgaagtgggaggattgcttgcacctgagaggttgaggttacagtgagccacgattgcaccactgcactccagcgtgggcaacagagcaagaccccattcctagaaacaaaaaaaaactgtatcccagaatttcctcagggagccacagtcccccagtctttatccatgtggtttgggacagccggtcctgatctgctttccagggctgtggtgtgaaccagtcctggccagtgggaggtttgcacattcctggctgtggtgatgagcatgtgtctgtaacctttccagtcagaaccaacgagatcaattctgagactcttattggaacttgtgggaaggagaaacctgattttcacaggggtcaatgttggtagaataaaagcatggagttcctggatcagaagctcttgcagccttgcagaataaattgagagtgaagtcaacacagataaaaccatacccaaaagatgggaagagacagagtgctggtaccatgatgtgagctgctggatccacccatacctgaaatccacatgtaggctttcatttacttgcaccaattagtttcctatcatgcttaagccagactgtgttggatttctgatgcttctaaccttatatagaaatctatctctccagtactgatgaacctttatagggttacatgcaacagcagacagactttctttttacttcaggcaaggttagaccacataaagtctctgtgtcttggatgaacttctctcaacaagataagagccatctgaactaatgagtaagggaagtaatggctttacttaattggagtgatataaattgctgtaatgtgaattgtctgcacaagacagaaattcatggaggtgttctgttctaacctgtgacctaccattataaaggttctgaagtgaagggtctattctcccctgatgctggacttttcaaagcacagcaattttgtttcattttgaaaggccatagtgaagccagcagcttactcagcactttctgccaactattaacttctctcacatcaatggccagacactcagaccctgcccagcccaggtaggtgatgccaatgcactaaccagccagggagagggtataggtgtgcctcttctgagccaccagaactgcagcaattcagaagagatgccccttccaaaggagacagcctanggcctagaatccaatcttgaccaattttctgatgtctttggaagtctggattttctttcttttctttttcttttctttcttttgtttttgagacagagtctccctctttcacccaggctgcagtgcaatggcgagatctcagctcacttcaacctctgcctctcaggttcaagcgattctcttgcctcagcctcctgagtagctgggattacaggcatgtgtcaccatgcccagctaatttttgtatttttagtgaagacggagtttccccatgttggccaggctggtctcaaactcctgacctcagtgatccacccgcttcggcctctcaaagtgctgggattacaggcattagccatcatgcctggccaagaatattttcttctaatatgtacctggatgatccttcaccaaacaatttccataggtttcacatactcttcatttagttttgatattgataatgtaattatcaagtacttattacattataatatttataagccaaaaagctgaagctaagggaagtttgaatactatataatatagaaaaaaaatttaaatactaaaaaaacttcaaaaatagaccctataggaaaaatataactatttaaaaacatttgattaaaaatgaaatactcattataaagctagacaagttcaatactttcttttacagaaacgtgtgctatgttgtactggacaaagaatctgatccatgcagctttcctgcccactaacctcgatcaataaccccccaaaatagaaatccgtgtttgctttaataacaatgaaataaataatactaataataatactgtaagatggattcattcaatgttgtttctagtaaacagaattgtttttcttccgtaaggcagtgcattaccaactacaggaatctaaaggtaatgaatttgcagagtgaaagaacaacagcaataagaaaacctgtaataaaagatcccctttcaaggtaaccccaacgtgttttaatgtctttttttattgtaacacacacacgcacacacatgcacactcacacgtgtgctctctattatgataaggtggtgtgaaaggaaaatatcttgggcccccaaatcacaaagctaaagggaaaagtcaagctgggaactgctaagggcaaacctccctcccattctattcaaagtcacccctctgctcactgagataaatgtatatctgattgcttccttgggaaaggccaatcagaaatgcaaaagaatgcgaccttttgtctgtcacctaccagtgacctggaaaacccctccctgctttgagtcttcctgcctcgcttccagttgtcccgcctttccagaccgaaccagtgtacctcctacatatattgattgatgtctcacatctccctaagatgtagaaaaccaacctgtgcctgaccaccttgggcacgtgtcatcaggacctcttgaggctgggtcatgagtgcgtgtcttcaacgttggcaaaataaactttctaaatagtaactgagacctgtctcaggttttttgggtccacatttgcattgccacaacatacgatcggggtcctcaggaaggactagggtcctaaatgcagtgatacctctcagtaaccctggttttcagaagcgagactgacacctacattaccaaacaaggaatctgaggctcccgacagaactttgaatgctgtcccctgtatggaatagggtgatccagctacataaagacttgaagtgtcccaaattccctggccagagcttcccagccatgaggtgagccacagaaaattaatggctggtgatttattgggataaaatcaattaccagttttgctttgttttgttctctacaatgattcaaagatttaaaagggtcgaagggatagttaggcagtacttgttggaccaactgtaaactgtggtttcagggttattctagacacaggtgaagctttcttctaacaccagcagccagtgaacatgtgggaggacaaactgcacagaacccccttgactgtccagccaaaccccgaggaagcccactgagcacctcatgactgatcagaaaagttctttgttttgggtatgcatgtataggtagttcttttgatttaatttccgctttttttcacaattttcatataatcatggaagattcatattgcttttatcattattttatttaattttttatttttttaattaattaaattttttttttttttgagacagtgtcgctctgtcacccaggctagagtgcaatggcaacatcttgcttactgcaaccaccacctcccgggttcttttgttgttgttgctgttgtttgtttttgagatggagtcatgctctgtctcccaggctggagtgcaatggcacgatctcagctcactgcaacctctgcctcccgagttcaagcaagtcttctgcctcagcctctcaagtagctggaactacaggcacaggccaccatgtccggctaatttttgtatttttagtagagatggagtttcaccatgttgtccaggctggtctcgaactcctgacctcaggtgatccacctgcctcagtctcccaaaatgctgggattacatgtgtgagccaccgcacctggccacctcctgggttaaagtgattcttctgcctcagcctcccaagtagccggaattacaggtacccaccaccacacccagctaatttttgtatttttaatagagatggggtttctccgtgttggccaggctggtctcgaactcctgacctcaagtgatccacctgcctcaggcctcccaaagtgctgggattacaggcctgagtcaccgtgcccggcctgattttatcattattttaattcttattattgttattcgttagacaaagaaatgggagtgatttttttaatcaaggcttttaatccactttaaattgctgtcttcaccacggggctggaaggatacgcgctggcgtcatccggcggcgctcac

SEQ ID NO: 752 - DNA, 5761 bp, Homo sapiens
gtgcacgtcctttcacccctggtgaatattctttttgcattttaaaattattggtgtaatttgccttttttttttcatgaaaggcatctgtatttttttctgtgagtgtgtatgcttatattggttcaaactgtttttaaaatttttaaattttttatttttaacttgtatggtacatagtaggtatacatatttaaggggcatgtgaaatattttgatacaggcaagcaatgtgtagtaattacatgagggtaaatggggtctccatcaccttaggcatttatcatttctttgtgttattaacaatccaattatactcttttaattattttaaaatgtaaaataaattgttgtttattgctgtgctatcaaatactagatttgttcatgagttattttcttttcttttcatttcttttcttttttgagacggagtctcactctgtctcccagactggagtatagtggctcgatctcggctcactgcaacttctgcctcctgggtttaagtgattctcctgccacagcctcctgagtagccgggattgcaggcccctgccaccatgcccggataatttttctattttcagtagagacggggtttcaccatgttagccaggctggtctcaaactcctgacctcaggtgacccacctgcctcggcctcccacagtgctgggattacaggtgtgagccatcctgcccagccagattcctttattatcatacactgagatttttcttttttgcttttatttttctttattttattttttttgagactgagtctcgctctgtcacccaggctagagtgcagtggcatgatctcggctcactgccagctccacttcttgggttcaagccattctcctgcctcagcctccccagtagctgggactacaggtgcccgccaccacgcccagctaatttttttttgtatttttagtagagacgggggtttcaccgtgttagccaggatggtctcatctcctgacctcatgatccacctgcctcggcctcccaaagtgctgggattacaggcgtgagccaccgcgcccggcctatttctttatttttttaattaattattatttttcttttgagatggagtctcactctgtttcccagactggagtacagtggcacaatcttggctcactactacctctatctcccaggctcaagcaattctcctgcctcagcctcctaagtagctgggactacagatgcctgccaccctgctgtgcaatcaaatactagatcatattcattctatctaactatatttttgtacccattaaccatctccattccttcctttccccctactacccttcccagcctttggtaaccatctttctactgtctatctccatgagttcaattgttttaatttgtagcccccacgaatgagtgagaacatgcaaagtttatctttctgtgtctgtcttatttcacttaatataatgtcctccagttctatccatgttgttgcaaatgacaagatatcattctttttatggctgaacagtactccagtgtgtatatgtaccacattatctttatacattcatttgttgatggacacttaggttgattccaaatcttggctattgtgagcagtgctgcaatagatatgggagtgcaaatatctcttcgatatactgattgtctttcatttggctatatatctagcagtgggattgctggattatatgatagctctatttttagttttgggaggaacctccaaactgttctccacactggctgtacgtatctacattcccaccaatgacatacaagggtttcttttcctccacattctcaccagcatttgttattgcctgacttttggataaaagaaatttttttttcaagaaggagtctcactctgtcacccaggctggaatacagtggcgtgatctcagctcactgcaacctccacctcccgggttcaagcgattctcctgcctcagcctcctgagtagctgggactacaggcgtgctccaccacacccagctaattttttttttttttttttagtagagacggagtttcaccatattggctgccgagaccagcttggttggggagaccctaacccagcagcactagaggaattaaagacacacacacaggcatgtagaggtgtgaagtgggaaatcaggggtctcacagccttcagagctgagagcctcgaacagacatttacccacgtatttattaacagcaagccagccattagcattggttctatagatattaaattcactaaaagtatcccttatgggaaaccaagggatggtccgaattaaaggaataggttaggttagttgactgcagcaggagcatgttcttaagggcacagatcgctcatcctattgtttgtggcttaagaatgcctttaagcggttttctgccctgggcgggccaggttttccttgccctcattcccataaacccacaaccttccagcgtgggcgttagggccattgagaacatgttacagtgctgcagagattttgtttatggccagttttggggccagtttatggccagattttggggggcttgttcccaacaattggccaggctgctctcgaactcctgacctcgtgatctacccacctcggcctcccaaagtgctgtgattacaggtgtgagccactgcgctggccaagatgaaagccattttaactagggtgagatgatatctcattgtagttttgttttgtttgagacagggtctcactctgtcgcccaggctggagtgcagtggcacgatctcaactcactacaacctcggtctcccaggttcaatcgatcctcccacctcagccacctgagtggctaaaatgacaggcgcctgccaccacggccagctaatttttgtatttttagtagagacggggtttcgccatgttggccaggctggtctcaaactcctgacctcaagtgatctggctgcatccgcctcccaaagtgccaggattacaggcatgagctaccacacccggcctcattgtagttttgatttgcagttctctgaggatcgatgatgttgggcacctttttgtaacctcttcgccatttgtgtgtcttctcttgagaagtgtctattcagatcttttgcccattttaaaaatgggattattagaatttttcctattgagtcatttgcgttgtttatatattctggttattaatctcttgtcagatgggtggtttgtaaatattttctcccattctgtgggttgtctcttcactttgttgattgtttccttttctgggaagaaggcttttaatttgatgtcatcccatgtgtctatttttgctttggttgcctttgcctgtggtggagttttactcaagaaatcgttgccctgaccaatgtcctggagcgttccccccacttttggtatttgttctgttttgtttttgagacagagtctccctctgtcccctagattggagtgcagtggtgcgatcttggttcactgcagtctctgcctccagggttcaagagattctcttgcctaaacctccggagtagctgggattacaggcacccgccaccatggccagctaatttttgtattagtagagatggggtttcaccatgttggccaggctggtctcgaacttctgacctcaagtgattcgcccgcctcagcctcccaaagtgctgggattataggcatgagccaccacacctggcctgtcctgtcttttcttttctttttttttgagatggagtttcgctcttgttgcccaggctggagtacaatggtgtgatctcggttcaccgcaacctctgcctcccgggtccaagcgattctcttgcctcagcctcccaagcagctgggattacaggcatgcgccaccacgcccggctaattttgtatttttagtagagacgaggtttctccatgttggtcaggctggtcttgaactcccgaacttaggtgatgtgccgcctcagcctcccatactgctgggattacaggcgtaagccaccgcgcctggccctccccagtgttttcttgtcatagcttcagagttttaggtcttagatttaagtctttaatccattttgatttgatttttgtacaaagctggttgggactttttctattgcaattgacagaatgtcacatttgcttaaccaaaaggagaatttatggactcacaattaaaatgtctaattttaaagaaaaagctacttttagctatgatcagaaccaagatctataaacagtccttttttctttttttttttttcttttgctctgttgtccaggttggagcacactggcaccatctcagctcactgcaacctttacctcccgggttcaagcgattctcctgcttcagcctctcaagtggttgagactacaggcagaccccacaattagcctggctaatttttgtattttagtagagacggggtttcaccatgttggctaggttggtcttgaactcctgacctcaggtgatccccacctgcctcagcctccaaaattctgggatttaaactgtctttttcaaacaagtgtctctctcatctctatctccttctgggatgcttacttctctggtttcacaagatggcctctggcaactccaagcttatatttccatgatctcaaactcaacagaaaagagaatcacttcttcctgctcattcgagagtaaattctgggattagctttgaccaactaggatcacatgtccatctgtgaatcaatactttatttttgtttattcatttatttttttgagacagaatctcactctgttgcccaggctggagtgcagtggcatgaactcggcttactgcaacctccgcctccagcgttcaagcgattctcctgcctcagtctctcaggtagctgggattacaggcgcgtgccaccgtggccggctaatttttatatttttagtagagacggggtttcaccatgttggccacgctggtctcgaactcctgacctcaggtgatctgcctgcctcggcctccgaaagtgctgggattacaagcgtgagccaccgtgcccggcctgaaccgagtactttagctcagtagatgggatactgctaattggataggcataggtcaactgcccactcttggactggaggggtcaagccgccagacctaaatcacaggcgccagacctaaatcacagcgagcattgattagttaaggaaaatcaaggtgcagttaccacaagggagaatggatgctgaataggacccaacaatagctatcctctaaagagcctggccagtcactgtgccaattttatgtgtcgggtgtttatcctttgataatattctttctttattcatgtatcaagtcatttatttatatgaatctatttatttattttggagaggagtggcgccttgtgcaccaagtgtgggaacaacgcccagaagtgcatgcctttgcgttcaccactcgaataatggggcgaatcagccccaaaggtcgttgctgaatgacggcctgctgctgctcaccaccgtggggtgacgccttaaaaggggtgaaccatggtttggatcccatttaaccacctttttgaaattcccagtaaacaacccttagggtaaataggaattaacatttaaacgggtgggttaatagcgccggtgtttcggttttaaagtccgggactccctaggcgaatatccggcgggctttccatcacaaaaacactataaggggtttcgcgcactacacgagagacct

SEQ ID NO: 753 - DNA, 6439 bp, Homo sapiens
tacaacgaactcccgacccctcccctaacttgcccagacttctacctacttcatacctccattcggatgcctaatacaaaccctaagcttcataccaatgtcaaataatgagaaccatacttctagtgatgaaataaaaatacatatagttgtatatgtgcatatatacatacatacatttccaagctctaagagggcttacaagcaaggacactgagtaagcaataagcacagatcttagtttctaaataatattctctaaaaggacaaaaaaaaattataaaggaaccaggactcctttgagaaatagccatttccagaagtaggacaaggtagacaggagatgaatcagggacattttacgatgccagaaagtagaaaagtgctcagaaaacgatgaatgatgagagcatgtcaaaagaacacaggcatcagctcaaagcatctcctgtgggcaaatctggggcaatttgagcaaccgaataaacaaaaatagtaacagatgatctgtaaagggaaataaaataaatatctatgagtccatgttatatatatatatataatttttaatatatttatttattatttattttgagatggagtcttgctctgttacccaggttggagtgcagtggcacaatcttgactcactgtaacctccgcctcctgggttcaagctattctcctgcctcagcctcctgagtagctgggattacaggcatgcaccaccacgccgggctaattttgtaattttagtagagaacggggtttctcaatgttggtcaggctggtctctcaaactcctaacctcaggtgatcctcccccctcggcctcccaaagtgctgagattacaggcgtgaaccaccgcttccggccttacagatgctattgaaacctggaaactggtgagatcaccaaaggagtaagtgcagatagagaagagaagcccaagaactgagtcttggagcagcccatttttgagaaatcagagagagaaattagtgagactgagattgagtggccagttcgatgaaacggaatggtatggtggaaaccaatgaagaagcatttcaaggaggaaggagagagcgtatgtgcctgttgctattgataggttaagtaagatgaagactgaggaccggaccattcagcttaccaacatggaggtccttagtgaccttgagcacagtttcaatggtgcagtcaggggagctgcctggagtggtttaaatgagaagagaggcattggaggtgttgagtcaaggtaacaccagggctttttttgtcaaggagaaaagagaaaaaggacaataattgaagcagggactgtgggattaagggagtagtttttataatgagtagaggagaaaataatgatgtgggagaaagataggaggatatatattatctacaggaagtcttgaaagattgtaagtcctgactttatacaaaattttgttaagaattttctttctaactataaaaaagggctgtcccaatgcaatgtagaaattttgaaaagtactgaagaagccagggaaaagcgaattaccaagtttttttttgtacttcatgcgtgcgttaaccatgagtagctttatggtaggtgatcttctaattacttacatttgtatgtctgtgaccatagtttccatgttatctatattcgaaaatttggggtgaatgacacataccagtcaggttcttagtaaagcaggagacagagtcttgctctgttgccaggatggagtgcagtggcatgatcttggctcactgcaacctccgcctcccaggttcaagcggtccccctgcctcagcgtaccgagtagctgggattacaggcatgcaccaccatgcccagctacagttttgataattttaaggtgccaaacatggttttaatggctgcatagaattctatcataaattctgtaaatgattctttgagattgggcatttatatctttatcataaacaacaccacagggaaaaatctgtttctgtctttgtgtacttgtctgattgtgtctttgggttgaattcatagaggtagaattgcaaggtctaacgctacgaacatgtgaatatattgatgcagtttctcaaatttctcttcagaaagaatatttgcattttaattcaccaagtgggtgtatgttttcatttttctcacctttgtcaacattgggcatttttatttttaaaactgccaatcttatatgtgatgcaattctttcctattgttccaattagatttattttgttattagagaaatttcacttttcctcacattttatggtcccttatatttgctctcacgtgaacatcccatttttcccatccctttttgccccttgggatgtttggcttccttgttaattttgaagagctcctgagtaaggatattattcctcttttctccatgtcaattgcacatgtttcttccaaattgttatttttgttttaatttgtggtatttcagtagtttttaaattttaatataatcaaagcttttttatctttagaattaatttcatagctttttttctttctccttttcataccctgcctgtggtatccaataatgtcatagctttttatgctcagaaaacctttcccaggctgaggccagctgcttgttctcttatatcattccagacttctcttgtagtcttacctttttttacttagctcctgaaccatcttttgagatatatgatataaggtaggaaactaactttttccatgtatttaaccacttctctaaccttatgctatgtcaaattctttttttttctttttttgagacagagtctcgctctgttgcccaggctggagtgcagtggcacgatctcggctcactgcaagctccgcctcccgggttcacaccatcctcctgcctcagcctcccgagtagctgggactacaggcgcccgccaccatgcccggctaattttttgtatttttagtagagacggggtttcacggtgttagccaggtggtctcgatctcctgaccttgtgatccgcccgccttggactcccaaagtgctgggattacaggtgtgagccaccaggcctggcctatgctatgtcaaattcttaaatgtatttgggtctgtttctggccttgtatttggttttgatctttctatctttttttcactgccaacactgttttaattgttatatttttaatatgttttgatatctgttaatacacatctcatctttgaattcttcttcttcttcctcttcctcttcttcctcctcctcctcctccttcttcttccttttccttcttcctttcttctttcttcttcctctgtcacccaagctggagtgcagtggcacaatcatggctcactgcagccttgacatcccaggctcaagcgatcctcctgcctcagcctcctgagtagctgggactacaagtgtgctcaactatgcccagctgattacaaaaatgtttcctgtagagatgggggtctccctatgttgcccaggctggtcttgaatgcctgggctcaagtgatcttcctgcctcagcctcccaaagtattgggattacaagtgtgagccactgtgcctggcctgaattctttatcaaaattttctgattgtttgtcacccaattatatgtataggtaaactttaaaattattttgtcaaatttcaatataaatccacttctggattttatttgaattattgattttgacacgtaattgaggtaaaaatggacgttttgatagtattggagcttcccatctaagaatgtgctccacatttccatgaaaaagtatctcttaatattcctgcacttcatggcaaacataatgttaataaatagattaccttgttttcttagttttgagatcccttgtgcatttcctaaagaagcaattgaaaggagggagatgataacagtgagcacccatgtgcattcagtaaattgtgattgtgtccccatagtcttcccttggcagagctagtggagtggacaggctgcccttgaatggtcagggtggattaacccagcaagttccttgcttctctcctgcatcttcatttcttgcttttgattttatccctgcctctctgaacttgcgtggaaggaagagaaaaaataggagttttgagcttcgtttggtttacttcttgcatataaaacttttttttgatgtgagttgagattaaacctaatggccaatgaccacaagtaataaagattgattgcattttaaatttagtgtctcacgttgtctctcataatttgttccaaagagctgtttcatagttcttttaattgaattctggcctaattgtttctattatttttgttcatttactagatttgctgtcgctttcacagagtcaatgaaggaaatggcacaagcgcagtgggtatgtgtttatctggtgttgttattttggttgtgctgatgaaattgcagaattcgagaaccgaaaggcagccttactgagctgacagtgttcccatggacggtgcctgttgcggccacaatagtgtattatgtttcccatagattgattttgtatgtgtagatgcacctaaaacgtccctgatattttttgatgttgttattgaatgacaaaagtagcccagtaatggttgtatgttgttgttgttgttttgttgctgttgtttttttttttttttttgagacggagtcttgctctgtcacctaggctggagtgcaatggcgtgatctcagctcactgcaacttccacctcccgggttcaagcaattctcctgcctgagcctcctgagtagctgggatttcaggtgcacaccaccatacccagctaatttttttgtatttttagtagagatgggatttcaccacgttggtcaggctggtctcgaactactggcctcaaatgatctgcccgcctcagcatcccaaagtgctgggattacaggcatgagccaccgaacctggccctgttttctttctatgttctcagatcgggtgatttatcagctgcgctataaatgttgcagcaaccttgtatacatgagagtaacaatctcttaggtgacagaggtagtttcctgggttggaccgtttattagaagagctttaaacagtcaagagtttgtagatccacaagttagttcatttattgactttgtattcatgatgacttagagggctggtgtatgagctggtgggaacttaactgaattcccagtaaggagctatgtgaacgcaccatagagctggtgcctgcaaaactaaagaaaaaaaccaaaggtcagtttccctttggtgagtgaggctgctgtctctggcggtgggaactgcattgagcctgctccaccagcgttcatccgctgtgcacaatgtgcatgccctgatcatttgcaggcgttattcctgttggttgggaggatcaaggaacagggcttatgccctgatcatttgcaggctctgcccattctttatggaattgcaatttgcaaaatggtggtacttgaaaactgctgcactgggacaagggcagaacccagtcatctgtggtctcttccgaaagctcgggatgctagacatatgtgaatgtgaagttgcacacgccctgacggcccatagtcttactctttatatcagacttttcccaggcagagcatggaggttgtatttcctagtgcaatttaatgacttgtcaatctcagtattagaaaacccaacaggcatcctggtttccagttttattgtaataccaaactttttttttttttttttgagacagagtctcactctgtcacccaggctagagtgtaatggtgctatctcagctcactgcaacctctgccccccaggttcaagcgattctgttgcctcagcctcctgagtagctgggacgacaggcatgtgccaccacacccggctaatttttgtatttttagtagggacgtggtttcaccatgttggccaggctggtctcaaatgcctgacctcaagtgatccacccacctcagcctcccaaagtgttggggctacaggtgtgagccactgcacctggcctacctgttggactatctatctgccttcttaaggtagttttcaaaccagtggttaccaaaatggggtccctggacctctgagattccctgggactctttcagggcctccgccaagtcaagctttttctaaataataatgcaaagccttttcttttggcttttctcatggtttaaaatgcagtgatgagtaaaatgcagctgccttaatactaacgaaggcagtggccccatctgtgctaatattcgctgattagtcaccaccacccacttaagccagtttcacttaaaaatgtccctgatgaagaaatacaaattactagcttttcaaatattaacttttgaatacatgttgttattttttttttagtagagatgcggtgtcttc

SEQ ID NO: 754 - DNA, 7628 bp, Homo sapiens
atttcttacgccatcaaagtgaggctcccagtgacccaagatgtctctcttgccttccaacgtgtgggaaccaaaggtagccccgggttcataacaaataaaaaaaaaaattccaaggttaatacctggtcaacaagaaattacttctttagaaaataatactttcagaaccactcgtcggcaaataccagaaacaaggttcatttaagattggtcagggcacgagttgcaaatattatgaaagcgactataatattctcccaaagttggtatgctatgaatgtctggtacagagacaagccagtgtaaaaaggtgaaatagaataatttaaagacgatggtaaacattaatttatgaaagactttaaatgatggcacctctgcacaatggttgagacagatctatgtatgtgccactatgggagaaagttcccagatgtgtggctgagcggtgaaaaggaagatgctgaatatatattcagcggtgggcttccatttgtgtgtgtgtgtttaagatgggggaggaggtacatataaatacatgcatgggtgtacatgaacctcctcatatgcatgctctgtgtagtgccctctcacactgaatagtgctgacctgtgtaatcagaaggatattgtgggattcatgttgtattgacttctgagcctgggtcatgaaaaataaggcaaattccaacttgcttttcttttgatggttctctcagggagaagctggccatcacatcgtgaggacactcaagagggccatggagaggaccatgtggtaaggaactgagacctcccaccaacggccttgtgagtgcactataatggatgcacatcagcaagccccagtcaagccaccagataagactgcagcctcatgggaaaccctgagacagaccacccagctaagctgcttttgaatgcccacaggaaccattagataacaaatgtactgcgataagcaactaagttggggcagggggtaatttgttatgtaataatagataatcaatacagtacatatatttctaggagaatatccacaagaaaatgttaactgtggttacctctggaaatgagaaataatacagtggggataagaggtgggagacaggcttacttttcatactataccactcagttacattttacaccggggcaatttttcatgtattacctgaaaaaataaaaaagaacacatagtaagatgtgcccatatatgaagagagtgttcagagagggctcaacttcctgtggaacaggaggcaggaaaaagagctggagcttaaataaggtttgatacagtgtggaaaaatgaaagaatcaccttcagtaaaaaacctctaaaatttttgaaagtgtgacacattttgctgaccaaaatttaatcctgatgtgatgatgactagagcaaattttgatcctccaatgacatgctattactatcccttaaaatggtgcagcacaaatgataccactactatgtcatttaattcatgtttgaggaaatcactcaggccagacaataacaaaaatatctgtcttgcctttatttggtggctgctatactctcagtaaagtcagatgggtcttgtgagtgttaagaaaaattttccacaacctgaaaataaggtcaagaataataagaataaataaggtccacatgcattttcttgcaatgttctaggaagccataattaaaagggtcctctaaagactcattttctgagagagtgtattgttgtttgacttcactatttactattaattgaaagctcatactctgtgaagttacattaagccatttgtagctttgtgtcagggagagacgtaaatcatttctgtccagtagaagagatacttccaaagcttggggcccattgccttgttggatgttaatcagttctgcaactaacctcgtgaatttactctgatattctttattaaattgcttatttaaactccagttgctcaaatgtgctttaaactggttttaacatcttagtagtttcctcataaattgatgggttgaacaacatctttcataagtgctctatttgtaaaagaattcttttgaaaaaaatatattttgaaagatgaaatatgcattgaaaaaattcagggccaggctcatgcctgcaatcccagcactttgggaggctgaggaggatggattgcttgagcccaggaattcaagaccagcctgggcaacaagggtgaaaccctatccctgaaaaaaaaaacaaaaatttaaattaggggacatggtggcatgcacccatagttccagctacttgggaggctgaagtgggaggattgcttgagcccaggaagcggaggttgcagcgagccgagattgtatcactgcactccagcctgggtgagagtcagagagaccctgtcccaaaaaaacaaataaataaacaaacaaaaattaaggatgatacttttaatatggtaaaaacagtttcaatacacatccattcttgactgttataacatttaagaaaattgtgcattaagaaagcaaaccaaagagattattgcatgtctcccatttctgaactggataaaaaggagacactgtttcccgtgttattggacattacaggcacttccggttttcagaatttctagtgttttacttttgaagaaaaagaggattaccttgcaaaagcctgcctcccctatagagatgaagagccagggcagcctcgcagttctcagccaagatgaggtttgcaatctcagatcggctttcaaagtcaaaggcatctttcaaaacgcacacgtgccctgcagcctctagatgggccctttatcaaaaaatacagagaaaggagaagatgaggggaaaatgttaatatgtaacaggttgctgctacagttaagactttttttttttttggttgttgttgttgttgttgttgagacagagtttcactcatgttgcccaggctggggagcaatggtgcagtctcagctcactgcaacctccgcctcctgggtctccaagcgattctcctgcctcagtctcccaagtagctgagactacacgtgtgcaccactacgcctggctaattttttgtatttttagtagaaacggggtttcaccatgttggccaagctggtctcaaactcttgacctcaggtaatccacctgctttggcctcccaaagtgctgggattacaggcatgagccactgtgctcagctactatgattaagattttaaatgaattccacaagatgacttatttactgaatcaccctttgtaagcaccctgccttaaaatacaaaagaaggcctagaatcaatgacattagccattcatctgccagtctcagatacccaggactgtggctggaaccgaggccattggaaggaagattgacccaggaggccctgacagccttcagacatggggcacacactgccacctccagtggcatttgccataccagacagcagctccttttctatttccttaattccacattttctctcctgtccctgaattgtggtatctaaagattgtttttgggcctctgttgctcggttctttgaaaagacttcaaaagtcacctattatcatagcttcaaaaaaaatacttcctggtttttccattctacctgctacacacacacacacacacacacacacacacacacacacacaatatttatgtctttcaaacatgtctcttctctttgtctccaccttagtttcagctcctggtaacataaatataaaatacctcataaacaaaaaagaaattttttcaatagtgacaacaacatgaacaaaatcagaagacaaatgagaaactggggaaaaaactatttacgactgttactatagaaaagggctcatctgcttaatatataaagagcattcgtaaatcaataaagaaaaaaggctaacaacacaataggaaaacggacatgagggctgggtgaggtggctcacgcctgtaatcccagcactttgagagttcgaggcagacagattgcttgagcccaggagtttgagaccagcctggtcaatatggtgaaaccctgtctctataaaaaatattttttaatgcactgggcatggtgacacatacctgtagtcctagctacttgggaggctgagatgggactactgcttgagcctatgaggtcgaggctgagtgagctacgactgtgccactgtactccagcctaggtgacagagcaagaccctgtctcaaaaaaaaaaaaaaaaaaaagccagccacagtggctcaagcctgtaatcccagcactctgggaggctgaggcaggcagatcacttgaggtcaggagttcaagaccagcctggccaacagggtgaaatcctgtctctactaaaaatacaaaaattagccaggtgtggtggtgcatgcctgtaatcctagctactggggaggctgaggcacgagaattgcttgaacccgggaggcaaacgttgcagtgaggcgagatcaggccactgcactccagcctgggcaacagagtgagactccgtctcaaaaaaaaaaaaaaaaagatattttatttaacactcacaggatgctgcctaggaaccaggcactattccaggcaccgtccaagtgttcactcatcgaatccccgctgcaaactgtgaggcaggtagtattagctcagtcgtccccattttatagatggggaaactgagggacagagcagttaagtcctgcgcacccaggtagctggatccagaatccacgacatgcgtgtgaccactctactacaaagccatgtggttgtggtctaggggtgttaactaacttgccagcggttagcattgagtgattgcgtggatttcgtacgggactacaacccatctttttaaaaagttcttgctaagaattaccacaaaaatgagcatgtgtacggcacctaaaaactaaaacagtgctaggcatggtggcacaagcctgcagtcccagtgacttgggaggctaaggtgggaggattgtttgaggccgggacttccagaccagcctgagaaacatagtgggatcccatctctacaaataaatacataaacaaataaatataaataaaacatatgcagcctcagcgacattttaggcaatctaagaacatctctactctattgttcttttttttttttttttgagacagagtcactctgtcacccaggctggagtgcaatggcacaatcttggctcactgcaacctctgcctcccgggttcaagcgatttccttgcctcagcctcctgagtagctgggattacaggcatgtgccaccacacccagtgaattttgtgattttagtagagatgggttttcaccatgttggccagcctggtctcgaacacctgacctcaagcgatccgcccacctcagcctcccaaaaggattacagacgtgagccaccgtgcccggctactctactatttcataaagctctggtagagtagaaaatgcaaattaaaaagcagagagatgatatgcaaagaaaactgctttgaatatcaactgcctcctggctgcgcccagaaatggccagtgcaaaagtccacacagcccgcaccccgcctgtacttgcttctgctgaagcatttccagcctgtcctgttccaggctcacaaaagggtgggctatgacccaggcggggacaattcagtgccctcttcctggaccccgtccttgaagagaatgacagagacttccaggaccctgtcctggaccccgtccttgaagagaatgacagagacttccaggaccctgacctggaccccgtccttgaagagaatgacagagacttccaggaccctgtcctggaccccgtccttgaagagaatgacagagactgaggcatgggtggggctcattttctcaggtgtgaagccttgaatgaagggcttcttgacgcgacatcctggcctctggaatgtcttggttctgcctaaatccaagctggctcgccagcctgcccaggaattctcttagtgagaccttgtcttcttctaatcaataacttttggctggcgttgggccagaggtggtttctgatgcctggggtggaggctcaggactgagctggtgtggtttcttcattgggacctcctgcgaactagggcttcaaggagagaaatggacaagagggaaacactgcatagatgcactgccattgcctcctaaaaatagactgagctggccgggcgcagtggctcacgcctgtaatcctaacactttgggaggccgaggcgggtggatcacctgaagtcaggagttcgagaccagcctggccaacatggcaaaaccccgtctctactaaaaatacaaatattagccaggtgtggtggcacgtgcctataatcccagctacttggaaggagaatcgtttgaacccagggggtggaggttgcagtgagccgagatcgtgtcacttcaatccagcctgggcaacagagcaacactccatctaaaaaaaaaaaaaaaaaaaaaaaaagactgtctctttgaagacacagtaagtcaatgtggttttgtactaagaggcactgaacgtgacctagaaaagctccagccctccaaagtgtctagctgatacctaaagggtgtgttcattcattgagctttgcagttaacagagaaagacatgggctgaagcagagtgcactcccgtcggatgtcacgaatagtggtgagattcagggtgttaaatctgttgtatgccatagtctttccaataagaattttaatgtgtcccaagacttgacctctcgcccacttctcagatccatctcccaatcttcagcacgtgccctagtcacactgcaggaaatagtcaacttcaagcatgaaatcgccttagtcccctcctagttctgtattcagaagtgtaattaaattgaatacttgactctgaaaagcagtcgatgtttggaaatgttataatgatgatggaagagagggagtttcagttgggtggtccggggaagggtgtctgaaagggtgacatctgatcccaactggaggtctgcggagaggaaattttcccccctaggatactagaatgtgcactgggcttactcaaagtctaagaaacccaaggtactgacccctagagcctccatcccggggtaacccaggttacaactttttaatattacacgcgcaagggccttattagtttaaccaactcgtgcgggaaaaaacaaaagtgcggcctgtctcgaagaggttgggagaaatgtataagtattattattcccgatgggcgcatgcaggtacagatctttacggcagggagcaaactcaagcattcgctgtgatcgagcgtgatacgcgcattcgcgacaggcggcattgctttataaaaccgcaatagcatgggcatatacggaagttagacccctcacgtgggccggggttcgaacctaacactgtatcgagcagcactacgttgcaaggacaatacattaccaaattcatgatactacaccccaacgctggttggtgcgcaaccaagctagttatgtactgctcatctgctgacaatccaaatcacggtctcgtatctagtacaaccatctatcatctactttaatgtgcagcaatgcct

SEQ ID NO: 755 - DNA, 5401 bp, Homo sapiens
ttgagccaccgcggatccttgacaggccctggtgaagacatggaatctcactctgtcgcccaggctggagtgcagtggtgcgatctcggctcactacaacctctgccccctgggttcaagtgattcttgtgcctcagcctcccgagtagctgggactacaggcgtgcgtgaccacacccggctaatttttgtattttttggtagagacaaggtttcacgatgttgcccaggctggtctcgaactcctgacctcaggtgatctgcctgcctcagccttccaaagtgcagggattacaggcgtgagacatccctcccggcctggggttcatttctacagaactctccaggataagccctggctgagcctcaagccaggcatgggcagctcgtgtggaggtgcggtggtggttctacctcctcccctaacctggagggcgagaagcctgagggcagagtctggctctgctcacgtctgtccccgcagtgcccagcccagcactggccacacagggatgctccaaataacatccctatgcagacgatcaaagcacttgcttgttggatgctcaccaggcactaaaccctttaccatgggctaactcactgaatcctcctgtcaaccccatgagatacagcctgttattataatacacattttcagaggggaaactgaggcaccaagtgtcaacacagccctcgccacttcgtgggtctgaatcacacatttccttttgggtgggatttccctctgcttggagctttctctgcatttcttccctgtttaggaggaggagcgaccgtttccagctatcctgagtggggaaagggaagatgctgagaagctggatcacgcctcagcgaagccttgattttgggcttctggcctctggaaccatgaggccacggacttctgtcatttaagccgctcagtttgtgataatttgttctggcagccctaggaaactaacgcacaggacaaaagccatgatgtcagcagggctggtttctcctggaggttccagaggaggctctgtcattccctcttccagcttctagcagctgccggcattcccgggctcatgccacctctgcttccacgctccatctcctctctgactctctgctgtgccgttcatctctctgcctcccatgtgtgagttcccttgtgactaggtcctcccgcgtcccttgccttggataatgcaggataatctcaccaacattgtccattaacccaatcacacctgcaaagccccccttttttttttccatgtaaggtaacctgtctgcaggttccaggacttagaggacaacatccctgggggccatcgcgagctgaccacactcacattctgctgtgatgattgtggagaccacatgctctatacagcgcagccataagcaggacttcctgtcttgcactgcgtgagagtgtgagccgcctgaagactccaaggtcaggggttcacccccacagcatagtctgttctcgcctgtgctctacgagcggcccctcctggtgttcttcatcatattcagcaacatctgtgaaatccaaggggttcaccttgaatgggtttctctagcaaagggccagagtttcaaatgtctggggtatcagggtataccccaagtatccaacatggacacaccacacgagagcaaaacatggggaacttacaaaaagtgtgggtaaaattttacggttataaaatagggctgggtgcagtggcgcacgcctgtaatcccagcactttagggggctgaggtgggcggatcacctgaggtcaagggttcgagaccagcctggccaacatggcaaaaccccatctctattaaaaataaaacaacaacaacaacaaaattagccgggtgtggtggcaggcagctactcaggaggctagggcaggagaatcgcttgaacccaggaggtggagattgcagtgagctgagattgcaccactgcacgccagcctgggcgacaagagcaaaactccatctctaaataactaaataaaataaaataggattgaggtcgaatttaatctttttctctgaaggacagtggggctcagctgctatctggattccatgtgaaatgcacttagcatacagtggattttcttttcctccaaataccagctatttctaaattcaaccctctcttaggccaaccccactctactattcttacagcgggggaagccctgaggtttccagcgcatcggtgaagaggggcgatttctttcccatgacaatgacaactccatttccaatgtctaatttcttccattgtcattaccgcatcattttctttcttcccagggagcaaccttctgctctttgtttgccgatgagttacttggccactgtcacttctgagaactactgtctggggccctcctcccccaataattatttttccaatactacatgatccttaattatctcttgatcgatttctctccctgggagctggttgttactgctaaggttaagctcaaggctgatggacaattcaatcagattcacacagtccccagtcctgctaaagacgttcatagataagaaagtgtcactgtttgggtacttaagttaaacagtgcagtagtctgtggacatctgatcaaggttggtaaaatgctgaccacaggcaaacatcttgagatgtcggtcaggaaaaactattggaggccgcaagtggggaagaaaggtttaggagtttttagccttaacagtgtcaacagaactcaccactaaatagttctcccaggacctttcatctgcattaggctcattattcagggaccagctcagctaccacctgcatgaagccttctctcatctctcctcacagctcctgaaggaacccacctaaaatcactgtggctgtgtggggtggctcacgcctgtaaccccaacatattgggaggctgaggtgggtggatcacctgaggtcaggagttggagatcagcctggccaacatggcaaaaccccgtgtctactaaaaatacaaaaattagctgggcgtggtggcgggcgcctataatcccagctactcgggaggctgaggaaggagaatcccttgagcccaggaggcggagggggcagtgagctgagatcacaccactgcactccagcccaggcaacagagctagacgctgtctcaaaaaagaaagaaaagaaaagaaaagaaaagaaatctctgcaaacagccaactcctttctaaaggaatcttaatgttactggattaatgctcagccccctctccggagtcatgtgcttccctaagccagtcataggaatctcattttaatcaccagggacaggttgaggaagtagagtgtgaaatgattccagccgaagggggacacatgaggctgcttggaggcacctgagaaatgctcctatttttttttaaagagtgaagcagaggaatgaacagtccctcctttcagtcagacccatcagtgatgcctgagaccttggctgccatcctgagaccaggaagggagattccagaggggaatccatgctcgaacagcagcagagcagaaagagggaagggctgcttcctcagtggcattgctggctggctgagtcaggaatcctgcaaacttcaggtcttctttcctagacagcaatgcatttttcctactgttcgagccacttggagctggaggataatgcaggaattctgaatgtgcttctccttgttggaggggactcccctctgtacttgcctggtatggaatcacccacttttgacaaattgaaaggagacatttatatgttgtttttgtttttcttggctgaaaacttcttgaaagcagttgttggaatctattttccatcttctcccaagaagtctcaagaagcaactctttaaatgattttttttttttctgggtgcggtggctcacacctgtaatcccagcactttgggaggctgaggtgggtggatcacttgaggttgggagtttaagaccagcctggccaacatggtgaaactttgtctctactaacaactcacacacacaaaaatgagctggacatggtggtgtgtgcctgtaatcccagctacttgggaggctgaggcaggagaattgcttgaaaccaggaggcagaggtggcagtgagctgagatcatgccattgcactccagcctgggcaacagagtgagactctgtctcaaaaaacaaacaaacaaacaaacaaacaaacaaaaaaccctctttataccacacagaataacaacatcttgtatagattgtctggagtgtacttccttaaaaaaatctgactattctagttactgtggctgcacaacggattaccacacaaagtggcatcaaacaaccattggttatgctcacagatttcttcactcaggaatttggagaggacacagtggggactgcttgtctctgctccatggatggctgaagcctcacctggaagatccgaagatgggcggctgcaatcctctgaagggtccctcacttatgcatctaaagggtccctcacttatgcatctaaaggttaaagctggctgctggctgtgagcctcaggggcactcctggggtctccccatggggtctctttatgtgggtctctctctgtgcgagtctccctctgtgtgggtctctccgtgtggacaagtttgcatgtccttaaaccatggcgaagcagctgtcatcctgcagagcaagtattatccaaagagggagccagcttggagctgtattatttccagaacctgcactaggaagtcacatggcatcacttttgccataccctgttgtctggagcagtcactgggtcacaccaggattcaacgggaggggccatagagcaccaatgagtgaaagcagtgttcgtcatgctgtaagcaaaaagggggtggagtgacccgtgtggctgtccacaccagtgtgttccctgaacacctaagggttgatcggcctagcccctaacaaaaacattttcaggacgcctgacaagcgcccacaagcctacctgctactcgttccctccctatcttgaaacaagacgatgcctgttctagagccccccgagacatctgcggcagtagtcagaataaccacaaactgccgccagtcctacgcaccaacctgtgagcaggaaggctgacgacctctcccaccagcttcatgtgcacacacagctctgagcgtatataccagataggatcctgtcggcggggtcatcgaaccccagagcacccgcgcacccgctacctaaggacactacaagacggagtggaccctaacactaaggcgcccttccggtgaatacccgctcgcggtcgctaccgggagagacgacgctacactggtgaagctgcagtccatcgagtagtgcccatctcatcccc

SEQ ID NO: 756 - DNA, 4799 bp, Homo sapiens
ttgcgcgcttggcgcgccccttccgcatcaggtgaagacaagctctgcctcccaggttcacaccattctcctgcctcagcctccggagcaggtgggactacaggcacccgccaccacgcccagctcattttttgtatttttagtagagatggggtttcgccgtgttagccaggatgatctctatctcctgacctcgtgatccgcccatctcagcctcccaaagtgctgggactacaggcacccaccaccacgtctggctattttttaaatattttagtacagacggggtttcaccatgttagccaggatgtctcaatctcctgacctcgtgatccatccacctcggcctcccagagtgcttggattacaggcgtgagccactgtgtccggccacttttttgttttctaaaatggaagtagttcttcaccgctgggcatggcctccttcttctccacactgacctttccctccctcaaggcttcctggggctgcaaagcaaagaaccacgaacttctctgtggcctaagccacggaagctctggaagacagatgtctgggctcccggtgtcacagagtggcccttcctccggctccggaggacagacgtccgggctcacggtgtcacagagtggcccttcctccggctccggaggacagacgtccgggctcacggtgtcacaagtggcccttcctccggctccagaggacagacgtccggctcacggtgtcacagagtggcccttcctccggctctggaggacagacgtccgggctcacggtgtcacaagtggcccttcctccggctccggaggacagacgtccggctcacggtgtcacagagtggcccttcctccggctctggaggacagacgtccgggctcgcggtgtcacagaggggcccttcctccggctctggaggacagacgtccgggctcgcggtgtcacagaggggcccttcctccggctctggaggacagacgtccgggctcgcggtgtcacagagtggcccttcctccggctctggaggacagacgtccgggctcgcggtgtcagcagagggtcccttcctccggctctggaggacagacgtccgggctcgcggtgtcacagaggggcccttcctccggctctggaggacagacgtccgagctcccggtgtcagcagagtggcccttcctccgcctctggaggacagatgtccgggctcacggtgtcacagagtggcccttcctccggctctggaggacagacttccgggctcgcggtgtcacagagtggcccttcctccggctctggaagacagacgtccgggctcacggtgtcagcagagtggcccttcctccggctctggaggacagacgtctgggctcgcggtgtcacagagtggcccttcctccggctctggagcacagacgtctgggatcgcagtgtcagcagagtggcccttcctccggctctggaggacagacgtccgggctcgcggtgtcacagagtggcccttcctccggctctggaggacagacgtccgggctcgcggtgtcacagagtggcccttcctccggctctggaggacagacgtccgggatcgcggtgtcagcagagtggcccttcctccggctctggaggacagacgtccgggctcgcggtgtcacagagtggcccttcctccggctctggaggacagacgtccgggatcgcggtgtcagcagagtggcccttcctccggctctggaggacagacgtccgggctcgcggtgtcacagagtggcccttcctccggctctggaggacagacgtccgggctcgcggtgtcagcagagtggcccttcctccggctctggaggacagacgtccgggctcgcggtgtcacagagtggcccttcctccggctctggaggacagacgtccgggctcgcggtgtcagcagagtggcccttcctccagctctggaggacagaagtctgggctcgcggtgtcacagagtggcccttcctccggctctggaggacagaagtctgggctcgcggtgtcagcagagtggcccttcctccggctctggaggacagacgtctgggctcgcggtgtcacagagtggcccttcctccggctctggaagacagacatctgggatcacggtgtcagcagagtggcccttcctctggctctggaggacagacgtctgggatcacggtgtcagtagaggggcccttcctctggagcctctagtggggaacctgttagttgcatcttttggcttctggtggctggtgtttcttttttcttttttcatctttttttttttttaatttaattagagacagggtctgcctgtgtagcccaggctggtctcaaactcctggcctcaagcagtcctcctgctctgtcctcacaaagtgctgtggttacaggcgtgagtcatggggcccagcctgttggtgtttcctgacttgtggccccatcactgcagtctctgccttcagggtcacatggccttctcctctgctggagcatcccctcctgtaagtttcttttttttttttttttttttgagatggagcctagctctgtcacccaggctggaatgctgtggcgggatcttggctcactgcaacctccacctccagggttcaagcaactctcgtgcctcagccccccaagtagctgggactaccagtgagcaccactacacctggctaatttttgtatttttagtagagatgaggtttcaccatgttggccaggctgatctcaaactcctaaccttaggtgatctgcttgcttcagcctctcaaaatgctgggattacaggcgtgggccagcacgcccagcctcctgtaagtttattgtaaaggcactcatcatgtgatttcgggcatgctgggcaatctaggatgatttcctcatcttaagatccctattttagttacaacaaaaatcactttttctcataatgtcactgttgtggtttgaatgatggtgtcctctctaaaactgatgctgaaactgaatcctcaatgcaacagcattaagaggtggggcctttaggtggtgattaggctattagagctctgccctcatggatatggttagtgtcttatcaaatgtcttcgggggtgagttcattccttctacctcctctgctatggaggatgcagcgttcatcccctcaaaggtcttcgggggtgagctcattccttctacctcctctgctatggaggacacagtgttcctcccctctggaagatgctgcaataaggcaacattgtggaagcagagagcagcctcacctgcccccaggtctgctgctgccttgatcttgaacttcccagcctctagaactgtgagaaataaattcccattgtttgaaaatcacccagtctacggtattttgttacagcagcacacatggactgagcacatccgatttacaggttctggggattacagtatgtacatttctttcttggggccacccttcagaccaccacaaaatccctcttcaaagatgactgcattttgttgttgttgttgttgtttgttttgtttgtttgttttttgagatgacatcttgctcagtcacccagtctggagcgcagtggtgcaatcttggctcactgcaactgtgcctcctagtttcaagcaattctcctgcctcagctccccaggtagctgggactacaggtgcgcaccaccagacccggctaatttttgtatttttagtagagatgaggtgtcgctatattggccaggctagtctcgaactcctggcctcaagtgatccacccaccttccttggcctcccaaggtgctgggattacagggatgaatcgccacgcccagccacatcactgcattgatgaaggcccccaatcgcctcatctgggactattcttcaccttccctaaccctgaggctctttggccctgtctgctgtcctgatcccgttctgcatttagccacggagcagtcagccccttcccctcaactggatagtgacctcctcgacagccaagtcatttgtgcctataacctcggcttgcctgggacagtgacatgcctgggtaaaggcagtcaatcaatgtttgttgagtttcatcaaatctttaaatgtgcactgttacaagattttattcctataagaatgtatttctgacttttttgagatggcgtctcactctctcacccaggctggagtgcaatggctcgatctcggctctctgcaacctccccctcccaggttcaagcgattctcctgcctcagcctcccaagtagctgggattacaggcacatgccaccgtgcacagctaattttttgtatttttagtagagatgaggtgttaccatgttggccaggctggtctcaaagtcctgacctcaagtgatccacctgtctcagcctctcaaagtgctgggattacaggtgtgagccactgcgcctggcccatttctgactttttaatgggagtcagtgttacaatgggatatgttgatctgaaattcacttatatatggttgttctggaatacacctgttccacaaggtaagatattctcacatctcctttgggacccattactttacacattcatggcttcagtttacccatttgtaaaacaagaaaaaacgataaacaatatcatagttaattagttgtcttgatggagtctagtatgattctctcaagtaggtaacatagaagggtactaatgcaatgtgttattatgggataatgtataaatagtcttcaccactgggctggaaggatcagcgtgggcgtccagtatacgggcccttaaa

SEQ ID NO: 757 - DNA, 8836 bp, Homo sapiens
  misc_feature (1)...(8836): n = A,T,C or G
ggccattgtgtgacgcaccgaatcaatgtcgatcgcgctcagatacagatcgaatcgaatgcagtgcgagcgatatactctcacacgtgatcatattacatgcgtgtagagtgcattgatcacaatcgatgcattcatcgcatcatgatatcgtacggattaatcaaaaaatcctctgtccaagtccacacactgacgtgatccgggcatttgacataccgatcaatcaagcgatctcacctcatacacactcatcattatcgcgtcagtctcatcatacaccaatgtcctccatcatcgatgacaattgtcaatagtccgtccgtcccaaaagtaaatctcgcgtatggcgttataaaaacatcaggatgacgtccaacatcatcaggaacaacgaaatgtcattgatcatataaaattgtcttctacagtggggcaagcgtgtgcgcctatggtcgtcgtccccgtggtaaaagccacgtgaccaggtcctgcctgcgcacgggcaccagcctgcgtctacccgcatcgcttccgcaccctgtgttcagtgacgtcggctgaggaactggaaactggccttggtaaagcattgacacatggacactgataaacagggcttttaggaaacagggcttcccacgtcctaaaaagctctctctcccggagaggagtggtttcctgcttacggttaaaaaacaaacaacaagcgaagacaccagcctatctgcagcacgaggcactgaaacacctgcccagaggccccccacgctgtgaggcttcagtgggaccgggggagtccagaataaataagttgttggaaggggcttgtaatttcttagactccgcgagaccttagaaacgtagaaactcaaattatttcatccactgagatggcgtcaaggttttgtggcggtggctattgcttttcccttagatatggaggaccttcgacgaggcagggatcttaaaccagggtcgtgcccagagccggatcttaaaccagggtcgtgcccagagcctttgcctctgctaaaggccccccgaggctgaagaccggcggcctcgctgcaaaccgcgattggatgtgggagccgcggtttcagcaaatcccaggacagctcggggctgcgtgtcaacaggcacagacctggcgctcatgacctgtttgctgaaacaacaaatccataaccaaagggtgcacttttccattgcctagggctgctttaattatagacagcaaagtgcctcgtgaaagaggtgctttagaattcttaataattgatggcgacgaatttaaaaaactctcagaccacagtccttcccaccagggtcccggacactctgctgcagggccgcctctcccagctaccctttcctctcattactttgtgttctctgctccacccaagccaactaacgtgcctgggctggacgtgcagctccagacggggacatgggggtttcagggacggcgatccagttggggtgtgagctctaggggactcatctgggacccgtacttgcctaccacgtatgttgtcatcaggtatgttacagatgtgttggactagcttggaaatggagaggggggatctctggaaatcaaggaggagctaaagcttccccagacggggctttccatcgcggccaggagccggcagcaccttcatgcagccccacgcccccgactgttccctaatcctgcaatgtcaagtcctagtcaactcctcaacaggcaaagccatggcgatccttgctcaaacccatttcgcgatgacctccttccagaattaggaaagcaaagaaaatacagagatgcattttgtaggacatacaaggccaacgttgtgtgtgtgtgtgtgtgtgcgtgcgtgtgtgtgtgcgtgtgtgtgcacatatcctcacatgaacacagtgtttagttcccagcacttaaaactaaaggcatttcactgacattatttttaattaaaaaaccacacacattcaccccttcaaataaaaagaggaggcctctggacttgtggcttctcctgcagagtcagctcccggccctgcagggacaagattcctaacagacactttaggagggaagacaaacactttttacactcactgtgctttcagaagcaggcaaacgaaagttagaggggaggtgccgtgttccatagagaagtagtaaaaggggggccaggcgcggtggcttacacctgtaatcccagcactttgggaggccgaggcaggcggatcaccggaggtcaggagttcgagaccagcctggccaacatggtgaaacccccgtctatactaaaaatacaaaatttgccggacgtggtagcaggcacttgtaatcccagctactggggaggctgagacaggataatcgcttaaacccaggaggcggaggttgcagtaagccgagatcccaccactgcactccagcctgggtggcagagtgagactccatatcaaaaaaaaaaaaaaaattaaaaagtggccaggtgcagtggctcaagcctgtaatcccaggattttgggaggccgaggcaggcagatcacgaggtcaggagattgagaccatcctggccaacatggcgaaagcccgtctctactaaaaatacaaaaaattagccaggcgtggtagcacgtgcctgtagtcccggctactaaggagtctgaggcaggagtattgcttgaacccatgaggcggaggttgctgtgagccaagatcacgccattgcgctccagcctgggcggcagagcaagactccgtctcatttaaaaaaaaaaaaaaaaagggtggtagaagagacgtatttcctccgggaggtgaaaaacatttctgattgcttcatatgaaaacaacagcagcaacaacggtcgtctctcctaaaagactattacttaagaagccattaagaaacaaatggcacctgctccctctccggcaggcagctgagttaaagaggacagatcaatccaggcagcgtcctttgttctagcagctctctcttctcccgcctctgcaatcagcttacacgcgcccagagtctttacttctctggaagagggctctgtcacatacctagtgctatctgtgtgcccctgcgtttgccccccgtaccagcttcctgatccagaaaaagccagacattgcgaccaaatgatcgtcagttcagtgtttgtggatgatcatctccagcaggggttctttataagtatttcttccatcccacacgctaatgttgtacagaactctttcccaaactttggctagtcgcatgcacttgcaccgtttttcatatctgcatgccatatgcaccactgcttatactttttgtgaagtcaatttattttgaaaggcaattttcataattggaaagctggtatcaagcactgtacctgagatgtgatcatcagaatgaaaacaatgaaaaagaaaaccacattattaaatgccttttagatactgttgttgcctgctcatggctcccagtctgaggccttctctcttgattagccagaattttagcatcaaactagaagtttttctttcaatgttcttcaaacagaaaaatgacaagataattttaaaaagtaataataataaccatacctctatgggacttaacatgaattagcacactgggaattatcttgttactactacaatgctagcacttaaggtgtgtgtgtgcatgcatatatgtgggtgtatgttaacaaactgccacatttaagcgtaatttatcttccatatggtattcaatgtggtcacacagattctagcccttgatgtttttatttgtttgtttgttttgaaacagaatcttgctctgtcacccaggctggagtgcagtggcgcaatcttggctcactgcaacctccgcttcccaggttcaagtgattctcgtgcctcagcctcccgaggagctgggattacaggtgcaggccaccatgcctggctaatttttatatttttaatttttgtacttttagtagagacggggtttcaccttgttggccaggctggtgtcaaactcctgacctcaggtgatcgcccctcttggcattccaaagtgctgggattacaggcctgagccaccacacctggcctagcccttgacatttttaataccttttgtggccctttccaggtaaatatttccaaaagcctttgaaaatactgagaaaagcttgtaactcccatgtcatgcttttttggggtccctagggaactacaaaaaactatataagaaagaaccacaaaacagacaaggtgcctggcagttgtgtagagttcgcttcactcagattttcagggacactgctgctttagggaccggaaacagaacacccctgaagaaacggagtcatcactgccaatggtacaccccatctggctggaaacgctaagtgcgttttgttttccaaactgcttggagtcagtgcaagctctttctcatgagatgaccagtgcagccacacagactttatttaacgctgcagaccaggcagcttagtccatgtgagctgctattgcaaaataccataaagcagaggctgacgaacaacagaaatgtgctgctcatggttccagagggtggaagccaacactgaggtgcgggaaagatgggtgtctgcgaagcctgcttnccatccagatgctcgccaagtcctcgcttggtggaaagggcgaggcagctctccggggcctccctattgggcacaaatctgccctcatatctgaatcacccccaaaggccccacctcctaataccctcacactggggaacaggtttcaacataggaatctggagggatgcacacactcaggccatagcagcaaccctggaacaaaaaccccacaaagaggccgggtgcggaggctcatgcctggaatcccagcactttgtgaggtcgaggcaggtggatcacctgaggtcgggagtttgagaccagcctgcccaacgtggtaaaacccccgtccctactaaaaatacaaaaattaaccaggtgtggtggcaggcgcctataatcccagctgctaagaagactgaggctggagaatcgcttgaacccattaggcagaggttgcagtgagccgagatcacaccattgtactctagcctgggtgacaggagcgaaactccatctcaaaaagaaagaaaaaaaaaaaagatccacaaacacgcggagctgtcactggcagtggtccaccctgtctggctggaaacactaggtgtattctgttttccaaaccgcttggagtaaagacgagctcattctcatgagatgaccagtgcagccacagattctatgaatcctaagcccttgggacttctattaggactggcgtggaacacagcacgtgtttggtcctgatctggtgagggacgagtgaatatcccagagtccccatggaatgggaggcggcatctgcaagtggctctcaggggctccatccctcggtcacggccaccatagtcacggccaccagaacgtctcccatcccagcgtgtttctcggatttacagatactcattttccacacaacaaggctcccaaaggtgtcacctgccatctgatgctgggtggaaggaaccgtgccaagtttgttgagccatttaaggaaatttcaaagacaatttggatcacacataatatttgctttatgcacccaattagactaattttcactttatataactttaattttctttttataggactcctatgtatttcttttctttttttctattcttttttggtttcccttttttttttttttttttgagacagagtcttgctctgtcggccaggctggagtacagcggtgcgaccttggctcactgcagcttccatttcatgggctgaaataaccctcccacctcagcctcccaagtacaggcatgtgggactgcaggcatgtgccaccatgcccggctatttttttggtatatttttagagacaaggtcttgccatgttgcccaggctggtcttgaactcctggactcaaccaatccacccaccttggcctcntaaagtgctgagattaaaggcatgagccactgcacccagccttgaattcagttttaagtgtagtgaaacacagtctgagctttgtctctgaatgtgaaagaagtgtagagtttaactttccttataggccaagatgaagttcggaatccctgatagctcagtaggaacctttgtaaggttgtcactgactgttgcaactctttcatgcagtcacaaagcctcagccctgagtttagtgattctgttgacagtgagttgtgttgttttcttttctttttttcttcagcttttaagttcagcagtacatgtgcaggatgtgcagatttgttacataggtaaacgtgtgccatggtggtttgctgtacagatcatcccatcacttaggtattaagaccagaatccattagctattcttcctgatgttctccctcttcccccaccccacccccaacaagttgtcaagttgtgtcattttctgtaaagtgatacttattatttttttctttttctttctttctttctttctttcttttttttgggggggtgggcagagtctcactctgtggcccaggctggagtgcagtggcatgatcttggctcactgcagcctctgcctagcaggcttaagtaattcttgtgcctcagcctccagaatagctgggattaacaggtgtgcaccaccatgcccagctactttttgtgtttttagtagaaacgggctttcactgtgttggccaggctggtctccatctcctggcttaaagttgtttgcccgcctcggcctcccaaagtgctgggattacaggcgggagccaccaagtgcagccggcccctgttatttctttttaaaggttttacacacatatgtggaacattttattcccacaagtgggattaggtctgtatatttaactcatatcttagctacttttccaaatccacaaagctacattctttttattggctgtgaggtattccactgtgacaatgcaccatacttattaaaagtctctcttgtttttttgctattccaagcaaggctgaagtgttttcgattacatttctttacaccattgtatgtggatgttggaaatataaattcctaggaaagcctgtgggtcaaagggctgtgtaacttttgttttgattgacagtgacaaaatgctatatggaaaggttattccagttcgtattctactaacagatgggcaaggacttatttctcctctagtcagattgctggatttttgttttttccttcaaacttacagttctcaattttaccatgcttgacctctgcttcaaataaacaaagtcatctgaagttaggtttgcttcttttaagagttgaaggaggagaggagccctctgcaaaaccaacctattgcccagaggaaaaaaatcaattacattgctcaatctaataaatatcgagaactgaagccatgcttactcttagtaaatgtggttaaacttttacttgttcattcctagttgttgtccatatggaaattaaactgtatttattcctcagggttatgtttttgaaggttaaagtctctctgtgtagcatcatgtgtaaaaagcaccagaaccattgtcagtaagaagagctgtccctgtgcaccgtgaggttttcacttagcaaagtatctggggaccttctctgcaccagttgcagacattgagttgccctaccctgtcattaactggctgtgtgatatttcattctgtgcatacactacgcatttcttagacagccttctattgattaaactgtatttaaaaatatatagttcttattgatttttaaattacttatagaggtgatttggaaactatgtaaaaatacaaagaagaaaatatggcacctgcagtttcgccacccagaaacgaccactgtttgtgtgtgtgtttttggttttatttatgtttttattcaaaattaagtttgcaaaaaagatataattttacaattaagcttgcaacttcttttaaaaaatatttgtaatcgtgccgggcgcggtggctcacgcctgtaatcccagcactttgggaggccgaggcgtgtggatcacaaggtcaggagatggagaccatcctggctaacacggtgaaaccctgtctctactaaaaatacaaaaagttagccaggcatggtggtgggcacctgtagtcccagctattcgggaggctgaggcaggagaattgcttgaacccgggaggtagaggttgcagtgagccgagatcacgccactgcactccagcctgggggacagagcaagactccgtctcaaaaaaataaagaagagcaatgtaaactgattgtagaaaatacataaaaagtatatagaggaaaacagagatgagataagtgtttactgcacatcaacttacttcaggacccacaatcaccaggtgcacattgggctcctcctgatgccaggcttgggaagaaaaaagaagacaaaaaaacacttcaaatgggtttaagtcacagctgcaagcacaactaacttcaatataaatttctcaataacataaattatttcatatcatttggctttcattcataatattaggcaatttaaattatatttatttagaatttctgtatttgacattttatgattttaagtgaatttctacaatattatccattgtccagatttctaatttactggataactaggactagtctccaatatcaccccaattcaatgtggactttggaatataccaagactctccgatagtgttcacccacggtggaaggaccgcgacccctca

SEQ ID NO: 758 - DNA, 8039 bp, Homo sapiens
gagagtcgtggtgaatacggctcactgcaagctccgcctcccgggttcacgccattctcctgcctcagcctcccaagtagctgggactacaggcacccgccaccacgcccagctaattttttgtatttttagtagagatggggtttcaccgtgttagccaggatggtctcgatcccctgaactggtgatccgcctgtctcggcctcccaaagtgctgggatgacaggcgtgagccaccgcacccggccataaaatatcttttcatgctgatgttacctttctgctttgacatgctgagattctgttttagctgcaggatggtttgagcgtggctttggttttctattaaagcttctttgatctcttagctcaaccgtttcaacgaagcatatggtctctgcttgcaagcgatcatatgtgggtgcattttctggtgctctttgataaggagtggggtatgcacatttggtttgagcatgacagcttaatgactttccacaataacttcttatatcgaagattacttcccttaagcctaggagttgtaacaaggtattttgctagaaaataaataagcttggaaggaggaaatgagaattttcattgtggcttgcgatgcttttgccctttaaaatttcatgacatgtgctttcattaaataaaaatatccccccttctttttctctttatcttgcactttgttccacgtggcttcactaagagatttgaaagtgaactgatgtggaaggtaaatccagaaaaatttaatgcagtttttagtttcaacttgaaagttgctgttatgccttaagttttagataaagtgtttttgtggtcttataaaatttgatttctttccttgataaattatttttccttagttattcatgagagcagaggcatgctaataaaattaaaagtaagagaaattcctaactaaaaatactcataaaatgtgattttgaaaattaatatgtagagcccaaaaaaggctttcattggactgtgtactttttcatgataagatgttagggttaaaggataattcagttgtttaggataattcgagcaaaaggcatcagaaatgggaaatggaaaggtggggtctgctggaaatcattctttttgcagatcttatgagcatagaactatatgcagggcccctgtgcatggccttgggagggacatggagataggaggagaaggtgggcaagtatcaaaagacgttggcccctgtggtaggaggtgttaccatagcgtggggtggagatgttacttctggacagggtgatgggaaagtgtctcagagagggggcattgcctgcatctcagaggatgaataggttttggggacagaggatgacattcctggtagagagaatgcagggacacagatagacactgatatggtttggctgtgtccccacccaaatctcatcttcagttgcaatcccgtgatctccacgtgtcatgggaggtagtttaatcatgggggtggttaccctcacgctggtttttgtgatagtaagttctcgggatctgatggttttataaggggcttcccccttcactctgcacttctccttgctgctgccatgtgaagaaagacgtgtttgcttcccttccaccatgattgtaagtttccagaggcctccccagccctttggagctgtgagtcaagtaaacctctttcctttgtaaatgatgcagtcttggatgtgtctttattaacagtgcgagaacagacgaatacggacacggttggggtatagtggataaattaataagtaggtaggctttccagaatcgacgtaagcttatgaactatatctgaggaaatactttggacagaaaccagagaggcagcagagcatagttttacaaattcagccccaggagtcagcctgaatgtgaatactggctcagcaactttctagctgtgtgatcctggttaagttatagaactctctgagcttcagtgtcttcatttgtaaaaggcgggtaatgataaccaggttgttggaagaaataagctaatgcatgtaaaggacttagcatatgttctgcacagagtaggtggccgagaagtattaactattaatggcaacaacagcaataaacaaaaaaattgtgtatggctataatttttctcttgaaatagatttctaggaattcttttaaattttcttatgcatccaaattggctgaaggctaacagcaaattttcagtgacttagtgacctcagggatgtcaacgagcttaacattaccaatcctttgcgttaaatctcaggctttctggtcatctgaaggagctggggtttaatacacacgtgaaacatctccttgccagaagaaatggaaataaagtttctagaaagcagcgttatttcagttagtgttataaactgttgggatatcatcatattcttcaaaccaacttggtttgtaactcataatgcctactggtaaagtgtaaatgagaatagaaattgaatatgccttcactcccggctcatcaggagtagcagctgggaagaaactgcaggcatagcattagcaaaatgtgtttagaccctctgcctgtatctttgaataaatgcttagaattttgtgttacacttgcatatatttaggaatttttttcagtattttaaaattctattcattgtcgataagaccaggagaggcatgggtgttggttgttttgttgaagactttgctgttggatgagccagatatgataactgtattctgcagctttgtcctgagtgggctggaaaaggtgaaacagcaccctaggaaggtcctctcagcacctcagtaagcaaacttacctgaggccaggttgttgcacaagacgagatcattgcacaagacgaggttgcataagatgatgtcgtgtcacggtgaggtttctgctggtgaggagtgtggctgctgcccctgggaatccaggggttcctttcaggcaatcagggagcttctctctacctcccagttctggagttttcagaagtgtggcagtgtcacttaatctcagatgtgtacttaatctcaaaagtacacatttgaggccgggtgcagcagctcatacctgtaatcctagcactttgggaggccaaggtgggcggatcacttaaggtcaggagttcgagaccagcttggccaatatggcgaaaccctgtctctcctaaaaaaaaaaaaaaaaaagtgcacatttgagattaagctcagccgggcacagtggctcatgcttgtaatcccagcactttgggaggccgaggcaggaggatcacttgagcccaggagttcgagaccagcctgggccacattgtgagaccctgtgttagttctcccactgctataaagaactacctgagactggagaatttataaagaaaacaggtttaattggctcaagttcctcaggctgtataagaagcacagccagggaatgcctcaggaaactttcaatcacagtggaaggcgaaggggaagtaggcgcgtcttacatgtctgggtcaggaggaaaagcgcgaggctggaggtgccacacacatttaaacagccaaatctcctgagaactccatcgcgagacaacactgggggatgttgccaaattgttagaaaccccccccccgccgccgatccaatcacctcctaccaggccccacctccaacaatggggattacaatttaacaggagatttgggtggggacacagatccaaaccatatcagaccccatttttaatatatatatatatatcttatatatgtacacacatatgtgtgcatatataagattaagcttatagattattttgtattggtggtgccgtctgtagctctcaatagatgtattttgtattgtattgtagctctcaacagatgtattttgtattggtggtgggatctgtattggtattgtattggtattttgtattggtggtgtcgtctgtagctctcatcgttattttcttctagcatttttctaataagacttcgacatttgacttttttcttctgcaacacatatagcagttactgtgtcccaggcacagttctaacagcaaccagagaggcagcagagcatagttttacgaattcagcccctggggtcaggctgaatgtgaatacaggctcagcgcttcatgtcttctcagtcatttactcctccgagcaatcccaaggtgctagagttctcattggacagacgagcaaactgacacgcagagaggtccgttaatgtgcatgaggctagtttggtgcctgggtggcctgaccctggccctctgtatccggagtcccctcagtctggtgctgcctctttctggcctccacacatccactacgagtttgcttaaaaacttctggcctgtctttgaggagcgataagtttgaacatgttgctattaatttttgcatgaattcaacaagtgtgttattagccttcaggaatgcaacaggacggaaatagtccctgccccaaagcacctgttccttccagatgcaaagcaggagtcaagtcgggactggaggatgttaggttgtgactaatgaaaaggctgcccctggcctttaaaaagttgaggtggaattcacatgccacgaaattcaccattttagagggtacaagccagtgggttttagtctattcacaaagttgtgcaaccatcacacctatctcattcctgaatattttttctctccccaagaggataccctctatccactaagcagtcacttcccatttccgcctcaccccaataacccctaattagatcctgagtgacccctgggtaaccaccaatctactttctgtctctgtgatttgcctgctttggccatttcatagacatggaatcatacactctgtggtctttcctgtctggtgtaactcacgtggcatcgtgttttccaagctcacccttgttgctgcctaagttggcacttccttgtcacggctgagtggcactcctttgtatggattggcacatcacgtctactcattcatcagctgatgatcaggtcctggcctttcaaactgtttctgcgaagtcatcctgttaaaaaatattttgatatggtcagacctttggtcatagacttactaaggattccaacctattctgcctgaatgattttatgacaaaatccttctgcatcatttaagcaacacttccactgcaatattgggtggttgtcaaattgtcccatttctggaaacgactctgtctcaagaccttaagttggctgaagggttctcactcaccacactcaggtgtagccatacaggctcctaaccagagtctatatgtattctttggaacattctgtctcttctttctctctctctttctcttttttttttttttttttttttgagacagagtctcactctgttacctaggctggagtgcaatgcggtcatctcggctcactgcaacctccgcatcccgggttcaagcgattcttccccttcagcttcccaagtagctgggattacaggtgctcactctacccccacgcccagtcaatttttgtgtttttagtagagacaggctttcatcatgttggccagcaggcgggtctcgaactcttgatcacatgatcccccctcctcagcctcctaaaatgctgggattccaggcatgagccaccagcatgagccaccgtgcctggtctctctctctctctctctttttttttttttttttttactattattgtttttattatttaatagctgggctcatagtaccatttcctacttatttttttccctctctgaattgttgagtctggctctgctgccatttgatgtaattcctggagacttagcttcatttcaggcttttgctaacatgtgtcttcttttttttttttccactgttttaaggtcatttattagaacacagtcattcagaagccactgagacatcaggcagcaggaaggaaggtggggtggagcaggccctgtgaaggaccaaggacaaagtaatagcctcagttatgaaatttcattttattctgataaagactaatgtatgcctgataacctagtgataatccacaagtttggtagttcacaacatttttagaaagcacgtacgattaacatttaaataaggcattatagaaagttttataaagaatgaagtgtgtactataattcttttaagaaactttggttcatcttgaaagatcaatgaatttttaaaatatcagaagaaaaggaaaataaatttttttccccaaaaatacataagaactgcttactggcacttgtattttaagtacctggggaaaaaatggaaaagatttttaaaggcaattaataacagcttgtacgagggcttgtttcatttgttctggcaccaagtaaagagtaaatacgccatggaagacgccatcaggttttccgtccacctctcctactgccccacttctcccagaccacacagcacatcagcagccatccttgctgccccactcaggaatcactttagattccaattttctttgtttgtttgtttttgttttttgtttttttttttgagacagagtctcgctctgccccccaggctggagtgcggtggcacgatctaggctcactgcaacatccaccttccgggttcaagtgattcccctgcctcagcctcctgattagctggggctacaggcgcgccatccagcccgagtaattttttgtattttagtagagacggggtttcaccatgttggccaggatagtctcgatctcctgacctcatgatccacccgcctcggcctcccagagtgctgggattataggcgtgagccaccacgcccggcctagattccagtttttaaatggcttctcagatgacaccaacagagttctttccctttaaaataaggtggcagtgaatgctaacaggtatcgatttcttggatcaggaacaaagaactccttcaggaaactcacttactggtcctggttaacctattgtgtaaagtctttttattggcacacctgtttactaattatgattgattgctatttatgccaagggagcgtttcccaggcatatctcatctatttactaacgacaaagtgtgcttactttatttacatagtgccacaggttttctcttttctctcttttttttttttggcagggagtggcactataacttgttatttatcagggcggatcatacatttggatcaaaaagaggaaccggcaagtagatcctaaaacacatttctcaacctgagtcacatctgaaaacatatagattttaattacattttgttgaaaattcattcaacttcggtgcttgtccaagaacttataatgttaatttctgacataaatcataaccctcagtacatatgtattttcaaaggaaacaagtcatcttaaagtaatatttttctatatgcgaatggatacattgttgtagcaaattgaaaattctgagtaaactgaaagtatgcttaacaacaaaataaatacagcatatatggttagcatacacatttcttagtagcagaggatttgtgtcttacaacaaatctgtaaacccacttgctttctttctggtattttatatagtgtctccccatgttccacaacgctggagatgtcttttgtggcatcgatctgtgcaaacatttctgatcacatattttcccccaatgacatgtaacttttttttaacttttccgggaaaatacggaagctttatcaaccacttattaactgaacaaaaacttagattactaccaaatgctcttttaattttgctccaacagatgttttaaaagttcagacatcactgatgtttttgaggatagctgcgtaaaacacactagatgatttcaaaggatgaatcttagtatctgactcatttggcacatccttagtatctagaatcaaatcagtagaaataaaagtcatataattttcaaagaattcatacatactggaattccgcggatcctctccctatagtgagtcgtattagcggccgcaaatttattagagc

SEQ ID NO: 759 - DNA, 8274 bp, Homo sapiens
gggggcatatatagcctcccggttcggcctccgtggaccgcagcaggcatcagcgcgcccctatgcggaggtgggacagtggtgcttgagcgggtggcagagacgcgtcgcggagccagtgcggcgactgagaggaaaagagggttcagcgggaccgaggtccagcggtggcgggatcatgggtgtcatccgagtaagtaggggacttcggcggggccgcccatctcccgcacggtggctcgttcgatacgctgaggtgaggcgcgaggccgcgcatatcgcctagtgagcggcgacggcgacggtagcgagtttctaatagcgcatgagcctccctccttaaggcgtccataaaacgctggggattcaccgccatatgaccgtcagggtggggcccccggggcgggtggcgtttcaatacatctcgaatggctgtttgttctttaggaaacgggtctgtaggactagaaagtgggctcagagtccatttcggacgtaatttattcccctttggaatcggtgagtttggttatgctgccacttaaagtcactcggggagagttagctacatttcgggataatggtagcaagagtcatcgatttacagacacacgtgtagtaaggtcgattattagtacccagtcatgcaggcagggagggagggagggaggaaggggaaggggaagggaagggaagaaggaaggaaggaaggagaaaagaaaagaaaaagacagaaacagaaggaaagaaagaaagaaaaagaaagaaagaaaaagaaagagagaaagaaagagaaagggagcaagagagaggaaggaaggaaggagggagggagggagggagggaaggagggaaggaaggaagggggaaagaaagaaaagagaaaaagaaaaataaagatgggcacaaaattgcagtccatagaaaaagaaatacaactggactcttgaacaaagaaaatgatgctcaatatcagccatctttttaatccagaaaatctgtaaagattaaaatgttgacctgaggcctcatgaaataaacactcctatacattatctgtgagagagcaaattggtacaacctctctagtgggcaatgcaacagcagctagaaaattttaaatgcacaaaccctgtgaccaaataactccacttctagatatttattccaaagatggacttggatatatgtgcaaaagcatgcacccaggaatacgcactgcagctgtgaagtagcaaaaagaccaaaaaactacctcaccgtgcatccgcagggccctcgttatattatggtagatggacctaatcatgttcttttgccatcaaaagaatgcaatagatcactatgaagtattaagaatgaattccaagattcactattaatgaaaacagagcacagtgaagaatacttttgggtatatacactgtgtgggcatagaatatctctagaaggatacattaaaaagagataacaatgattgtgtccaaagaggagagtcaggccaggtgcagtggctcccacctgtaatcacagcactttgggaggcagaggtcggaggatcatttgggctcaggagttcgagaccagcctagacaacatgatgaaactctgtctctacaaaaaatttaaaaaattacctgggtgtggtgacatgcacccgtcatcccagctgtttgggaggctgagatgggaggatcgatgagtccaggaattcaaggctgcagtgagccatgatcatgcgactacacttcagcctgggtctcaacagagcgagaccctgtctcaaaatgaaagaaagaaacagagagcaagagagagagagagacagagaaagagaaagaaagaaagagacacacgagcttttgtattgttggatagtttttaccacatgcatatattatctttttaaattgtttgaggtgtgtatgtgtgtgagtgtgagcgtgcgtgtgtatgtagatacacaacaaatgggaccaggtctcttttctgattaaaacctgcaaagagctcaccgtattcagctcaactgtcagtggcatgagaatggggaccatttctatcctgcttagggaatcaactaatggctgagcgtgtctctgggataaatgcctcagcccagaacacagctcaccctgcatggcagaagtgcactccactccaaccaccctcccacagcaggacctctggcacatcacgcttccttcttgagtctccacgccgctgacatgacacttcctagtgccagctccttccagagaactctcctgacagccccagttcctacacaccacagtctctcaaaattcccattttgttttgagcctatctctgttataacccctctgcactgcatttatagggaagatggagtcacatcttacttggggcactgattacaaaatcagcacatacatgaaaatcaagtacacttaaaagtacccttgaatcggccaggcgcggtggctcacgcctgtaatcccagcactttgggaggccgaggtaggcggatcaggagttcgagaccagcctgaccaacatggtgaaaccctgtctctactaaaaatacaaaaaaattagctgggcatggtggcatatgcctgtaatcccagctacttgggaggctgaggcaggagaatcgcttgaacccgggaggcggagactgcagtgagccgagatcgcgccactgcactccagcctgggcgacagagcgagactccgtctcaaaaataaataaataaataaaaataaaaaataaattaaaaaaaaattacccttgaaaatctcttaaatcatccagacagtactatagaacaaagttcaagtccaacctagcccttttttcttttgtaattccagcaatgaaatagttatttattcagctgaacaccaggtgaattaactggtgtgcatttaggagcaatattgcacaaaatcatgagtaaaacaaagaagaggaggacaaagatcagaggaggaggaagtagggggaggtctagagcctttaaacactgtgttcataaaatgaccaagttgctaggactgtgggagccacagagaaacatgaggttcaaatcgtctgaccctggggcatatggtgagattctacactgtactaatatgtggatgatatttttctctctctctttctgtttctttttcataatgtaaagtgtcacaacatcactgtgcaaataaagaataactagggtcttgagacttaggttggtttaacttactgaagtgcatcgtgtatcttgagcctaccattttcactgttaattttgatccagtcattgtgggtcagtaacattccttctctccccaccaaacctagtatcctttggaaatgctgaaggtaactgaccagcaggatcaggaaagatgcctgcagcagtcaagctatcagctcgcttcagcctaaaaaaatataaaatacatcacacaaaaataaggattcaacatgcttctgaccatggttgaataattgctattttatgttcttcgtaaagctctaagaaatgagaagccaaaaataaacactgatagatggaaaaggggctgaattctacttggagagtccattcctgagggactcatgacttatgcagaatcgatacagcagagtgcgtggaatgcaggtggttacatagagacaatcggtagtttctgatttattaaggtgtttttgtttgtttgtttttgagatacggtcttgctctgtgggccaggctggagtgcagtggcataatctcagctcgttgcaacctctgcctcacgggttcaagcgattcttgtgtctcagcctccagaatagctgggattacaggcacgtgccaccacacatagctaatttttgtatttttagtagagatggagtttcaccatgttggcaggctgggctcgaactcccaacctcaggtgatccgcctgcctcagcctcccaaagtgctgagattacatgcgtgtgccgccgtgcccagcctattaagcatatttttaaatggcattttgacactaactttgcaatctcataaatattctaaataaatttgtctaatctaaattattcatgaactaaaattgtacccttgtttctggctgacttgcaacacctttaaatcgatctatgttctctccttctgtcaagtaataattcaattcaactaataaattcactaagcacctattattcccaaataattctgatttgatttaaaaaggctttcttgaaaacaaaagcatctcccatagagattttgggcacttggcaggtccacaaagagaagaagcctatgtgtgcgcgcctgactcaagattcacagacgctctgtggctccccggccagcaaccagactctttacttgagtgtacagtagagtttggtcatttctgtgttttggttttgtttttttgttgttgttgttttgagacagtctcaaaaatatttgctggagtgcaaatttatttactttttgagatggagtctcactctgtcgcccaggctggagtgaccgtaatcccaacaggctgaggcaggtggatcacatgaggtcaggagtttgagaccagcctggccaacatggtgaaaccccgtctctactaaaaatacaaaaagtagctgggtatggtggtgcatgcctgtaatgccagctattcaggaggctgaggcaggagaattgcttgaacctgggacacagaggttgcagtaagccatgacagagcaagactctgcctcaaaaaaaaaaaaaaaatagaatacacacaggaactcttttttaaaagactgcaaaaattcaatcacctaacaggcaaagtgactagatcaggaagtgtcttgaactcaaatgtcaattgagatcaggtgaaattcaatgaactggaggtgaggatggtgaaatcataagacaggatgagctctgcaccgaacaggaggggacgcccatctgcagggtcaggcccccatagtccagtaagataaagaaagccacctggggcagctgagcactaaaactgtgcctaatccaaatagaaaggcactcagtgtgaaagacacacgcagctcggttagacatgcacacgtataatatatattactacttatacgtaaatatataaattatatgtatacacatatttataatgtgtatttcaaatatgttttataaatattctatttatatcataaatatttcaaatatataatttatttcaaaatagatggggctgggcatggtgactcacaactataatcccagcactttaggaggccaagacgggtgaatgggttgagcccaggagtttgagaccagcccgggcaacatggcgagaccctgtctccacaaaaaatacaaaaagtagccaggcgtggtggttcacgcctgtagtagtcccagctactcgggaagctgaggtgggaggatggctttagccctggaagacaaggctgcagtgagtcaagacggtgccactgcactccagcctggacgaccgagtgagaccctgtcaaagaaaaaaataaacgaggctgggtgcggtggctcacgcctgtattcccagcactctgggaggccaaggcgggcggatcaactgaggtcaggagttcgagaccagcctaatcaacatggagaaaccccgtctctactaaaaatataaaattagctgggcgtggtagtgcatgcctataatcccagctactcgggaggctgaggcaggagaatcacttgaacccggcaggcggtggttgcagtgagctaagatcgtgccattgcactccagcctaggcaacagagcgagactccatctcaaaaaaaagaaagaaaacaaacaaaatagatcaaaatcatgtttagacatgttgagtgaaagagaatataatattaaagttgattttatctgtttctttttgctatgtttaatgtgactactggaaaatctgacaggacccatggggctcacattatgcttctaggcgagagtgcaaggtcagaccccactggctctggcagtcggcacccagctgatcgaggagctactcactgctacaaggtcaccaatctacccagagaagccaggcatttcaacatctgtgagaatctccccaattccaacctccctaatggtatttctcactccttcaagatccacaacacctgttagtcctctacatcttcagaagttcccggaggcctgcgtttcccatttcccttctccatacggacgagtgacgcttttgggcggggtgttgcctctagtgtctgttcccacacgctccttcctaatacctcgaccctccctggcacttacttgaggaggacgagccccatctccagatccaagggtgctcctgcaggctcatgccaatcaaaacatccggctctccacacacccacccctagacgttcaattctgggacctgggtcgtgttttcagagactcaacctcagaggttctccatgggcctgacctgggattcagggagacccaggaggggctggcgagaagattctgccaggagagggaagcagatgcaggagacggagataagtggactcctgtccctgtcctctgctggaaaaccaccctgaggaggccctgcctccagccttcttatggcaaaagccattacattccctttattgtccaagacaatttaggttgggttttcaattcaacttagctttcaattcaattactcaaggctgaagatctctaagccacaccacagtaatagcttagcgcccttattgttagtttatacacaatccatcgcagtctctcatcccctcaatccttccattatgagtcctttggcctcctcggaattccagaccattgacctctgccccctcggacccacagtccctccgagcttttctcccagttctggggagattccatgctccgccatttcaattactttcttgtcaacaccttaaccactcccgtcccccagtctttctgtagtaagcgtgtgagcatctggaacaacgccagccctggagagtctccaggtcagctttctccatggcagccccaggcactggcgcctgctgggggacccccgaggcagagggtaagtggagatctgtgagatgggatcccaagttgctcactactgcgtcggaacctctcatgcattttcagtgaccaagcgcacctgctgtatgcccagcaccgctggggcaacgagggttcagtaaagaaaaaaacatgcacaaatccctgccctccaggtgccaactctcttttttttcttttccttttttttttttctgtttttttttttttttttttgagaaggagtttcactcttgttgcccaggctggagtgcaatggtgcgatctcggctcactgcaacctctgcctcccgggttcaagcatttctcctgtgtcagcctcccgagtacatgcctgggattacaggcattcgccaccacgcccggctaattttgtatttttagtagagacggtcaagacgccaaaggggcagtgagggttggcacctgaaggtccgtggagatcttgtctgatcttgttccgcaggagtagtggtatgtggaagcccaggagtgggcagtcatgggagatggagactgtgaatgtgtgccacactttcatttccagaagtccttttgcgatgagcaggggaggagagagtagagcctgattcggggaggatgctggtttgctggggaaaccttctaaggggctcggccatatttgatgctgcctgaatgtgagtgggaacaggaaacagggagaggcatgactgggggggtggttaactcctgagctgttggggaagggtgagctggaaaaagagtgttgcctattgttggaactcagggagaggtccaaaaggcctgcatgtgctaaaaggggtgggtaatgcaggggcgtaccttaaccgtgtctctgactttgcaactgtgactattatttgtaaggaagcaacggcttaagtttatggcatcatgacaatatatgaacttttgaggtttgtggcaaacgtaagtgtttaacatcctcaccctcgcttgtggcaagtgcaaaatcctaataacaaggagatttgatcgtctcagacagaactaatcagcttctatttcgagaacttatcagtcgaaaagcacactttttattgtatagacaactcatggtcgcacaatactttgcagcggaaagtgcagatatctatcgcataggacttaatattactggacaattccacttcgtttgtgagccacactaccatgacgatgatcagcgcc

SEQ ID NO: 760 - DNA, 8517 bp, Homo sapiens
ggaagacttccttctttctttctttccttctttcttcttcttttttttttaattgttctcctacccaaggcggaagactggcagctcagctaggtgctgggctctgtatggtggctggcgtttctgtgggacacggagggcagcaggaaggaaaataaacacgacaggccgggcgcggtggctcacgcctgtaatcccagcactttgggaggccgaggagggcggatcacgaggtcaggagatcgagaccatcttggctaacacggtgaaaccccgtctctactaaaaatacaaaaaattagccgggcgtggtgacgggcgcctgtagtcccagctactcgggaggctgaggcaggagaatggcgtgaacccgggaggcagagcttgcagtgagccgagatcgcgcccctgcactccagcctgggcgacagagcgagactccgtctcaaaaataaataaataaataaataaataaaaaataaacacgataggtccaagcgtcattccactgggttttgatattggcttcgcagctagtctcccgtttctgacctgtgccatccatctataatgaagcaggacaccaacgcttcttcctcatattccagaatcccaactcttgaaaacctctttctttgttgttaaaatgttgtgaaatgttactgtcctggacatttttttttttatgaaaaatgaataaagtcctttcctagtaaaaaagaaaagaaaagaaaagaaaaattgttctttgtgtggttggttccattgcaggagttcagtggcaaggctgaatctccccacacctcgccttccttttgaatattactttctttttttttttatgcacgataacagatttctaagggaaaagagtagagggaggaaaaaagacactgtgaccttgaaaagtgcccaatttctttgtgttttgtggcataaatatattttgcaactttatatgtatgggccatcatttcttttaagcagtttgtaatcgttttacaagtagtttttacaaagccacaatctgaagttgtattataatttcagaacaaaaactattatttttgtcatctgtagagcataaaattgtgcctgtatttcaaaaataatctattgtggtttccatttgcagaaagtttaattttagaaggtgaatctctggcttatgtttagtcaaagaatgggaagttctttggttgatgttatttccagcatgaaaaggtatcagttagtccttgggtctgttagaagtccatctatttataggtatctatccaataggatcctggctttttatatccagtaatgagccaaagaggtaacagttgctgatagacacacctcagtgtttgccattgtgtgcactgatgagctaatctgcaaggcaggccgtacacaaggactttgactcatgttatttcaaggcagagagaacaataataaatattgagcaaagaaagctaatttgtatttgttacactttcatatagaaaatgtttttcaaaatcaatataagccaattggcttttgccagatttcttttattgcaatgattacaaataactcaggtccagacttcctttatactgcaactttatttcctctgtttgcctggatgagatctgaaaataccatttatgcaacgcttttcaaatgattagaaaaatgatgctcagagatgtgggaagatcagcagataagtccagaaatcttcactttcagtcaattccttctgctgacagagctgagatacaagtttaactcttttttttttttttttttttggtggaaaaaggagtttcttgacaggaacattttgagtttatgtattgctaattgcagagcctatttccaatgaaaatagtgacaaaaactataaactctatgttgcctcaccttatatttatctaggattatgctgaatctgttattgtcaaacacttatattaagttatattaagttaaatgccatggtgttctattgtgagtgctttaccatccatcttcaagatgttgccaggcgagtgttttggacacagggttgttttaggaagaaacactccaagcttccactacactccagtaacagctcttccagctttccagggaaattataattcagcacaaggagtagtttagggctctgaactgcaatttctaatttcaatggtcgcctttagcctttttttttttttcattaaagttaatgtcttttttaactggtagagaagaggtctttgaaactctctcttaaaggtttactattttaagggcatttggaataccacacatacctgcttgcacgatgaagtggggaggagaggcaagacttctggaggcttgagatgcttcctgtagtgaaatacaaaatgcgatgctaaggacaaaaccaacaccataccgagcctcgtgtgtacccaccaccttctttattttttttatttttcaggcagagtctcactctgtcgcttagtctggagtgcagtggcgcaatgtcggctcactgcaacctccgcctcccgggttcaagcgattgtcctgcctcagcctcccaagcagctgggattacaggcgcatgccgccacacccggctaatttttgtatttttagtagagacagggtttcaccatgttgcccagactggttttgacctcctgacctcaaatgatttgcctgcctcggcctcccaaagtgctgggatcatatgggtgagccaccatgcctggccgtgccacccaccttctgcctggatgctgcctctaccaaaccttcccaggcttggggagggccagtctccttcttcctgttgattgtctcgcccttggcagggctacttcactttagcttgtgtcccaaaatataaaactgaagtggggacaacgtccaacgtggatcagcataccccatgcagtgccgagggctccctggtgccctaaagaccacactgtatccctacaccgaggaaggacaggggtgtgtcttctgtgacctccagggatctagctagttcagtcacttaatgcattgatcaggcttaggtcacatgacaaaaagacatccatttttggactctttcaccaaaatgacggcctgttttgatcacttgagagaaaccgtccttggcatggacttgctccatcactctgctcctgcctccacctttccatctaaacgtcaccttaaaaatattcctgccactgtttcaaaatgaactggagaaatggattcaatttctctctagtagttttgtgacattccaccagaaaacatggcaaggaatagtaagttgatatcttggtacaaatatccatatccgtcatgcaagggccgccttttgcttggtgccagggaggtaacttaccagacgctttccacccggctgtcctcccttgcctggaaggatctgcctcctggggcctgtctttggtttcccaacatattggcagctcctccttctcctcctgctcctttcttctttttttctgggggtggtggaagcagtcttcccctcagggatgcataagccataacatgcttccccaaacctccacctccacgcaggggcgggagctgcatcagctgggctggcactggcatgctctctggctgaacttcagtaatgtctccactaatatagcaagtgtaaaattgcaaaattgcattaggcctcatttaagagactttttgtgtgtgtgcttcttaccttatagatgctgtatttttaatggcaaaacctattaaaaagcagaagtaatgctttgctcttacagagtaataagtctatgagcagctgtgtagatgattctcagtgatgttttccaggacggctttttttgttaatgaccttcattttatttctaaaaagcagttgtcatgcactgtccaatgtacttttcttttctctctcccctcctttcaaaagccgcatgctaagggtaaggtctatgtccagagtcaaggtaagatttttaaaatatttatttacttatgtacagggatagagaatgaatatatcaaaatagatgcatatttatatgtgataaatatatatatatatttaaaagaataagtttgcatccttaagagacacatattgagatgtttatgaaggagataatatgatttctcagatttacttaaaaataatcagtgaaatggctacttttttttttcttttttgagacaaggtctggctctgtcgcctaggctggagtgcggttgtgcgatctcggcttactgcaacctctgcctcctgggttaaagcgtttctctagcctcagcccccccagtagctgggactataggcaggcatgagccgccatgcccagctgattttttttgtattccttgtagaaatggggtttcgccatgttgcccaggttggtcttgaactcctgggctcaagcaatctgcctgagaatggctacattgttaagatttttctaacattagaataaaagataaataggagaaattataaaataatgatttaaaatgcggatcacttaacattttctgccagtagaagtacgatatactccatcagcagtatgtttggaaaaaacaaaccaaaccaaatgcggagcttctgtttcagctgacttgagttgggggaactggaactcttctcccttcatactcctccttcctccctgcccaattctgcccctatggtggcatctgaggcccttcatcaaaccctctgaggtttaaacacagttttttgtttttgttttgagatgaagtcttgctctgtcgcccaggctggagtgcagtggcgcaatcttggttcacgtcaacctccgcctcctgggttcaagcaattctcctgcctcagcctcccgagtagctgggattacaggtgcccccccaccacgcccagctaatttttgtgtattttgtagagacagggttttactgtgttggccaggctgatcttgaactcctgacctcaggtgatctgtccgccttggcctcccagattgctggggttccaggtgtgagccaccgtgcccggcctctctaaacacagtttgtaaaccactgtactacatgatagaaataatggaaagactagatccaaggaagaacatgtaattggccccaagctcaggttagaacgagtgcagaggctgaggccaggcgttcgggcctcctgaggacttccatggtgctcaggcgcaccttagtgaggcacggcatcctgtcatcaccgtgtccttgctgcattggcttcagtgacatttttagctggtgcagcaggaaaaacctgggctctgaggcagcgcgtaggtttgaacacagcgtctaccacctccaccctgcgcattttgaagtgcgtttaacctctttgaacatcagtgtccagctggataaactggaggaagcagtctgctcagtgggcctttaagggttacagtggagtatggaaagcgcctacatgcagtcggagcccagggctggcttgaaatgggcgcttgttaaatagccgctgtcagtatgattcagtgtgaataacgattatgcaggtggattttggaggtggttagatgacttgatttacttacattttataaaatttcaaaatgtttctgttaccaagataacgtgttagacgttgcctctgaatttctaaattgtaaaatagtcattttttttttcagcaaaaattaaatgtaacttctctctctgaagaagtaatagccaacagaccatcaggcatgagttggtgagggttgagagtgggaattttacagggaggtataattttcacatggggcttagctgacagtgtttttgaaacctgttacttcctggcatttttaaggaactcaaggtttgtctaacccctaaccccgtttgggcctgtcatggatcctggggctgaaaggggtgcgtcttttctcatgtggaatccatgggctctttttaaccctcctgtgctgaaggattcatgggacttcagtgacacactcagagcatcgagcggctttataaaaaccaggtgctactgttatttaaacttcaacacaagtgggccgtgtgtggtggcttacacctgtaatcccagcactttgggaggctgaggcaggaggatcacttgaagtcaggagttcgagaccagcctggccaacatggtgaaaccctgtctctactaaaaatacaaaaattagccgggtgtggcagcgggcgcctatactcccagctactcgggaggctgaggcaggagaatcgcttcaaaccgggaagaggaggttgcagtgagcagagatcgtggcactgcactgcagcctgggtgacagagcgagactctgtctcaaaataataagaataatagtaataataataataagcctcaacacaaaataactcattgtatttcagcagtcgcttcaaagtgaacttgccctttttttgtttctttgacccaggaattgcaacaacaccaaacgccgcttttaactggaatacctttcttcaacgctctggtgagacatgagatcttcttagaggattttgatgaagtgcatcttgtcagttactttcaggagcttgtgacgttcatgcggttttgaaaaagtggttgtcagagagaacaaggttcatttccctctgtctgcggcttcatgagtagttttatccttttgaggaacagcagggctagaaagccagagagacaggggctctggccctttctgatgctgtttttagcacctgctttccaaattttcagtatcatttcctgtgacatttgttctttataagaataacaacctcatgtgttcattttattttactttactaattatacacgtagttaaattaccattgtagaaaaatgagaaaatatcagaatatgcaacacatttttttttttttttgagatggagtctcgttctgttgcccaggctggagtgcagtggtgtgatctagactcactgcagcctctacctcccgggttcaagtgattctcctgcctcagcctcctaagtagctggtactacatgcatgcgccaccatgcctggctaatttttgtatttttaatggagacggggttttgccgtattggccaggctggtctcgaactcctgatcaggtgatccacccacctcagcctcccaaagtgctgggaatccaggcatgagccactgggcctggccaaaaaatgcaacaaaaattttaatcacttgaaatttcatcaccaaaaagaaactgctattaatgtttgatgtgatctttctcaacaatttacatgtaaataatgatgtttaaaagacaaagtcaagcttcacttactactctaacctgccttctttgctcattatgtcagtagaatagagtgaactcatcctttttttaaaataattctatagtttgtatgcagtgaaatgcagagatctcaagtgtaaaattaggcaaatgtttgacaaatgtatatacccatgtgacaaataccccaatcaagatagataacatttccaccactcaagaaagttctctcatgccctcttccatatttaatttctgtctctttataggcgattcctagtctaatttttcttatcttagattagttttacctgttcttgaacttcatctaagtggagtcatgcattgaataattttttgtatctggctttctttgttcaactaatgtgtttgagatttatccctattgtgtgtatctgtagaccttttttcttagtattctattttggaatggtgtatttcattccatatatcacaaattgtttatctcttcttctattgatgaacttttagcttgttttccatttttaaccgttacaaatacatttactatgaatatccttgtgcaaggttttttggtgacctatgttttcacttctcttggataaatgcctctaagtcaaatagcttgactatatgattaacattataaaaaatatccaaacagttctccaaggtgtgccatcttacacttccacagaagctgacaagagcttcagttactccacattcttgcccaccggtggagtagacagtcttttcaattttagttgttctagggagataatgaaatggtgtctcattgtcattcttctaagtttcatttccctgatgattaattttgttcaccacctttttatgtgcgcgttggccattcttgtatcttggttcgtgagtgtctacccagtggggggtgtgtggccttccacttctctggctggcaaaattagcttaaatttcgggcgcccggcggttctgccagaataatcatattgcttagcgtgcacagtcactcgggagggctgatcgttggacgaggatcaatatcggtcggttatgaaccgtgggcggccgccgaactgatgccgttcgacggacgttcgacgctttctgtatcggcgttcatagactgccgcgccggccatctgatccacgctgcgccgtatgaaccgacggcggatctgtagtacgggttgatgcaagcaatcgacggcacggatgaccgggatgagcgtatgcgtgct

SEQ ID NO: 761 - DNA, 6475 bp, Homo sapiens
  misc_feature (1)...(6475): n = A,T,C or G
cgagagggtacgcgaccttccgcccgtggtgaagacttcttagatttgtgtgctctcaacagcaattattattttttatacacataagttttaaatcttcatgtagtcaaactaattttttactgcatgccttctgcctttagtgttaggcttaggaaggcattttctctcgattatctatttgccaatattttctcctagtgcttttatagttttggtttcttaatatttaatccatctgaaatttatgttggtgcaaaatatgaagactgttttcccctatgtttcaacattcattccaacataatttgtttaacaatccatcctttccccatgaattgatgaattactgattcttttttttttttttttttttttttgagatggaatctcgctctgtcgcccaggctggggtgcagtggcgcaattttggctcactgcaagttcggcctccagggttcatgccattctcctgcctcagcctccccagtagctgggactacaggcgcccaccaccacgcccggctaatttttagtatttttagtagatacggggtttcaccgtgttagccaggatggcctcgatctcctggcctcctgatctgcccgtctcggcctcccaaagtgctgggattacaggcgtgagccacagcacccggccccacctttttttttttggagatggagtcttgctcggttgcccaggctagagtgcagtggcgtgatcttggctcactgcaacctctgcctcccgagttcaaatgattctctcacctcagcctcctgaatagtagctgggattacaggcttgcgttaccatgccaggctaatttttgtatttttagcagaggttgggtttcaccatgttggccaagctggtctcaaattcctgacctcaggtgatctgcctgcctcggcctcccaaagtgttgggattacaggcatgagccactgcacccgaccagatccctttattatcatacactgagatttttcttttttgcttttattattattatttatttatttatttgagatggagtcttgctctcttgcccaggctgtagtgcagtggcacaatctcagctcactgcaacctccacaggttcaagcatttctccggcctcagcctactcagtagctgggattacaagcacctgccaccatgcccggctgagttttgtatttttcatagagacaggctttcaccactttggtcaggctggtctggaactcctgacctcaagtgatctgcccagcttggccttccaaagtgctgggattataggcatgagccaccataccaggcagcctttcattattattattattatttttgagactgagttgcactcttgttgcccagactggggtgcaatagtgcaatgacggcttactgcaaccttggcctcccgggttcaagagattctcctgcctcagcctccggagtagctgggattacaggcacccgccaccacgcctggctaattttttatatttttagtagagacagggtttcaccacgttgtccaggctggtcgtaaactcctgacctcaggtgatctactggccttggtctcccaaagtgctgggattacagacgtgagccaccacgcctggcctcattatttttaattgatataataattgttcataattatggggcataaggtaggattttgaaacatgtacttctatgagatcaacttttttagcttctatatatgagtgagagcacatggtatgtatctctctgtgcctggctgatttcacttcatacaatcagttattttgtattagtgcttctgttcttgttctttgtattcatcttccttgatctttcctgtaaggcctaatctagaaaacaaatacacttataattaccaacgaactattatatgattacagtttaggctaaggttgcttacaaggaattgtgaaagtggtggttaaaataggatcttaggtgtggtcacaccatcttgcgcttcttgcaatagaaggaagcagaagttcattttctttcacttactctctctctctctcttcacctccctgcttctattggcgaagcccaacttttgcacgtcttgggggttttttaaacacaggtggaaaagtacgcaagaaacagacgttgctactcgcaagggtcaaataaaatgagtgcctgaaacaagtcaaatcaaaatcagcttcctgaccgtacactctcacatcctctgttaaaataaatgcaagtcattctgggagctgaattagttcatactaaaagtagattagtgtggctttggtttaggatcaaggatttaacacctgattctattccgttggttgcctgtgtttttattgatttcactttttataccttctgcttctatcaagagtatttgtagccagaaagagtggttgcaacagtgactccttgaagtaaatagaatttatggcaactctctgtacccaaggagattcaaaagatgtgtggcatggcctgtggctgtactatggctaatgacttatgctatggcctgatgcacaaaggtgagggggcctatccgagtccctccctagggatctgggaaattggagaagctgaagcactggccgtgagtgctgaggctgagctgagctgaggctgagctgtcatgactcagggggcaggtgttcaacagttgtttgttgagtgagttagtgatgtacagatggcacagaaaggctatgacagctgcttctaacccgaagttttgaggaagctgaaactgtcagtaaggagaggcaactgtctggcggtgaggagtgagcaactcaacagagatgtgaaactacggcagaaatgtcatgaaacagccagaggagtcaggcagtcccctgaatgtcctgtctgtgacggtttctcagttcactgccttaaatcacacccactcgagctctgcactgggtgaggctcangagacaaagtggtaccagagaagggagaaccctgtgtttccaagtctagtccacaccacaggcacctttgcaaagagtgtccttgccccttttctagagggcccttgaagtgaaaagccaatagacaaaaatgttattttggaagacacggttacctatcccttagatgcctactgtatgggttgggtcatttattaattttagctgcaaaggagagactcataggatcactttttggggcagaagtatattgcgagcatatccaataaagtgggaggaatcaccttacatcaattctttagctataccatcactgggggctcagtacaggggctgcaaacccaatcattacagaagcccagcagaaaactcatgggtcaggcatgagaaaaaaatcaggctggcctctcttgttccttaatttttttattttttattttttgagacggagtctcaccctgtcgcccatgctgaatgcagtggtgcgatctcggctctctgcaacctctgcctcctgggttcaagcaattctcctgccctagccttccagttcttttattttttccatttttgatagaattatgataggtggcttggggccacaagtaatacaaataacagaaaacccaacacagtggcttaaacaatgttaagacttattatctcacttctccctgagtctcctgtgccatcccccaagtcagtctcatcctaagctggttcatctcatggttgtcaatagccatcaggagctattagagctgcaggtttcctaactcacatccagtttgggagcatgtgcctcgcccacagtcagccaataagtggccttgcctctagtctgactgggtcaacttacctcatttgtccactgctgggtcagtaaccgcaggcaccagggaaatttcgtgtcctgaaaggttagagtctgcgttcctgaactggtcaccatgaagaggcatgagactagtactggtgtgggctagttctatctgggaacaaggatgaagtcaggttctcctgagctacatgggaagctggtggggacaggggtgggttaaggaagacaaatatgtgaagagaatcaggattgtttggaaaaagaaagagtatggatgttggctaattagtcaatcatatccattacattttagtacggaatggagttgctggccgggcgtggtggctctagcctgtaatcccagcactttgggaagccaaggcaggcagatcacctgacttcaggagttcaacaccagcctggccaacatggtaaaaccccacctctataaaaaatataaaaattagctgggtatgatggcagatgcctgtaatcccagctacttggggggctgaggcgggagaagcacttgaacctgggaggtggaggtaatggtgagccgagatggcactatcgcactttagcctgggcaacagagcaagactccgtctcaaaaaaaaaaaaaaaaaaaaaaagaatggggttgctgatagaagttactgcaatgatggtgtgaaatagactatgctgtccaatacggtagccactagccacaaaccacttgcaatatggctagtgtaactgaggaacagaatttttcattttatttaattttaactagtttcaatagccacacatagctagtggctcctgcgctggactatgcagatatggagaattttctctatgataacaaaaataagacaatagtgagtggggagggtttaggaaagctagaaagtgtctgccatctaaagacagtggctgctgctgagtgtcagcagattgtggctacagggggaagcaaatgtgtttccattacctgttgctacataataaactgccccagaatttagtggcttaaaagaacaaccatgttatttgtttacaattctgctatctgggttgaggctcagctgtgtggttcttctgctggtcttcacatggctgcattcagtaggcaggtcatctggaatgctgagaatcccctctccacatagttgcagactcctcctcaacatatgatggaaggcaggtggacgtctaatatgatggctccggacaccccagtcatgaaagtggaaggtgtcagactttaagcctgtgcccagaccaggcccagagacacttttgatgtattctcttggtcaaaacaggtcacaggacaggccctgtggtgtgatctctgaggaatacataaaggcttgaatactatggggcatggttcaaagtgatgggatcatactaatgtaacaggtaatcacaagtccagcattgccagagctcacatttattttccccaaatagcaaggcatccaaatttatatgtgaaacctttcaaactgtaactattagttcactttcttttggtaccagctttatggagacatattcgcataccatataattcacttatataaactgtagaattcagtggttttttagtacattcacagagatgtgcaccaatcttcccctcccctcccccagtatcaggaaactgtactaatctgcattgtctgtatggatttgcctattgcctattctggccattgcatataaatgtgatcttgccagatgtgggcttggctcacttttttgtttttttaaacttagctttacttttcttaaatgaggcaatgcaatcggattagtttactatcattcaaaaatggcagagtgtattgagcactgtttggacactgggttatcacatgattcaaatcatttgcttagctttcattccatgttaaatgttaattttactctagactttgcctgagcgtcagacctatcagtcttacaaaaaatactcaaagattctgactcctctaccaactgcaaagtgaaagcatcactggactcataattgaatataaccctttcatatgagtcaggagtcgtatggctgtctattttaatctttattttgagacagatgctggtctctcacccaagctgaaatgaccatgacattggaccttagcataacatgaagagacactacgagaattacttgacaaggacatgatgatggcgacatacaaatacacgacaattgacgttgctcactacaacgacaacgacgatgaggcctgagacgactttagagaacgagcatgcggcgtaatcatcaactataatacagtagcgaggaacgtcacggatcggcatgactatagagcgatgacatctcgctctacgatctcagaatgtatgaagagatacacgaattgacgactgaacgattgatgtacagatcgagtgacataactgccgcaggtgataaactgcttaactggacgcaacactctattgatagcatgtgcgatccgtaagtatgagatgctgtttatgtaagaattcaacgaatcgaacgtcgctatgaccggatgggatcaatagttatggaaccgagcgtcacgacatgtatgtatatggaaacgacaagnaatgaaaggcagatcgtaagcgagtctcatgaagaaaggtgggtatgctagggtatgagacgtacaagactcc

SEQ ID NO: 762 - DNA, 7505 bp, Homo sapiens
  misc_feature (1)...(7505): n = A,T,C or G
gcctgcgcaaagtggatggagggttctcccaagctaacctcggactctaacaataaaggtggccagaatatttccgggcgggcgacaaaagactttatggcgcggattaatggggggggttttttcacaaattgatgcccagtttttgggtggtttgtaaaataacgaaaaccttggcctttttttatcgcggtaatttatttggttgctaagtttcagaattaagataaagggccaggtaatctttttcaagtttgataaattcaccgccgtaattctcatattgatatagaaatgtgatatctcttccataatttcattagaaaatgataaaaatcttatgtttttatcaaagccaatttcgcttgagttaatatcatcatgatctgtgaaccatcaacgtcttcaatgatcgacttttaagtaagtctggaaggtanagctatggagcttgctactacgcagtcagtattgatgcaaattcaaccgacaattcagcgttttgccagaatgcttgccagcgttttgcagcttgaggttgagatcgttgatgaaaacttgtgtcgcgttgccggaacgggcgcgtatgggaagtttcttggtcgccagttgagcggcaactcacgcctgctccgccacgtcctggaaacgaaaactgaaaaagttgtgacacagtctcgcttcgatcccctttgcgaaggttgcgatagtaaaaattactgctactaagtgcacctggaggtgggccggtcattcactgaatctgtaatcccagcactttgggaggccgaattgggtggatgacctgaggtcaggagttcaagaccagcctggccaacaaggtgaaaccctgtctctactaaaaatataagaattagccaggtgtggtggcgcacgcctgtaatttctgctacacaggaggctgaggcaggagaatcgcttgaaccagggaaatggaggttgcaatgagctaagatcgtgccactatactccagcctgggtgacagagagagacttggtctcaagaaaaaaaacaagtcgctctactccgatgccagactttcaggaagaagtttattttcacttctccattcttaaaagtggaaacctcccttgccttgcattcctcttttgtgtgagtcctgtgagggcgtctcctctctcctccagctgtgtgcaacctgtcaggaccccacacagagctcagcttgccggcaggagcctgtgacacgtgtaccaccccatcctctggaaacactcccttcacttggcttccaagacacctccttagcctgggaacctcaggtccttactccatcaacatccaggccctcaccgagcacccgcaggtgactccaaatgcatccttcccaaccccaatcactgcaatcagacgtgcagagccgcttttggacagctgtctggagaagtcctttaggcttgaaagaaggccttcgtgattgacttgaccgttccagaaaaggattaatataccaatacagtttttatttatttattttttgagacggagtctccctctgtcacctaggttggagtgcagtggcgcgatctgggttcactgcaatctccgcctcgcaggttcaagtgattttcctgcctcagcctcctgagtagctggggttacaggcatgcaccaccacgcccggctaattttttgtatttttaatagagacggggtttcaccatgttggccaggctggtcccaaactcctgacctccagcaatctgccctgacagcagctctgattaagcaacagggagatgctagggatgggtaaggggagttatgcaatggacctgcccaacttcaactcccaccatcaaagccctagaggtcaaggggctcatcctgcgtttctgggaaatgccgtgctacctgtcggcctcctcaactccctatgcgttctgtggctgaattttgatgtcactagagacacagcccggcacagagaccagaacacaggtttctgtgccgtcctcaccactgggaggctgtgaccaggcctagtccctgaacgtctgggggtgtctgctcatctcgtctcaagacacgtctctcacgatgcattggtttgggattcggtcaaacagagaaaaaacaaggtccctggcactgggctggcttcctctccatgcagccctttgacaacctgagcatgcttagctcatttggaaaccagcaaatgctgagttttcttgttactatccagctttccatcattcggctgctttttctttcaccctttacattctgtacttttcatttgcttaatagattctagtccaacaaatcactttgtaggcattatctcctttaaaaggccctatttccaaaagaagaacatgtgagaatgaacatttaaaaatagttactcaagtgacttcattgtttgagaatccccattaacatatgtggcccgtgttaataacagtgtgtatcactctgcggcacacagcagtttcacattattgcagcattccgctcctgcttaatgtgcttttttttccaggtgatgggattttgcaccaagtgaaataattggtaatattgaggatcatccattttttattacctagaattcagaagtgatcaggacgggcctggtgtgactctgagatgatgggctgttgggaagtgtgatgtgatgtggtactgtgcgctctccaatcctccgggaagcagcatctcggcccctgggggtggggggcacgaggccggccccagggaccctgtacttgtacagcccgtccgcaaattcaggcaggacatgcggtcgcagtctcaccctgggatcactgaccacaggcccagtgggtccctgtcagtcttaagaactttttctccccatctgcccatgacactgtggagaaatgaaaagctctgtcctgcccagcttccccgaaaagaaagtctggctgagcatcttcacatggagcgagaagacgtttgcttcatgaggccaagaaaagccagttacacacacaccgacgtcttcagggcaggcacatgtttcatgcttatttattcaatcaccgcttcatgctgtagggtgaacctgatcaactatctaaattcagaagaaaatgtaaaaagttgtctgataaaaaaacagtctttactctcacagaacacttctgatgcaggatgggaaagtggctctccttccccacgtcacacgatgctccggcggacactgagcatcctataatatcctggcatatgccctgccaccacccacctggaggcagcatcaggatcccagggctgagggctcaggcccacgaggctgcccgccccggcagatgccaggcgcaagtagtgggctgtcacctacgcttctgaccaactacagagcaggaactccctctccaggttcagctgatttgccagagcagctctgagctcgggaaacgctttactcacgcgtgcccgtttattatcaaggctgtgacaagggcacagaggaacggcagatggaggtgtgcagggtgaggtgtgtgggaaggggaccgggaagctcccatgcccgctgggtgtgccaccctcggggaacccccatgagttcagcaaccaggaagttctcagaaccccaggcctctggggttttatggaggcttcattacgtagtcatgactgatgacacaccactggccactggtgatcgactccaccttctacccccacccccccaacttcctggaggtgggggagggggagggctgaaagtccccccactccaatcaccagactggttccccgagcaagcaccccctctcctgaggctgtccaggagccaccacagatggcctcattagaacaaaagatgctcccatcacccaggaaattacaaaggccttagcagctctaggccaggagctggggtcaaggggtcaaagagcaaatatgaaaatgtgggcttctcctcgtgccctatctacaggggttgcaggagttctgtcccagggatttagggcccagaccacatctgtttcttatctcatcacaatatcacaggctggtaccctgatgactctgtcaaccctccaactgactttctggagagaatttccctcgtaacatcgagggtgcacctagctaggagcaggggctggcgggacagacggagcggatggatgtggttactcactcaccgttcacacagcccggggcatcaagggcacaacgcaccggaggaaggatccgagagctctcccgacgccacctgcctttccccttttgtgcaaaggccttatgaagaaaatctgtttgacaccatgggttatttttacatgtgatatatcctgaagacatgagttctgtctccggaaagtggtatccttcgtagcacaaggcttttcgaaacctgccccgttttttttaacctgggctcacaactccggcccctctgagatccagtgataccatgagtgtcatctgtattcactctatcctacttccactggttgaaatgtcttgtatttttctatagtttttctatactttctattacacaacgaacaacaacgtgagggttttttggtttgttttttgtcttctccaaatgctgaaactacccttccatgcagaggaggctgcagaatcaggagacgcgccggagcatccgagggctgtgcaggagcgcacttccccaccctcccctcagttcccgactcgggaagctctgcgccttctacacgacaggggaggaatccacacgccacaccagcagcgactgaggacaaaccacgcaaagaaccggctcatggatttcgcatttgagatgctttttataataaagttatgccaaaaatacagcaacaaatacagaaaaagtattaacaaacggagaagccccagatacacgtacagtaacaatacaaaaatgtgactggtcaaacagctcaagttcacatttaacactttcaattatttttaattacactatttctgttcaaaagaatgttttccttacatacaaccatgatcagtctttagtctcaatcgtaccaaaataaagctatatataagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtactttttgaagcagcagatgaaatgtgtttactaccagcctaaatcaaagaacatggcaagagcaagattgttctcaggaaggaaaccataaatatggcatttatgtaaaatccttgcagcatctgaccatgcttttatctttaaaaaaaaaaaaatcctcactttcttaaatataagtaacagtttattaattttttttttacagtgagatatggctatgggaagcaggtgatactatttgtttaagaaactgggatgccaactaacacgtggagttccccaagactttgcaatctccatttgtgagtttctgtaaaaaagggaacccagctagaggattcacagagaccttgaatgacaagcgacatactcgaaatctgcagctctcctcccggagggcccagcgtgccaggagacacgctgcagtaaggcacttaccaagctcctttggatagagggaaagaagaaatcaatccaggcaacatgcaagtttcagtgaagtcagacattttatgggaatttaaagtcttgcctgttctcagtgcaccccagtcagttactgacatgtcagcctcagaaaccgcacatggcctcaggaaggtcaggccctcctgctggtgggcacgccattggctcttgatcgctgatggtctcgatgatggtcatatttcacagaaataatgaggaaaagcaggagggtagctccttgaatagcagccagaagaaaaaagtaatagttcaaatagcagccgttaatattacctggagaaaacaaaaggaaagcggcaggtaagctgcgctgctacaggtattttttcaagactttactatttaatctggttcccactaaggtttaactggagtcataaaaaaagtaacaaatgttgtctctgtagtccaaaatgcacaagcatcttgctttcaaaaccactgaagaagctccctgaagtcagatacatcgccaccgggggctctggaggtgggctgtctgcagccccccacctgcccctagcagcccatccctctcttctgtaaggtaaaaggaggaggttccctgaggaaactagaaaaggtagctccccagtactcaggaaaatccctgcgtggcctgcagacacacatgcggtggtgaaggggacagtgtcgacggagagtgtgcctaaggccgcacgacaaggctgcaaatcaggagcaaggggaaacctgccaacccagcctcctgtgactgctaatccccccacaccagaacagctgggcaaagtaaaaaattaccttcctgtgttcttgccaccagaaacaagtgttagccggtctggtgttatttccttcctgccttttctgaggcagtgttcctctcctcaactacttcaggggaacttcctccatttatagttatgattggcctggaactgcattgttgaggaaggcagatgcgaagataacaaaagagcgcctgactatctctttatcgaatcctgaggtgagcgtctttgtaacttggctatggaacctgtgcactttttagcatcacagattgcactatgacacagcctgaacatcgtgaattctggattcactgcatgggtcactgacacacccaacacaccagggccgacagctgggcaatgtatcaaaggaagagatgagctggtttctgaatgtgtcttaaacatgttcaggttttagcatcctcaaactgacacaagcagatacctctgcatactttaatacaaagagttagcatacactgaatacccaaccgagtcccgggcactatggaggcactttacacgcaacgtctgcatcccaagcaggctggacagcacagaggataagatcatgggccatgcagctcaagctataaggcttgaatccggcctctgagacctctgtgctcagtttcctcatctgtaaaatggggaaagcgccgaggagcagcatttcagaaaggcactcaagagggagtctggacgcggtgagggtgctagcaacacgtgccacggtcatgatccccctttcacagaggtctggaactgtccactctgcaaactggcagtctctccgccagagaacagagttcagccagcaccggctaacatcaccactcaatgtgcagacgtgggaacgacgtgtgagcagaaaacggcaggacttttagctcgtcatgactggtcatgcaggccaagccgagtgtcgccctgtgctctccgccacggctgctcctgccaccatggcgtccctctgtctccgtaccatgtacatcacctgccaccagctggatagcagtcttcatattcggcggaagaacgcggtgtcaac

SEQ ID NO: 763 - DNA, 10104 bp, Homo sapiens
acaccatcctggctaacatggtgaaaccccgtctctattaaaaatgcaaaaaaattagctgggcgtggtggcaggtgcctgtagtcccagctactcgggaggctgaggcaggagaatggcatgaacccaggaggcagagcttgtagtgagcggagatcgcaccactgtactccaacctgggtgacaaagcaagactccatctcaaaaaaaaaaaaagaagctgaaaagagcatgggagatagattatgtgaagcagggaagcattcccgctaacagggaacacttagctgtgtttctcctgcttctggagaggatgggatctctgttcctctccccaggaataggatgatggcattacctactgtccaaagcaaaacacctttgagaatgggagtttaaaaaatatatcaaaacgacacatggtactccataaatacatacaattagtatctgtcagttaaaaataaataaataataacactataccttaagaatctataccttaagaaatatttttatggtgtgacaaattagttttattatattgatgggcctataaagtctattaaaaactgttttaaaaaacataatgtttgaaaaactattctaaaaaaatcatacctgtgtacattatggaaaagaatgttaaattctttatgttaactaaaatactttggcctggcatggtggctcacacctataatcccagcactttgggaggccgaggcgggtggatcacttgagatcaagagttcaagaccagcctggccaacatggtgaaaccccatctgtactgataatacaaaaattagccaggcatggtaaattgtgcctgtaatcccagctactcaggaggctgaagcaggagaatcacttgaatccaggaggcagaggttgcagtgagctgagatggtcccactgcactccagcctggatgacagagcaagactcagtctcaaaaaaaatatatttttagtattaatttaaaataacacaccaggcatggtggctcatgcctgtaatcccagcactttgggaggctgaggcaggcagatcacttgaggtcaggaattcgagaccagcctggtcaacatggtgaaactccatctgtactaaagatacaaaaattagctgagtttggtggcatatgcctgtaatcgcagctactcaggaggctgaggcaggagaatcacttgaacctgggagacagaggtttcagtgagccaagatcgcacccctgcacgccagcctgggcaacagaatgaggccctccctgtctttaaatactgagataatacaataacatcagctgactaattatgcttactgcacattcacactctctcattatttcctgagtcatgcgtcgctctaatactatacaagtgttatggttctagagactacattgtttcaatggaatctgcctaatataaagctcagaacaagaactgcctcataaaaattctttcactaacttttagactattgaatcactaataaatttttccgccccaatattttcacaggcaaaccttctttttggcctctattcagggaacctttctcggacaaatatttttacaatacaaaacctatcaaacaaattacctctatttaaggtttcttgatacattttaccaaatttagatccagcttctgaatggtaagctttctcatttatacttcattctgacacagaatagaaatttatctaattaaatataggaactctttcaaaagattcttcctccaggtcaggatatttcaaaacacaatcccatgatttcaaaatgagatctcgctgcagttttacactcttatcattcaatttgttttgttcctcccgtccttccacagggataaaattcaatgtttttttgctttgcagcttttttttttttttctcaaggattgttatttgctaaaagctccaaaaagctaaggtttgtgatgtgtcattgtctgaatactctgatgaaagatttccatctgattgtgagcagaatgcaattctaatctcaagcttttacaaaacagttctctatcattgtaggacacttaggtggatttacaaagtagctcttcaaagactcaaatacttctcaaacctgattgaatcatagcaccaaacagaaactgatcactgttttgacaatttttttgtatccacctcaactttattgaaacattttgcggcccacttattctgcgtgtatagaaatatatctaagctggccacagtggctcatgcttgtaatcccagcactttgggaggccaaggcaggaagatcacttgagcctaggagtttgtgatcagcctgggcaacatagtgaggcctcatctctattaataaagtaaaatattgttttaaaatatatatatatctttagaagagaaatatatcttttatggctagagctttctatttgttatctattattgtgtaacaaattactcccaaatttagcagcttaaaacaataggcattcattatatcacagtttctgtgggtcaggaatccagagagctcagctgggttctctggcttagcgtctctcataggtggcaatcgagatgttgttggctgagtctgccaccaggttcagtggcggggaggatccgctttcaagctcactcacagagctgttggtaggacacacagtctcgctggccggtgactgaagactccgactcctccatagggtattcacaacatggcggcttgctttccccagagcgagagattggaaagagataccccaagaagtagtgagagagcctgtgcaacatggaagccagagactgactgtaaccgacttcagaagtcatatcccatcacttttgctagatttgattattagaagcaagtcactccatccagcccataatcaagaggagtgaatggtacaagggtgtggacacggggagtgggagccattgcggtccaccttagaagtcggtctgtcacagcttttacttgctagaccattgcaactcgattggacacaattatgaaccgtgtatgcacctcaatcaaaccaactaagatctcctctgtaagggtttgtaacataattaatttcaaagaacaaacattgtatatagttaattgtgtaacaacatgatgttttgaaatatgtaaacattgtgaaatggaatcggagtcttcagtcactggcaaattgggcaattaacatatgcatgaccttgacttcacgtacttagcatttttgtggtgagaacacaaaatctctcagtagttttcaagaatataatacattgttaactctagtcacatgttgtacagcagatctcttgaacttattcctcctatcctcctatctaactgaaacattttattttttgagacagggtctctttctcacccaggctggggtaaagtggtgcaatcatggctcactgcaaccttgaactactgggctctgacaatcctcttgactcagcctcctgagtagctgggactacaggtgcacgctgccatgcccagctattttttttttttttttttgagacggagtcttgctctgtcgcccaggctggagtgcagtggtgcaatctcggctcactgcaagctccgcctcccaggttcacgccattctcctgcctcagcttcccgagtagctgggattacagtgcccagctactttttaaaaaaaatttttgtagagacgggggtctctccatgttgccaggctggtcttgaactcctgggctcaagcaattctcccacatcctgggatcacaggccactggcctaactgaagctgtatagaaatatatctaaggtgggcacagtggctcgtgcttttaatcgaagcaagcctgggcaacatggacagacccgcatgttgctgggactacaggcactcaccaccacacccggctaatttttttcagggatggagtttcaccatgttggccaggctggtcttgaactcctgacctcaagtgatctgcccgcctcagcctcccagagtgctgggatgacaggtgtgagcccccgtgctcggccttttttccctttttaaaaatcaggccaagactttgactgcaggtcctgggctgcttcaggccttaaagttcctgccagcgacttgcctctctccagcaccagaatgtttcggtccagcaaagcgatgttccctctccccagagcagtgggtgcattgtggctgcgttgttgtattttgttttcgtctagcctaaatattgactctctctagaagcagtagatgctagaacaaccttctttccaatcacttcagactaaggaagctcctggaaaagagagcaaatattttgttgaagtgcattgagtgaaaacagagagacagagagagaatgtgcttcatctggaggacttctttgtcagactggcaattcacagaggtaccaaagcctgggagatgaggctggacaaatttcaaatacgcatgaggggcttatacacctctgggaccagcctttaccattcaggtggctttgaataaattgggaagaaaattgaataatcagaggaaaagcctcagcaggcaaagttgctctcagagaagtgacaaagcaacatacacacaaaacctccagtgctgacagaggacgggctgcagcagggctgccagcattcgtgagtacctcattggtgcaagacttttacaggcaagagtgtgtttaactcttacgactatatgatgtggatattgtaacctctattgtttatacacaatgctaggggtcaggagtatccatttcaggaaaccaaagaagacatttgagcgcagataaatttgcataacctttattcattcaataaatatttgtccagctcttgtgatatgccaggcactgtggaaggtgcgggaaagaacacagtttccaattctgctttcatggagcttaaaatctagttggcggctgagggaggggagctggagagacaatgaaccaggaaagaggtaaaacgagacaatgtcacagagagattagtgctgcatgggagcctaaaaaggcgccacgatggtagtggaggagcgactcccttagatttggggaagcttcagaggagaggggaatgggagctgagaaatgtctagaacccacaaaacaggcccccatttgcccttccttgggggaagagtccaccaggcagatagaagaacaaagatcttctatcaggtctgtttgaaggatacaaagaaggccaatgtggtttagtgaggaaaggggatgtggtaagtgttgggaggacagaggcaaacttgtaatcccagcacttcaggaggctgaggtgagtatatggcttgagcccaggagttcatagaggctgaggtgagatgatggcttcagtttggcgggtggaagctgcagggagccataatcatgccactgcactccagcctgagtgacagagtgacaccttgtctcaaaaataaataaataaataaataaataaataaatagaattctgcaaggaagcgtactggccctatcacttttatgagatgaagctcagccccatggccacacctcattgcaagggagccagaacgtgccatctatttgtatgcatgtgtggcagatgaaagatggtggcaaatcttttgacacttccattgcaagggaactgtctcccttcaccttgggtctgggctggcctgtgtttgtgttgaccagtggggtacagtggaaggaaggcactgctttttctgagttcagcatgaacaggaaagacagcccctggcttgaccttgttggagccctaaacctccatagaataagcccaactgctctgtggttgccatgttgtaaggaagctgagggagtgggagatgctcggttagacccagcaggttctgcccccaccgtctaagccatctcagcggggccttgtttgaaggactgacctacagacacatgagatatgatcatattaaatggttgtctgaggccactgaagtttgggatgatttgttatgcagcaacaggtgactgagacaatgaggaaggagaagacactgacggtggcaagcatcaccagtgtccgttccatgtcacgtttcctccacctcggatggcacatgtgcaggaagcactgcgatggccgagtgcggcagctcactcctgcagttccagcactttgggaggccaaagtgggaggatcacctgagcccaggagttctgggcaacatagtcagagcccatctgtatacaaaatgtacaaattagccaggtgcgctggcatgcacctgtagtcccagctactcaggagactgaggtgggaggattattggagcccaggagtttgagaccagcctgggcaactaagtgagaaccccatctctacccaaaatttaaaaaatagctggatgcggtggtgcacacctgtagtctcccctactcaggagctgtggtaggaggatggcctgagcccggaggtcaaagctgcagtgagctatgatcacaccactgtactccagcctgggggtcagagcaagaccttgtctctgtttaaaaagaaacaaagacgaagaaaaagaaaaaaaatgcaacctctttgtccctgcactgaagctagctgcttttttttccctgatttttctccatagcacttaccaccttgcacatagcacataaggtgtgataggatttgttaatttagcgaccgtttcaccctactggtggatttgagagtgtggacttaggaaggtagtccatggccaagtgggcttcctacttccttccctcaaatggaattctctgacagaccctcgtcagagtagtacggctctgcagctcagacccatttacccaagcagccgcaggggagtcctccgcagagggcgcgtgaggagggcggggagagaacgggtgcttccttccttgctttctgtcccggagttagacatccttacattagaagcccaggaggaaactcgggaagaaggagaaaattgtctgtcttgcaaaagccgaactgtttgtattcgacaaattgaaaagaaatattagaaaaacaaacgaagagaggcatttctttcttttcacttcacgaatttattcttcctgggactccccatggcctggtctttctttcagtgatctggatgcatcctggacacacggctttgcttcagccctctctgtggctaagcaattttacaaccagtttacagctatccatcttagtttcttccaaagaaagctggtttgcaagcacagctgttagtggcagattccccatcttgagaagacaaccagagaaaagtagtggtttgatttagttgaggcagcgcggggcggtggggagagtctggggtgaggtggagacggagccatccctctcattctgagactggccgctgcatcccggggggcggcccgtgtcagcagaaccactgctctttaatgaattctgagccgagggacatgtctacaggtttgtaaacagattattgctgtggtgaagacagctttgatgatttcaatctggagacagaggtccacactcaaataagattgtacaccttggagcaggttaatcttttagtctgagacccacccgcaaactctaggctccctcctgagccctgctcagaatttcatgaaagaccttgcctctaacacaaagcaactcattctcttccctttccttcctccctccctcccccctgcctgcctctctccctcctttctcctttcctttcctttccctttctttccttttctttctgttctctttctcttttatccctctctcttcattccttctccctctcttcttccttctttccttccttcccctatttctttatctttcttttctttatttccttctctctatccattccctctctcttttctcttgctctctcttccctttgtttttctttccttcatcttttacctttttcttttgaactttcctttacctttattcctcccacccccaagctttcttttaaattaagtgtcatttcggtgctccaccccaccccactggaccttctggagcagtgcttgtctctgctcaccgcttctttcctctcccctcgtgccgtgcacacagtaggagctcaccacatagttgttaaaacaagatgttcaggcaggagccctcaggaaggtggggcaccttgagcacagtgtcccccttttctggctgaaggcttggggagcatggggggcttgggcatccctcagagggagatgttgtgagcttgcggttatttacaaaacccgtgtgttcccagcgccgtggaaagcacttggcgtgtcgtctcgtctcatcctcatagcagcccaatgggaaaagacttgttaatatcccctagttagggatagagaaactgaggcacaggtgggtgcagcagctttctgaaggtagcaaagctgatgagggggcagcccgggttttgaactgagccgtcagattccagagcagatttccttaggcactagagagagagagggattccacacccagccatcacctgtagaaggactcatcttctctgcttgtatttggagacagggtctcactatattgcccaggctggtcttgaaatcctgggctcaagtgatcctcccaccctggcctttctagtggctgggattacaagtacatgccaccgcacccagctctttctgtgtgtttttgtaaaatcaactttactgagatgtaatctacatataacccattttaagtgttccattccatgtagtgtgtgtggttccatgcctctcctgcgtggttatgcatggattagtgcatgtgtattcctgtcataaggcttgggcattattttctccacattaaggatggggaaactgaggttctgagaaggtgggtgacttgctcagggacatgcagctggtagcagggctagggtgcagacccaggttcatgtgaacctagatcccattcctgtctcctttgatcacctgctattcaccccatgggtgagggaactgccacccttgggtataaggatagcaaacgtgacacctggcacaagatggatgagataaacaatggtttgttggccacttgtactccccgcaggcgagagggcatcacatgccacatggggccacatggaggttgtcgttggaagcagactgtgccggcagggattgggggccagctctatagtgacaagaaggtgtgggtcccctggttcccacaggagggtgtcattgtttccgtaattccatgggggcagggaacggaacaaagcccagggctaagggacgggcaggcatcgtgcctggtgtccatggtaaggagggtggagtggctggggggcctgatctgtgggagcagagtgggaaagggggcttgcagttaggccatttcccccgcagtttccccggaggtcaaggcagcccataagccccggcctttcttttagagctcacagtgccctgtcttacggcagccacaacctctcacgctatgcacatggactgttgtacttctggaatgctcagccaagcccccttctccttgacacttccacccaataacagcgactctgctgagtttactccatgtcagggatcttctgtaaatcctgcaacagcagcatggaatgggtcccaccaggggcccactttacaggaggaagcactaagcctctgggagtctgagtggcctgtccggggacacacagcaaggggcgggtgacacttgcacgcatatgtattcactggttcacctgggccctgtctgccagccctgccccctcctccactgaaggtggcagcccacagagtggcatctgggcacatccagagccacagctctgctgccttcagagcctgaatcccaaacatctttgaaatggagttatttctgcccaaatcagattcttcaggttggttgtacactgaggatttgcaagatgaggttagctaaagtgagaaatgattgaaaccatcactcaagctttaaaccaccgcttgctgtggcatcggccacttgcttctcctggttgggggtttctttcgttcttcctcttgtttttttttttttgtgagatggtcttcaccacggggcgtcaaggatccgcgttatgcgttca

SEQ ID NO: 764 - DNA, 11934 bp, Homo sapiens
  misc_feature (1)...(11934): n = A,T,C or G
tgtggcggtcgcggtccttccgcccgtggtgaagacggaggatctcttgagcccaggactttgagaccaggttgggcaacacagtgagacctcatctctaccaaaatttaaaaatttgccctccgtggaggcgcacacctgtagtcctagcagagaaaggaggattccttgagcctacgagtttcggaggctgcagtgagctagggtcacaccagtgcactctagcttgggtaacagagtgagaccccacctcaaaaaaataaataaataaaatttaaaaaatacgctgagcgcagtggctcacgcctgtaatcccaacactttgggaggccgaggtgggtggatcacctaaggtcaggagttcgagaccagcctgaccagcctggctaaaaatacaaaaattagccgagcgtggtggcgggcacctgttctctcagctagtcgggaggctgaggcaggagaatcgcttgcacccgggaggcagaggtgcgatgagccgagatcgcgccactccactcctccagcctgagcgacagagcgagactctgtctccaaataaaaataaataaataaataaaaaataaatgaacgggacccttctatgttcaggccctgtaagttcagaccagaaggctaggaaagagcagttgtttgaggagctttccagacatggggattcgcaggtgcagggccctgggccaggaagctgagggaaggggaagcccccgttgttgccttagcttcctttacaaagaagtgggaaaacactcatattgcgtcttcgtggctttaaaggagttacgggctaggttgggtcggaaagctcagatgaaaatgagtttgaatcaagttagcatcaagctgctcccctgcaactgtaactgccaagaagtgagggaggaaccactgcagctcttcaggaggggcaaggacgtggccaccaagtattatatgcagaataggccgcctttaagagcaatagcaaagtcagatcgtttcagaaaatataaaaaaaagtgggaagtgaggtggaaggctggggccggatcatgtgaggagtgttaaagcgttggggatacagtcgagagctttactgggttccagcagggagtgatttgtgcagagcaggcactacagctggggtagcaggtcaggtctgcttcttattttctgaggattcacaagctaagaatggttcttaatattttctttctttcttttttttttttttttttgaggcggagtctcgctctgttgccaggttggagtgcagtggcgcgatctcagctcactgcaaccttcacctactgagttcaagcgattctcctgcctcggcctcctgagtagttgagactacacgtgcacgccactgtgcccagctaacttttgtatttctagtagagacggggtttcaccgtgttggccaggatggtcttgatctcttgaccttgtgatctgcctgcctcggcctcccaaagtgctggggttacaggcatgagccacggcgcccagctagttcttacatttttaagtggtcggaaacgggatcatttgtgaccagtgaaaattttatgaaaatcaaatttcaatctccataaataaagcgttattggaacatagccccacctgtttctgcaacacagccactacactggggctgctttcactaagcagtggcagaattgagtaactgtgatggagacgagatgtctcatagaactcaaaatgtgaactgcctgccccttcacagaagtgtgcggatgcttgtagagaatgggttgtgtaggaagtggtgacattagggacatgaggtgggagtctctcctaactagagtggaggcagtggaggtgggtgaagtggatggatggagttcagctatggaagtagaatgggcaggaagtactggcaggttgtctccctgtttgtgttcctatgtaggaatacctgaggctcagtcatctataatggaaagatgtttctttggtttagggttctgcaggctgtacaagaagcagggcgccagcatctgcactgctgagggccttgtgaatgggagccagctgtgtagagatcacatgcactaaaggaagtgagagaggggagggaggtgccaggcttgtaaacgacctctctcataggagagttcactcctgtgacagccccaagcctttcttcagggatccgtccccatgacccaaacactaggccccacgagaagcactggggatcacatttcttcatgaggtttggagggtcagatatggaaaccatggcatgtgagcagtaaggaaggcgactcttaagcttttgcctaagtatctgcgagtgcctgttttttaggaacatttactgagagcttactgtgcaccaggcacagtgcttgctaagtacctaagtacagtatctggttagtccacatgacacgtatgctacatgtctacatgtctacacgactacttagtctacatgacacgtacggtgcccattttactgatgaggaaactgaggcttgagaggtttaatcattggcccaaagttacacagcttgtatgtgactgagccaggattcaaaagcctgtcctttgaatgtgagctttcactctgcctgtgtaaggctatccgttacagtcaggagacaccttagaatgacgttagaaatgatagtttctaatgtactgaattggaactgggttttttgtacagtggcgtatgctttacatatgtgacgaaatctgaacctcacaggagtcttagatccactttactgatgaggaaacaggcacaaaaacagatcactttcttactgcctgtaggtagtgagtggtcaagctggacttctatcccagctctggttcttttttagctaccacactaagatgggcccagtgtgcgtgcgttccgtaatggttctgcagggctggatctcaaggcccaggctcttggccttggggtgccattggctcatgaaggaacggggctggtagcacagtcagcctctatcttttaaagacttggccaccccacacaggtgtactggaaagcttctattatgcctcttacttgtgcctttcccacgtgatcttatttaagcctcgccacagttgctggtgtgtgtgctgcagttaagcctgttgtccagggaacagaggcctagagggttagctcccaaggctgcacagcaggtgcctaggggagctggtttggggccctggcagcctgacttaaaagctggtgctctccaggatataacaggcgagtaattgatacttcttaaaatgaggaggaaatggtgctcggttatctcagatgaatctgacagaatatgcgctctttcatccataattaaatgtggatgttgaaaggagatgtgccttcttccgaaagatagctggcctgatctcttccgacgtaatgctgtcatgttaaaagaggaccttgtggatgaaaggctactcgggagacctggccgccccctgcagcgcgtgctgagtgattggatcccagctgctttcatggccgttcttcttggatgcttgggatagtttgtagaccgcctattagctaataatggaccaatgttgcctttcttaggtgtggtaatttcactgccgttaaaagaatgtccttatttccaggagattcatgatgaaattttgggggtgaaattggttgctggagcttatttgtatgtagatcacccagaagtatttttttttaagaccaagtcttattctcttgtccaggctggggtgcagcggtatgatctcagctcactgcaacctctgcctcctggttcaagctattttcctgcctcagcctcctgagtagctgggactacaggtgtgagccaccacgcctggctaatttttgtatttttaatagagacggggtttcaccatgttggccaggttggtctcgaactcctgacctcaggtgatccacctgcctcggcctcccaaagttctgggattacaggcgtgagccaccgcgctcggccagtattttttatgtatagaaaaaagtgctgaggctccaagtgaagggtagagaggtgtgcattttgcaattcaacttttctatacatttggaatttttttaaatgaaagataagaaaatgttcactgatgaatgtataaactaaatatagtatatccatacaatggcatatttttcagccattaaaaaagaaatgaagtactgatgagccttgaaaacattcggctgcatgaaggaagccagacacataaggccccagttgtgtgattccattgatgtggaatgcccggaagaggcgagtccacagagactggaagtagattaagggttgccacgggccaggagaggggcgtgggactgacttaaagggaacaggagttcctgttggtgtgatgagaatgtggacttggatggcagtgatggctgtacatctctgaatatactagacactactgaattgtacacttttgaagggtgaattttatggtatgtgaatcatagtgaaaaaacatttgaagggaaaagtacccttatgccagggtgcttgcccgtgaccaggtggcaggtccccctccaggtgcggctgcttcatggcaggaggcctggctggggaccctgaggtgtgcaggcctgaagtacactctgttgtgccccaggcgagggttaatttgtcctggtttggtccttttcatttagaggaaacctgtttgtatttttaaggtgctttttatggttctttgtcacttacctcttcatctcccaggtagagcctctgggaaacattctgataggagagacaatggggtgaggctgcatagctttgagaaggaggcctagttggcttctgaaagaggatgtgtgagctgtgagtccaagggagacgtatgttcgtgtaaatcatgtcaggccgtatcttcccccagtgtttcacctttttcaaaggtcacaatcgttcttggtggatggattatttgaaatagtgacctgaaagacgaaaatcttatgttacagatgaaaagagcaaatgatgcattttttttttttctagaggaaaaactgacaccccattttaaggaattcttctgtcagccaactgtttggtatgctgtacacaattctattcttttagcttttcttctccaaattgattttggtggtatcttttggccagtcatgtgaaaaccttgtttacccttggtagggcacgtagctgcagctcacacagtgatgtcatgcaaacgatgggcaggaggttgtggcctgctcgccaggggctgggaagcatgtgatgtcccttcacagcagccaggttcccttggtacagaaatgcctgctgtgtggttatttagggcttagtaattttggcttataaagtaattttgatggattactcttggagttggaataaattgaccaccacaattacacaggaaatgaggatgaatggcattttaaggttaggattttcccagagtaatcaaatgctgatattttcatgcttcatctgaagaggacataagtctgagactgtgggaagatatgtgcagtgtcactgtgggtaacgggaaggcccgagtgagaccgtgggaaggtgtgtgcagtgtcactgtgggtaatgggaaggtccgagtacatttcagttaggaaatcatttgtgcctctattaagtttatatactatgtttactggcctcttttatgcttgtcaaaaaattactttttgtttgttattttttcgcacttctagttttgttttctcagtaaccatttctctgctcacatttttcatttttcttcctggtccatgtctagtatagcatgagaattggtgtccactgttgagcaatatttaaatgcattgtgtcctagtgaagaagtgtcttagatgtctgtgaagttctcacctcaaactctttattcagtagagatgtctgcatttggtctaggacctctgttcagtattgtaatagataagagaaaagtttaaactcttgagaataagtgattttcttttaaatttagatttttcgtttgaagtggtgttactatatataattaattacctgccaccatagtggccatgcttaatcatttggacttcaaacaaatctctttttgaggagcacacaattttttttcttttgctctatttcctttagagaggaacacacaattttaactataaattttactcctctgatttaatctttaaaaaatagagtttaaaataccatatcaaatatatgactgctaaaaagatgcatgtgcttattacataccatatctttttttttcttttgagacagggcctctgtcgcttaggcaggagtgcagtggtgccatcacagctcactgccacctcctccccagttcaagggatcctcccacctcagtctcgcaggtagctgggactgtaggcgcacaccaccgcacctggctgatgtttgtaattttttgtagagatgggggtctgtctgtgttcccaggctgctctcaaactcctagacccaagcggtctgcctgccctggcttcccaaagtgctgggattccagacctgagccaccatgcccaaccgtaattggttgttttggccccattgagaatgtgttattcagtagagcagattgttctatggatccagaaactagatctattattagaataagaattttctaactctttcataacctgtgacttaagaatgagacagtagaagtttttaagacagcaagagagtctttttatgagatccagtatcagcctctcataagtttgttaaaaataaatttatgaaatgaaactcactagaaatgtctctgtctagtacagggttcatttgcacagtatcttatttagacgtaaaaatccaggtgggcagagaaggcttctggtgtgtctgcccccaaatgacctgttcccaccgcttgggctccattgaagtagcctcgtgaactccataagcctagatgttgcgttattacctcagtgcttttgtttgagtccaggaagtcagtgatttttgagccttttggaaatcccacccttatcagaatttctccgattccattgatagcctgtctaatctaaaaatagcatgtggttttatctttagtctataatttcctctttgcttcaagtttactgagatctctgattctcaggagaccagatacaattggtgtgggtggtgacttggcctcactgaacaaatgtctctctttggggcctaagcatatttgtggggtgcctcatggtacttgcatgtagctcagtaaggcatggagctttataacattggttctaaaacttacctgtgagtagaagtcacctgggaagttgcttgaaatgcagattcctgggcctgggccccagagaccgtgattcagtaggtctggagcgtgggtcctgtgactgtgtttgttttttgtttgtttgtttgtttgagatggagtttcactcttgtcaaccaggtacagtggcacagtctcggttcactgcaacctccatgtcctggattcaagcgattctcctgcctcagcctcccaagtagctgggattacaggtgcccaccaccatgcctggctaatttttgtatttttagtagagacggtgtttcaccatgttggccaggctggtctcgaactccatacctcaagtgatccacacgcctcagcctcccaaagtgctaggattataggcgtgagccaccatgcccagcggactctgtttttaaagagcattccaggtaattccaaggcaagtggttcaggtacttagaaaattctacagcagaatatacttggaaaaactctctagcatttgttggaatttagtgtaattaagtgaaacctacctagcaactgtagtaattaaaagcgtggggtgtgctttttgttgagatccgtgaatgtttctgtaaacacaattttgattgtgttgcgcttcttaaaggttgtgatgacaacggtaattttaaccacttgaccgtatatggttttcatccttgaagactgtcatatattttcaagtgtctttcctccctgttattttaggttaaagatcgaggtccggaagccactaggagattttttaattggttttattggagcattaacctgggagcgatcctgtcgttaggcggcattgcctatattcagcagaacgtcagctttgtcactggttatgcgatccccactgtctgcaggcggtcttgcttttgtggtcttcctctgtggcaagagcgttttcatcaccaagcctcctgagggcagtgctttcacagacatgttcaagatactgacgtattcctgctgttcccagaagcgaagtggagagcgccagagtaatgggtaagcacttagttctcatcttgggctgtttgaaaggtctttatcgatctctttattaacatcctagcttcggtttgttgtgtgcttattgtgtgctgggcctgggctgagtggtttacatgtcttctctcctttaacactgcatttccccaaggaggcgggtgcggtcttattatcccatcttaaagacaggccagtggcctgattccagagctcatgctttaaccccacgttgcactttctctcactgctagtgtagacggaagctcctttggtgccagattataaaggtagaaatttgtggaggacatcgaggagacagaagacatgctttatacatgtttctttttattttaaaaagctttgaaatacatttgaatgaaaaactaagcagttgcttatgctgtcagtacctgtctctgctctttaaaaagtaagccactgcctcttacataaaggtcagcatgggctccatcatacagcggtcaggtccatcatacggcggtcaggtccatcatacagcggtcaggtccatcatacggcggtcaggtccatcatacggcggtcaggtccatcatacggcggtcaggtctgtaactcttgacaggaaggtgcagtagcagaatggcgagatgcactgagggtaaccagatgatctcatgggacttacccagtgttagcaccaaagtcccatgaactgaggtgttaaaacagaaaggcctgtgtcctcagaacccctccaagtcactggccaactatgactcatgtttggtgatgttggatgccagttaataaagtccagaacttaagcccaagaagagagctcagaagtgtttgtgttactctttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgatcactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggcttcagtgagccatggttgcaccactacactgtagcctgggtgacaaagtgagaccctgtctcaaaaaaaaaaaaaaaaaatatagccccatcttagctgacactagtcttttgccagggccttatttgatcagacaaaagcagtgtttcggatcctagaggtctttttcaggaacaacccttaaagttttagtatccgtgtgggtggtagcccatagacatttctgcaagagaacagcattgttctgtggacatatttgggttttaaagcacaaatggcagtgtggagagggtttggagttacttttacttaggaagccgatttcctcttaggatagtctttgaaagtcttcttgggcaaaaataagggaaaaaaaagcaggggctagcttgcagaaaagttgatggtctgaggaattctcagattctgctgtttgtatgaactggctctgtaaccttgggcaggttactgatcttgcgaagcccagctttcctttttttacagcggagatggattcatctcatgggctcacggtggggcctgagcacagtgatgtgtgcaaggccctcagcaggatgccaggtacatgataagggccctgtcagtggtgaccactgtgacgagggtgccttaaaaaaggtgggcctccaggctgggcgtggtggctcaagcccgtaatcccagcactttgggaggccgaggcgggcggatcacgaggtcaggagatcgagaccatcctggcgaatacgtgaaaccccgtctactaaaaatacaaaaaattagccgggcgtggtggcgggtgcctgtagtgccagttacatggggggctgaggcaggagaatggcgtgaacccgggaggcggagcttgcagtgagccgcgatcacaccactgcactccagcctggaaggtagcgagactccgtctcaaaaacgaaaaaataaaataaaaaaaaaaagttgggcctccaaagcctgaggaagcatgacatacccaacatttttacagttgtgacacttaatttcatctggcccaatctcagtttcaatccaggttgatctgtgttttgaagataatatagtgcttgatattaaatgagaaatgaaggcgtatttgttcaactcatcagaccagagtagaaatggttctacagctttttgagatacatacttctttgggaatccgtgagaaccagtggactcttttcctggagaatacacacacctacatgcggccttcacagagactcaggcacaggcgtcctgaaactggagctcgtcaacttgtgtgggaggagcagagggctcttgtgggtgttcgggtgtcacttgtgaccgtggcttcgtgttggacccttgtatgttgcaaaatagtgcacctaacaatatgtgtaacccagtaaagcttcagatgcatgttgatttcacagcttttaaatattttaattacataaagcgaaagtaatataaccagtaacctgtgtgaatgattctttgtgtgaaaatgggtttatttgttatttaaatgtttttagtgaaaggtatttaatatgatgtggtaaaccactgatagtatctgcattaggtacaaaaggactttaatttcctttttgaaaaaaagtagtacttgaagaagttaatgttttcgagtgaaagtatttataatgtctttggaatttattttcacttttgggtgtttttgtttttgattattttcccccactagactaagtccgtaaggacaggagccctcccctttagcccccaggtagagcaatgcagggcctacagcaggtactcgatcagtatttgttgaatcgaacttagttttcttgtccaaaatttggctaaaatattcagttatagttttcagcgcttctatttttccccactctgaatgtccagacttaaaatgttgactttataagataaagcatttaaaatactggcaccatagtaaaatgggacatgagttaataaactagaaggctgacaggtgccatttctgttggcttcccacagttaaacacaatgtcttccccttcggatttggaaggatgccgcgtacagngagccgcgcca

SEQ ID NO: 765 - DNA, 11797 bp, Homo sapiens
  misc_feature (1)...(11797): n = A,T,C or G
cgtagctgtattgatagttggaaacgctcatgttgtaatgtgcacacatttgaggttcccataccagggttagttctgtggctcaaaatagaatatggggtccgaaatacatctgagtatctgagggggagtgtgccgtgttttcgccgaccaatttgggagccgtttcccaagtattttttgaaccccatgagttaaaccctccggtaagccagagtcaatgtccttgcgttccagtccgggcaccaaagtgagcttttgtttggctctaggaaaaaggccaaaaaaaaaattgtatatatatatatatatatatatacatatatatataaatttatagatatagatccataaaataaatatatttatattcctatataaatatatattatatataatatataaaaatatatattttttatggagtatttagtatgtgctaagcactttgataaatgctttggatgcagagatactgctgtatctgactcttgctctgtagtttgtgtgtatattttaaaaattgcaatcatattatacttttaatttcgtaacctattttacaatatgttagaaatagatggtctatatttcctctgtcattgaatgttcttttgcagcaagttatgaatggtcccgtcctatttccatttctcccctcagttttaaacaatatcatgatgaacagccttctgcataaacctttggagcccatttcctttaggattttccagaaataaccttgcaggatcaaagggtatatgcatttttaaagcttttcatacatattgccaagttataactagtcacatttatataactgtgtatattaaatattgctaagtaaaaccttaacagcttggagaagtggaagtttgcttttctgtttaaaattagtatttgctgagaaaataattatataaaatagctaagtagaatatgcaaataatggaaaatagcacattaacaacattaatacacattacggatatattgcaggtataacgcaatttttttttttttttttttttttgagacagagtctggctcttgttgcccaggctggagtacaatggtgagatcttggctcactgaacctccacctcccgggttcaagcagttctcctgtctcagcctctcgagtagctgggattataggcgcccaccaccatgccctgctaatttttgtatttttagtagagatgggatttcactatgttggcgaggctagtctcgaatcctgacctcaggtgacccaccacctaccttggcctcccaaaatgctgggattacaggtgtgagccaccacacccagcctgcaaatgttttaaagaacaatatcaactttcattccttaaggtatggaccaattattatatgaacctcaaagtaacacattatatttgtttctccctcttgggcatgtctgtaagatatttttggcatgcataccgatccatcgtttcaagtgtgtgtgaacagaactttacaggtatccttaacttagatggaatggaacctgttcccaggtagtgtgctttctggactctttcctatacaccctaaatggcacacaaggaaaaacttaacttgatgctggccaagagtgtgttaatcaagctcctcctctttctatttatttatttatttatttatttatttatatttttaatttttttttttgagacggagtctcactctgtcgcccaggctggagtgcgatggtgagatcttggctcaccgcaacctccgcctcccctggttcaagcaattctcctgcctcagcctcccgagtagctgggattagaggcatgcgccaccaccccagctaattttgtatttttagtagagacggggtttctccatgttggtcaggctggtcctcaactcccgacctcaggtgatctgcccacctcagcctcccagtgtgctgggattacaggcatgagccaccacgcccggctttttttttttttttttttttgagacagggtctctctctgtttcccaggccggagtgcagtggtgcaatcatggctggctgcagccttaacctcctgggatcaagcaatcttcccacatcagcctccagagtagctgggactacagacacacattacacccaattacttttttattttatattttgtagagtcacggtctcactatgttgcccaggctggttcaaattcctggcctcaagtgatactcccgcctcaccctcccaaaacactgggaatacaggcatgagccactgcacctggtcaggaatttagtagagatggggtttcaccacgttggccaggctggtctcgaactcctgacctcaagtgatccactcgcctcggcctccccaagtgctgggattagaggcgagagccaccacacccagccatgtgactattatttttgtgggaaagggctggattcctgacctagctctctgtgtttggtgaaggctggggtttggatttagtgagtcaaaagtgaggtgtaaatggtgcagatgcttttactggcccttacacacagcaggatcctgagcctggcaagaggatgccattcagggagaaagaagcctccaggtcctcactgttagcaaagcctaaggggtaaacagagggggctgtgaacttggaggagaaaaagagggagtggaaaaagccatgcatccacacggctctgcaggacttagggccaggcaggcccaacccagcatgaatgttcgaggccatgggagccagccctcctgtgacatagccacctctcagcatcagagaagtagatggctgctgtactgggctgactaataatagccccagccttcatgtccatccagaacctgtgacctcatttggacaaagtgtctttgcagatggaatcaagttaagatggggccacactggattcatgtggggcctaaatccaatgtgactggtgtccttggaggaagggaattgggacctccttaggggctgtcatcctgcctgctccagtggcacagaaaccaaactttgctgcctggcagccaaattccagggtgttgaagccacctgcgtgaagccctggcatgttgtcacaggagaagctcatcgtcaatcaacaatgccttcctcacaaagctggtaagaatgctaaaactgctccctccaggaccggcagtgctaatagcttataaaattaaacttctttcctacagatctagacatgaaattttattctttatattactgcacaaatttacttcatgggtacagatacggacatgaacaaaattaccaactttagagaactgaattaagaaaagagccctccccgctctgaagtcatccaaactccccgagcagagaaaacaagccccagcgggccaccttatttccttttcattttttggtctaggactttaatttttctacatcctgaacacaaaagtcgtatgttcctgaagtcagaaaaaccgcaatagcccatttatacccaccagaagttaaacctgtgctctgcgtgttaaggctgatgaaggagcacttcattacgccactcaaactggaatcccatctccgccgggcagaagctcttctggagagctgcttttcatgctcacactgcaatttcacatccatcagggaaatgggaaagaggcactcggagctgtcactcagggatgggccacaggatttggaccgagagtcctttctggaggggcatggccttctacacagaaacctacagtaggcgggaagacgccgtgagatgggacgagggagtgagtgtgcgtgggatgggcacaacttgcctcgtgagcaggtggacccttgagggctggtgcccaggaccactcctgcccagcaccaaccactgagccccacccctgggccctcgcacctccccatgcccaggccaggaaatcgtcccctccacataggtttcttggagggattatgaggttggtgggctggggaggggcgcccatttgtagatgcctgatcctgctcaggcactttgcagcatttgaccaccagtgtggatggtgaccaaagtgaaaacacctgctccaggagccagctgtgccccctctccaagctggagcagtctccctgggccaggaggactcgcctctggcgttttttgccagcagcctccgggatcccctgatgatgctgtcagcattcaatttggcggatttgtcacccactgagagcccctcatgtatttattttattttattattttttgagacggagtctcgctctgtcacccaggctggagtgcaggggcaaaatctcagttcactgcaacctccgcctcccggggtcaagcgattcttgtgcctcagcctccgaagtagctgggattacaggcacctgccaccacgcctggctaattttcatatttttagtggagacagggttttgtcatgttgtccaggctggtcttgaactcatggcctcaagtgatctgcccacctcggcctcccaaagtgctgggattacaggtgtgagccaccgtgcccagccaggagcccctcatttaaaatgacctgctggccagtgccaggagccctgccctaagcaagcgcctcacagggtccttcacccaaggcagcctcttaaagtgagttagtgttgggagcaggcattagatcatgagcttgttctccattaaaaaaacttactaaattgacacaaattgtatatattaatatttattgtgtaccacacattcggaaacgtatacatggtggaatggttacatcgagctaattaacgtgcattactgcacatattttacttgtgattaataacacttgagacctctcatcaatttcaagaacataataccttgctattaactatagctgtgttatgcaatagatctcttgaattttttccattttaattaactttgggttaggattcagaccagctttgctgtgggctgaataattaccacccccgcccccaacccaaggtgtcctgccctgatcccggaacctgtgattgtcacctcacatgacagagggcatctttcttgtgcgattatgttgatgctgtggagatgagcagattgtcctggactagccaggtgggccccaaggtcacaaggctcattatgagtgaaagacggaggcaggaggtcagaatcagaagatgggaggacaagatccaggtgggagtgacgtgctctggaggagggaggggccacaagctcaggggcttgagcgcctcaggggtttgggcgcctctggaagctggaagaggccgggaaataggttctccccctggaacctgcagggggaacacggctctgtcagcacgcttgattttagccagtgtgttaattcgttcgggctgctatgaccagaatattattgggacggcttcaacaacaggaatagattcttcagagtcctgggggctgcggcgtccaaggtcaaggcactggctgattggatggctggtgaggcccctcctgatttgcccactgcctgtttcatgctgtgtcctcacgtgaggcagagatcctctccttcctatcccttctcataagggcactaaccccatcacgagggtgccaccctccaggcctgattgcctcccaaagccccacctcctgataccatcaccctggtgactgggctgtcacataggaattttaccaggcacagtgtctggagtgaccagtgagtcccatttcagactctgacctccagaactgaagaataatacatctgtgctgttttaggccaccaggttttcgatacttcgttgaagcagcaataggaaatgaatggaggatattggtttgaatgtagtaaaacttccaggccgcactcacgtgcttcgtcatgtttttgaagctacagaagtaagtgatcatctcacagccctaaggtagttcagcattctctcctgggtcttttgaatttggggaaaccagggactggttccctaccccagctcccccgtaggcagcatggtgaagctatcctatgccccagggctgagatggggcatgaagttgaatggagtgccaaaaatcttggtagccaggataaaaaatatttaactcaatattttaaaaactcaaaattaatgcaaaaaactccatgatgaaaaaaaggctgcaacagtgaacacaggcaggactgtttctgccctttcagactcagccgcccccacctctcctgccaggccctgctgcacgtggtcactccgtttctcagcccttggacttgtctatttcagactgtaacatccctggcactcccccacgcgcagcacaatctctggctactctgaaatgtaaatgggtgacttatccaaagccacctaaatgagccagaatttacaacttcacttctatgtaagtcatttgtcttttctagagggaaggaatggacacagttcagggagcatcagagaagcttcagggtggatttatgctcagcatttaaaatctttaacccaaaccaagcccggtatacccaaaggacttcccgcttactgctctttagggctcagatatttcaaagacataaagcaaaccacacaggtcagcatttttctaatgttctggacaccatgctgagttcaaatcgactcattcacaatgaatcataataacatcggaagcaatgccaagagagtcagagaggccgggcacagaggctcacacctgtaatcccagcactttgggaggcttactctcatgaagacggaacgaaggggatgggactaaaccactcatgagaaatccacccccatgatccatccacctcccaccaggccccacctgcaacactgggggctacaatttcacatgatatttgggcgaggacacagatccaaacccatatcaggggcccacattggacgtagtttcatggtggacctgggcaggtgtttccagatgagatctgcgtccgtgaactgagttgagcaagtgcgctccccggagtggctgggcttcatccaatctgttgaaggtctgagtagagcgaaaaaggtggaggaggctgggtgcggtggctcacgcctgtaatcccagcacttgggaggcgaggagggtctgcggatcacttgaggtcaggagttcgagactgccctggccaaaatggcgaagccccgtgtctactaaaaatgaaaaattatctgggtatagtggtgtgtgcctgttatcccagctactcaggaggctgaggcaagagaattgcttgaacccaggaggcggagtttgcagtgagcggagatcctaccactgcactccaacctgggggacagagtaagaccctgttctcaagaaaaaaaggaggaggaaagaggaatttgcccccccttccccacccccctccattttccccactgcctcactgcttgagcgggcacatttcatgtcatcttctcagcaaccacccccaccattccccctcctccctcaaactgggatttacaccattgctcaggccttcagactggaactgaattacaccaccagctttcctggttctccgtatggcagacagcagatcagggttcttctcagccttcatgattacatgagccaatgcctcataataaatctccatttacgaatatgaatttcccattagttctgtttccttggagaaccctgactaatacaggtatctactggcatttggggaaaagcattttttctttaggcagggatgtcctatacgttgcaaggtgttaaaacttctgggcctagttgtgaaatattgacgacattccttaatcattctgacaacaaatttccttctccatccccaaatttccaaaagtcctctggagagcagttctgaatctggttcaaccactcataagctgtagagagactagaaaagagataatcacagagtcaggcaatttttacctgcaagattttaaaaaacagagtttttaaagttcttcgtagtttcttatattactgaattccttccttcctttcatccctgcctccctccccatccctccttccttcctttgttcctttctttcttcttacttttattacttcttttgtatcatcaagaatgagtgttgaatcctactgaatgttcttattccacccattgagagggtcatatgtatttctgttaccggaaaggggtcctatttcagaccccaagagaaggttcttggatctcacacaagaaagaattcagggcgagtccatacagtaaagggaaagcaagtttattaagaaagtaaaggaataaagaatggctattccatagacagagcagcccgagggctgctggttgcccatttttatggtgatttcttgatgatatgctaaacaaggggtggattattcatgcctcccctgtttagaccatatagggtaacttcctgacgttgccatggcattcctaaactgtcatggcgctagtgagagtgtagcagttgaggacaaccagaggtcactttcattgccatcttggttttggtgggttttggccggcttctttactgcaaactgttttatcagcaagatctttgtggcctgtatcttgtaccgacctcctatctcatcctgtcacttagaatgccttaacctcctgggaggcagcccagcgggtctcagcctcattttacccagcccctattcaagagggagttgctctgattcaaatgcctctgccatttcctcttttaatctattaatttagattgctatggcagaggtgacttactgcaaacctattctgccacttttctttagtaaccacgattgtatttaggtggcagtgtacccagttaatagaccgcatgtcttagcctccttggatgcaagaaatggccacgtggccaacacaataaaggcatagggctgtttgcatttttaggaagacactttaaaataaaatacaccatctggagtgcaccacttttgcctttccttccttcctgctgcctggaatgttgatgtgatgggtggagctgtagcagtcctactccttatcaattccttgataaggtgatcttgagactagaagctaaacactagcatgatggagtagacagaggaaagtctgggttcctggtgatggtacagccactatattaggcttgggccaccttcttctgaacttaatttacgtaaaaataaacttcaaattttttctaaacacaagaatacagatcgaggttatcaaggaattgaagtgagccttcaagcactgtgtgaaatggcacattcagatttcatcttaagcaggcagctgcttcccagcttcagtcagccacaggatggtggcttcatttaatcagatctctcattttttaacagatatcagaaattccaacttctatatgaaagctcccaattaaaaaatggtggcttggccaggtatagtggctcacgcctgtaattccagtactctgggaggctgaggtgagttgactgcttgagcccaggagctcaagaccagcctggacaacatagtgagaccccacttctacaaaaaatacaaaaaattagcccagcatggtggtgcacatctatggttccagctacttttttggaaggctgagatgggaggatcacttgaacccaggaggtggaagctggagtgatccataatcacaccacggcacccccagcctggatgacagagtgacactgtctcaaaacaaacaaaaaataatagctcagcttttatgaaaaacacggtgtagcctaaatacatctaaggatgatattgaggcccacaaggctgccagttcaactctccttagggaggtatctttttgggcttatgctgaagtcgccttttgtaaatcagaaatgtatctgttcacatttagcttttaatatcccatgggcaaggtgaaataggggaagatcatgggcaagtgcccccctctatttctgtataccacaccagacactgcgttttattgcctcttcttggtgtgtagcaaatatatcaggagtccactcaaaacttatttatttatttaacactgagtcttgctttactgcctaggctggagcgcagtggcatgatcgcggctcactgcaacctccgcctcctgggttcaaatgattctcatgcctcagcctcccaagtacctaggactacaggcttgtaccaccatgcccatctatttttctatttttggtagagacggggttttgccatgttggccagactggtcttgaactcctggcctcaagtgatccacccacctcggcctcccaaagtgctggaattataggagtcagccgccgtgcccggggtcaaaactctttttctaaaatgtcgttagaagggggttgtgacagctctgtgcaacttgtcccctttcctgtttgcttatgtaattctgttggaaagtattaagttgtttagcagaatgataatattttcagatcgcttttgtcctttaaaaaggatgtggcctgcctgcctggttcctgggaagctgaaataccaggaagaagagcaaaatcctgggtgtttttttgagagtgagaggaggacaggattttgattgttctacaatgatatacaactcttccctactccatgccacactgagaggcagagtggtggacgtacctgggagaagcctgcggagccgaatgtgccctccaggatggacttttatatcttgataagcctgggggtcaccatgctgcatagggaggccggagacctgccactgacggtggttatcccatgtcatggctttcttcattcccactttccctttttgaggctggaaggtatttaggggatgacagaaaatcaagtttgaaggtcaatggaaatattgggcacccactagaatgtcccacatctgtaaatacatgtgcatctttgtaaacacttaacagctgttttggggagtgcttgtttaaatccacagatggcattttgccagaggcctccttcagttccctatttctctcactcaaggtatcctagtttggagatccagaccaggtgcagcccatgtaccctgatgaaccccaggttcccctctccaacatctttctcacccgacaggtgcggccctgaaatgggtttctactgtctcctcacacagtccccgtcttcccctcctcgggttagttttaaggtagtctagcctgggaaggaatttgggactgatcatgccacgttccctggaatgggactagaaaggaatcntgggcttcatgcggaccaaggccccactcaggttgtcatggaaaatgaggctgagagcccctctctgcagcaccctgtgggacggaacccgaggtctctgctggtcctggtgggcacagacctgcagccaacccggtgttccgtgaagccctgatttcccaatgaagcccatggaagccatcactggtttccatgggagcggaccatggccacccctgctcctgttccctgtgggaaaggaccaaggccgcccctggtcctggtcactgtgggaagggactgtggtcaccgctggtcctggtccccttgggagggactgtggtcaccgctggtcctggtccccgtgagaatggtctgtggtcaccgctgcctgttccctgtggaagggaacgtggtcactgctggtcctagtcctcttgggagggactgtggtcaccgctggtcctggtccccgtgtgagggactgtggtcaccgatggtcctggtccccgtggaagggactgtggtcaccgctggtcctggtccaggtgggaacggaccgcggctaccctggtgatggaccctcacgtcttcatatatggcggaaggatccgcgctggcgtcatggattcg

SEQ ID NO: 766 - DNA, 1033 bp, Homo sapiens
  misc_feature (1)...(1033): n = A,T,C or G
gtaggaacaacctnttagagcacacccgtcggatccttccagccccgtggtgaagactgacactgggggtacagcctcccaccacacccctaccccaaggcacgtcaggtgcaaatccactgtgagcctggggggcagagccccacaccacacccctaccccgaggcacgtcaggtgcaaatccactgtgagcctggggggcacagcctcccaccacatccctaccccgaggcatgtcaggtgcaaatccactgtgagcctggggggcacagcctcccaccacacccctaccccgaggcacgtcaggtgcaaatccactgtcagcctggggggcacagccccacaccacacccctaccctgaggcacgtcaggtgcaaatccactcagtgggccccacccatccattctatgccagtaccgtggatggccaaaggtgcctcaccctcaagtgccagatttgggccctgcagctccagcacccacacccgtaaccccctgcccacgaggggccagcagccccgccagaagtcatgcacccccccaccccggggacagctgcccagctgcgtggggtgagtgcacaagtggctcccaccttgcggtggccccccaggcagcccagttctgcccatgcaggggaagggaagtggagcctgggctaagcccacatggtggaagggggcggattcacaggactgaggccggccgaaaggggctgagagtgacctttccaatcgggagacattttacacagtgtgaagctcaactcgaaatcttccaacttgttttaaaccctgggggctgccggtgccatgccagcccctgccccttatttcagcccaatacgttggattggaatgcaattgatatccccccccaaccgtgccggccaaatagaaggagggccccttggcacttgcattttgggaaaatggggtcccacaagggcagggcacgggggccccacagcccctcaatgcctnttggccccatccctttcagaaattggtttcccccaccacacccggaaat

SEQ ID NO: 767 - DNA, 1025 bp, Homo sapiens
  misc_feature (1)...(1025): n = A,T,C or G
atggcgcggctccttccagccccgtggtgaagacggcaatccggggtggcgtcatggaatgggtgtggtctaagccaggtctccagataagggcattctaggcagagggaacagcaagcacaaagtgaggaggccagcagcgcagagtgtgcaaagaagtgattggaagctgctggactctaaaagttgagactggtgtgaagagaggtgaggaggctgggtgggccgtgcagggagtcttgactgtcccgaaagttgggaagctcctaagaggtagaaagcagagttatggggtggtcaagttacataggtgggtcattggaggcagctttgaggacagattgagaagacaagtctggagcaggtgaatagttaggaagagatgtgtcgagcggcctggattatggtgatgaaatggacagagagaaggggggttaagaaacaattctgaagcaaattggtttgaggttcctttggggtcctccagagagtagtggctaggaatggagacatggaccacaaggaggacaggcaagcccatcccctgtcactctccagaggggccatgaggaaaggaagagccgtgggtgcagcctggtggggcatggccagagctgctcactgtgaccctcattcaaggatgccctgaaggagttgcggaagaaaggagagcctgccgagagggccagggcagcacaggaggaggactgaggagtcaggagcagggctgncagtancagtgaaggggctgcaggctgcaaggctgaaggagcaagagctangccccaatgcangtgcacttgaggcctaaccctgtctttggtgaccttccttcttacacttccccaaaccttgtacaactggaccatgtgctggctttccctctntttttttctccctttttggagaaaacggattttcactttgttgcccaagctggctttgaactcctgggtttaaagggaaccccggtgttaaccttcccaaatgttggatttccggtttaaccccccccattggctttc

SEQ ID NO: 768 - DNA, 973 bp, Homo sapiens
gaatagaaaaaccttgagccacccgtcgatccttccagccccgtggtgaagacaaagcgccccgccaagaatttcacacatcgctgcaagggcgtagcctttatgttcggcaaaggtcaacagcgaacccaacggcgactcctgcattaccgccggattggtcgtcggcacgccgttaacgtcaatcaggcaacctggcggcacggggacgcctttatgccaggcgacgcgggttttgccaaatgcaatggcgctggtggcgtaatcaagcaacagcgggaaattatctttacgagggaaaaccacacagaacggattggtgccaaagcggctgtcgcgaccgtggaacggcgcgaccattggaataccgaccacgctaacaaagtggatagagacaaaccccgccgctgcacactgctccgcccagtaaccgatacggccgatatgatgcgagttatgtagcgccacggcggcaataccgtgctgatgcgctttctcaatccccagcgccatcgcttcatgtgccgcgacctgaccaaatgcgcgatcgccatcgagcgtgaccgccgcccccgcctctttaacggttttggcatgatggttaatttgcaggtgcccctgactccaggagcgtacatagcttgggatcatgccaataccatgtgaatcatgccctgccaggtttgccgcgattaaatgatcggcaactaatttcgcttcttgttcctcgctacccatctgacgaaatacagcctgaataaaactgtgcaacgtctgagcattaaaacgatgaccactttttcatggttaactcccggttaattgtattgggttgggggaattttaatgctgcacgcccgggcgtggggaaggtcaataaagatgccggaaatttattatggccgggggggtaaaaacccggatgaaatgggttaattccggttgaaaaaagaattaaaatgcctgattaacg

SEQ ID NO: 769 - DNA, 1027 bp, Homo sapiens
  misc_feature (1)...(1027): n = A,T,C or G
gaaagtgttggggtgaannacttagcacagcgctgatacttccagccccgtggtgaagacgcaaccagccacaggttgtgattctggccgacggacaaatcacgcccttctctttgttgatggctaacgccgggaccggtgagccgctcctgacgttagtctgttcaggctcatggcccctggatcaaacgctcgccagagatacccgcccatgaacaaacaatcagggatgacactgcttgaagtcttactggcgatgagtattttcaccgctgttgctctgactttaatgagcagtatgcaagggcaacgaaatgccatcgagcgaatgcgtaacgagacgctggcattgtggatagcggataaccagcttcagtcacaagattcattcggcgaggaaaacacgtccagttctggcaaagagttaataaatggcgaagagtggaactggcgcagcgatatccactcaagcaaagacggcacgcttctggaacgcaccataacggtgacattacccagcggtcagacaacctcgcttacgcgttatcaaagcatcgataataaatccgggcaggcacaagatgattaatcgccagcagggtttcacattgctggaggtcatggcggcgctggcgattttctcaatgcttagcgtgctggcgtttatgattttttcgcaagcttccgagttgcatcaacgctcacagaaagaaatccagcagttcaatcagctacagcgcaccatcaccattcttgataacgatctnctgccactggtcgcccggaggaatcggagtaccgacaaaatcatggtggttggtgaagaagctatttttaccacgcaaagtcgcgatccgcttgcttcctctcagtgaagcacaaaccttactcactgttcactggtatctgcgaaaatatacgctttaacctgctggttggacttttggggattggaagaaggaacaacccgcccaagccaagcttggaccattttcaaactttctttctggaagagaaccacggggan

SEQ ID NO: 770 - DNA, 949 bp, Homo sapiens
  misc_feature (1)...(949): n = A,T,C or G
gccagccccgtggtgaagacaccatggctgtcaggacacccacagccacctctgaggggttgcccccgcgcacaggtgacaacagcaaggctgcctgagaccccatgcagcacaggaggaaggaaaccctaggaagagggcccttgggcaggcagctgctccaggaaccactgcccagaagtgagctccagccaccccaggtcaacagctcacggactctgggccaaaccaggtgagaggccaaaggcagagcccagggtggcagagctgagcccagggtggcagagaagagcccagggtggcagagaagagcccagggtggtagagcccagggtggcagagaagagcccaggggggcagagcccaggggtgcagagccgagcccagggtggcagagccaagcccagggtggcagagcttagggtggcagagaagagcccagggtggcagagcccagggtggcagagaagagcccagggtggcagagccgagcccagggtggcagagaagagcccaggatggtagagctgagcccagggctttagacagaccctcaggtgaaagggcagcctcaggggagctggggtgggggtgcaaagggcctggctgagcccctgctgtgacccagccaagtggccaattcctgcccatgaggctgggtccagggatcctggggtccactcctggcctgtggccgcgccgcccatgccgctcccttgccgcttcctgctctgccaccagcagaagctgtgggacagagacagtggggggccgtccccaccaggctgcgtcccctctggcctggccacactgggtcattcctggtttaattacacaccctataaaaagctgctgtggtttagtgagggagcctctacggtcttcaccacggggctggaaggagccgcgctagagtctcaatgntcaatnanaggctcgattgccgggc

SEQ ID NO: 771 - DNA, 971 bp, Homo sapiens
  misc_feature (1)...(971): n = A,T,C or G
atggcagcggctccttccagccccgtggtgaagacagtcgcctgtgtggagccctgcactgcaggggagggcgtggggaagacaggggtctgggtcagggagcctggcctgccgtacaggggcccccctcctgggctagaacgccagagacaggcactgcccagccaccaggagctgctcgctctggacgggagattgtgtttctgagggcaaggaagacgaagaggttccccacggccctcccttctcagccacccgcaccccagcacacaccaatgtctcggaatgatctcgaaggacgtggttagtcgccaggacatagggcctagaaattctgccacaagacgctcgcacctcccacccctcatggggcaaggggctcgccaggccctctcagagcgggagaaaagcacaggccaggtcctagggaagggggtggccgtgatccggggtgaaaatccctgtggagaggccgtcacagctggggtctggaaccagcacgtcctcctgggatggggagagggctctggcccacgcaccgcccatgtgcaaactctcagctcagggaaactcgcttgcccactcaacaggcttcctgagacggcaccgtggacagaaggcatgtggaccgagggcacagctcaggataaatacgccgcgtccctgccctccagttgacctggcagtgggtgaggtgtgttaatgtcagaaagaaatgagctccataaaggaaaacgagtagcaaaggaggaggcgtcgcttgagtgggtggcggggacggtccgggccactgcacttcccccgaatgaggagtggggcgagtgggcggaagggaggcccccagaaccactgaccacgcccacgcccacgccccagggcctgcaatggggccttgtttggaaatcgatgtcattgcagatgtactgtcttcaccacgggggtggaaggatcagcggtggtctattntctaa

SEQ ID NO: 772 - DNA, 1298 bp, Homo sapiens
tggcgcggctccttccagccccgtggtgaagaccgacttcggctccccacgggcccctccctgttaggacaggggggcctcccggcagccgcacccccgaactcctccctcaaactccgtgggtcagggcgcggccacctggaggtctcccggatggcaggtgtgggtgcctgtggtggggtcttcaccctcctcatccttcccagccccagggcccaggcttcactccccaccgcagggaggagtcgccggggagcagagctttggcccccgtaccccggggctcagcagagctggacagactgtgagtgcgcagcagtggggcgaggagggtgagagggaatgggggagggggaacggggaaggggaacagggggagggggaacggtgagggagaggaaacggggagaagagggaacgggggagggggaaccggggatgacgggaggggggaaagaacggggtaggggtgtgtggtggtgatacttgacatgagggtgattgaccgataatgctcttgattaggcatggctcactggtccgtatggctcttgagtgctgacgccctctacacaggcactgtctttcgttgtgtggtaggctgcggggaccaggttggcttcctcccacgtggtatacatccctttttggggctggcctgctggggaccggaagagccagtactgcaccctgagatgctgctcatgcttaacttggggccaagcgccagggacccatggcacccggtatgatgttgtacacctgcatgttccctatgagagaccctggattcattttttacaatggttccaagcacttcaggtttatcaaggttggtgctccaaatgattgtctcaattccattatattgaagtaggtttcgaccatgacattgggggccttcctttgagatcaatcgcctatccattgtagttacgtgcctccgcggctttggtacggggggggtttacataggcttcggttaattttctctcaaatatatcggctttgtgacactctctcatcaaaagacattgggattcattatttgttggctcaatgcccttacatgtgtggctcctcactatgcgtttcatgaccctctgtgtggggttcaaactgtttcatacccataaagggctatttggaggcttgttgtctctgtgctctcccacccctaggcccccatgaatgtgttttgataattgagatatatttattcccctttgtatggcacttttatctctctgattctagtaggggctctactctgccgtgttgtgtggggtattgtcttg

SEQ ID NO: 773 - DNA, 1637 bp, Homo sapiens
  misc_feature (1)...(1637): n = A,T,C or G
cgccatcgattcacataaaacgagtgacaactaccgttaacgatagaataagacagagccataaatatcgtactatagacaacagaaaacggcatatatgatccatatatcaatcgagatattgtgtggtattgccgtcaacaagatagcccatcggataagttaacagaaaaaggacgacggggtaaaagacgatgtttgtaaatccacaaagtgaggttaaaatacgtaatagctacgagagtgggagaaatctttcactcagcgccttcaaagaaagtgaccaacacttcccgaaccccacccatgagccttcggaataaagggaaggcaagtttactggaattcacaaagagcccggtgtgatcttatgtaagacaagctggtgcaaggaacccatttcagataaaagaatcagctgtgggaaaaagttttgggcaaaaggaggagcagggtcaaaagccctagggcaagggcggcatcagggttagaggttaagaaatggactgcaaaatcctgcacaacttccagtacagaggaggatgctgcaggttccccggcagagaaacaatgctggaggcctctgtgtgaggtgagatgcacagtgtggccagcagaacaagaactagatggggacaaacacagaggccgagatgcagggcaggggtggcacaaacccccacagatccaaccctacagacccaaccctgcagaccatcccctaaccatcccccacaactccatccccaacaggcccatcccccacagacccatcccatgcagacccaaccctacagaccccacaagtccatcccctaaaatccatcccccacaggcccatccccactgggaagggtgcaggaggacaggccacagctgctcctgagaagacaccaaaggcaggaaggaagcgtcggtgcatgcaagagaacattggaaaaaagccacagagtcgttttccagaactgcgagcgggtcagaggcatcggcgtcgatgccccacgacggctgcaacgaggcttctgcagatctgagttcacggaaaggaccatgaggagacactccctcaccccgagctgagcccacgccctcagcttctgcgggaaaatcattttcgagttctgcatgtgtccaggtggccacagctcagggctcggagagggctccgccctgcggttctgaaacccagcagccacgttaattgcctcttaacgcgcgctgcatgttgctgtatgaaaacaatcggcatccaggcactgtcctctgtccacaggttgagatttgattacttttttatctctaaattaaattccttctcgtgcttgtcttgttacatcaaatctctttaaatcttaatagactgcagctcctccctgcagctcaggcccctgataacagcgtctggtactcacggggccctgggcctcaaggcaggatgaggggaagggatcgcccaggatgcagctggatccggngacccggacgctgaggcanaagaaagagagtctgggacccagggaaggttcttgcttctcaaactggtgcagaccccgcaacaacccagcctcccaggacttaaaggggcccttccaggcaggaacagaccagacctggagaaacggtcgccaggttcttcc

SEQ ID NO: 774 - DNA, 1792 bp, Homo sapiens
gaagacatgttacagagggaaattcagagtggaaacagaacgccagacgctgcccaggatgagggtccagcgagagcaggtggctgcagccaaggtgacagcaaaagacccccaagatccgccacccgagcacgtgcgcccgtcaagctccaccatccgagcacgtgcgcccgtcaagctccaccatccgagcacgtgcgcccgtcaagctccaccatctgagcacgtgcacccagcagacgagacgcagccgagatgacagcaaataagcacaatccattcaccagaccccaaacaccgccactggaacacaggcgcccaacaggccagacgaaacgccgctcttgacgcctcatgggaccatctcccctcaccgggcccagccatcacactttctaacactgggggtggctgcaggtgatagagacctggaagaactgttgcctccacgagagaggcgtttgctctccttccctcgagagcagaggccgagggcccagggccaccatgacgagtccactcctccaagtctcccaggctctggggcccaggcatcctctatccggccacaccgttctccctggagaccctctgccaccccactctcccccgggaccttctgccacccactctccccggggaccctccaaccaccccactctcccccgggaccctccggccaccccgctctccccagggaccctccgccacccactctcccccgggaccctcggaccacgttgctcttcccagggttctggcacagcccacaggacatcgtgggaatgcctggactgcgccgcccctggagcccataacctgtcactctcatctcaactcctgtcagcgaatttcctctttgtgtgtgtgcgtaaaccactttgaggtgtgctctgtccctgtgattaaacacctggtggattatcaaagctgcgtgatgtcagggctgtgatgcctttgtagcaaggtgaagtcctcaagtttctgagttcagatcctccgcgtggaccctggagcgtgggggccacagggcccagaaagtgcctcagcgtcggacgaccgtggagccggcagacggcgcccagcagcaggtatcccgggggacctaccggctccagcctggtctacgaccctcactgaagatgctcttacctgtaggaaggtgccggggacccaaatgacaaacatcccactgacttgggctccaggaaccatgtgtggtgctgaggttcaggcggcgtatccgactggaccatcttcactgcgatggcagcagctaacctagactggcttaagtagaaaaggaaatatgttgatttatgtcagtgaaaagtccaaacgctggtgggctcatggagtgctggacacagatcctggtgtacctgggaggatgctcacctccccagccctgctctgctttcccagttccaattttcaaacaagctgcccccatggggcaagaaggcggcagaagttgcagccccaaccctcctggaagtggcttcagccccaggtcatcggtcaaaaacttgtgtttcgggaagaaggcaaggcttttgcccgcttaaaaacataacttgaaggcccctcaaaaaaccggcttgggaaagggaaaaggggctcaattctaagtgaccgtggaaaccccaaaaacttgtgagaatggcgtcctttctaatggcgcggggaaccggtccattctcagggttggcacggcccccttaatttaacaatgggagccccccctgttattaatttgttagccccggactttatagtccataaggctccg

SEQ ID NO: 775 - DNA, 1841 bp, Homo sapiens
ccccgtggtgaagactcccagccatctgagcaagcattaaggaggatttctgaaagcacatcctggtgtggctgcatccctgaccacgtccggctgtgctcgagtgcgcctgtcacacacagctttggaaggcacctatcacacatctcccatctgcttttcttctcagagtgcaggcgtgaatttgcagccagagaaaccaggagcacccgtgttcccatatgaggttcttcataagcagagaggggtgacggctgtgttagggcctggacaggggagggtcaggagtggggtcagctgaatagggggccttgggaccccttaaccaaaattctctccacacagccgtcctcctctttttcagtctgtggttacttagaattactttcacctcagccaggtgatgtggctcctcctgaaagcagaggcagcagccctgggcacggggaggctagccagaggctgcagggtggcccttgttgggtggacagggccttgcccacacccgtgccctcggccggctgtggatctccagccctgcccttctctccctggtgcctcctcctgcttttgtgacagcttgcgggggccttgaattgggacacgcctgtgagctggggctgcggcacctcctgcgtccccagctccagctcagctcacgtggtgcctggtactccgtgcagtgcagcttacagggtggttaacctggcccaggtaaggaggccccgaggccacagtcgccacagcggccaccaggggccatttgtgcctccccagagcccttttgtgccagggagcgtggggtccttggtttcagaagatgaacgccaggccatgttccaagccccatccgcacacccgagacaggcagcccgtgattgtcattgacgcagtacaagttccaagcataatttcagaagagtgcatggatgagagctgaggggcaagcccacctccggtcccggccctgccccgcccaccctgtcacctgccagagtgacactttctgtcagccactgcatttcccatcggcccatggctgtgccctcctgcctgccacaggcctgagacccccactcccagctagacggggttgggggaaaggccaaaacttggtgcaggcacaggagtgccaaggcctttgtgctaggtggccctgtgtgcagaggacggggctggggtcggcctggctggactgagcccaggtggggggcgggggcgggggtgggggcatggctcggggagctttgggcgagattggagctgggtctggaagggcggaggagcctgggaagtggggaggagcctggccaaccgtttctgcaggtgctggtgctgatactgccctgggaggcccctctaaggtgctgggaggcccgggatggagctggtgtctgtagcagttcttaggagcaagaaccttctctgggtcccaggactctgtctactctgcatcagcgtccgggaccccggatccagctggatccctggcgatccccttacctgatccttgccttgagggccaaggccccacgagtaccagacgcctgtattatgggcctgctcttgtttggaggacctgtagtctagtaagattcaaacaagattcgttggttcaggaacagcaccgagaaggaattgaaacttggttgcttaaaaaagtaataaaattttgaacctggtggacataagaaaagggccccgaatccccaattgttttcaatagacaaaacaggaacctcgcgcttaagagggaatgttatctaggctttcttgtgttgaacaaacctgatgtggggttccccctatccaagcccgttagaggagacaaaccctcaacg

SEQ ID NO: 776 - DNA, 1257 bp, Homo sapiens
ctacttgaccagccgtcgaaacttccagccccgtggtgaagactatctctctttgtgtctctccatctgtctttcctcactccccctgtagtgtccaggtgatcttgaccttggcatttggagtgtaattttccagataccccctttgctctggtgtcatgtgggtggctctggactcctccctccgggtgtctgccacagactggtcacctcttccggcctcaggtggggactcctgtgggcgtggggtggtggggaaccaccatgtgcaccctttgcgtattggtgtagcagaccttgcctgccacacagcgactcccctctacctcgcttcttaccaaaccttgcttctgttcagggcagccgtgtgcccagctggaaatgtcccttgcagttagatgtggccacgggacggattctggtctatggggatttaaagggacgtttctcctcagatgctctccctctccctgccccctgtccccctttcttcctgttggcaccttgatggctggggctgcgtcctgcaacatgaggaagagaccagcggcatcgtcttgcatagaactcagctgtgatggcctttaacccatgcaggggttccccgtggtcttcttgctgtgagtagagatcctcttggggactgtgacaaaacacacaagacgctggtaagattcaggctcagcagctctggaggggcctggggctatgcattccagagggcctcttgagtgatgcagacacagctggtcggggccacactctgaggagcaggtgttcagccgccattcaatcaggtttcagctacgcgcagccgggtgtgatcctgcccggggcggctatttcatcaggtttcagctacacgcagctgggtatggcccctgccccggggcgctgggctttgggtctcccacgtcagtgtgaattccatgcaggttttatttctcgaaatcggaggggtgtccctcactccttggggaggccccaggtctggggctctgtgcagagtcctggagcctttgccgctgccagacagagccaaccacagcatccgcatcccccaggctctcccctgtcctggccgtttcctaagcctcaggcaggcagagctggggggatgaagctctccagggtttgcttctctgagcctgggaacattaatgagagtgctggggtttgactcactcaacagtctttaaaaataatgtattttcgtatcacgtcttcaccgcggggctaaaaaggtgccgcgtcaat

SEQ ID NO: 777 - DNA, 1328 bp, Homo sapiens
gtgggttcagagaggtgggatattgggggggtttgggcccacccctgccctggcttaatgggcctttgtgtttggtccccaaaaaagttcttggttttgctggacacccttggggattccccccccacaaaagagccctcccggcattggtttctttgccgggggaacctgaagcagcctccttttgcattgaaaggtgggaaagatttggcaggtccaacccctaagcctccaaaccctaaatccggcccttgccccaaggcccttggccccggctcccccttttggccaaaattatttgcccaaagctgcttctttatcccaaatgtggtttcctccagcagctgtcctagcacagcacacacggggccattggaatccacagaaccttgccttccctctattccggaggcctgagggctgaggccgaggagtgctggctacgctcttggaggcgctgagcgagagtccccccactccaggcctctctgcctctgacgccgcctgtggctctgagcctgtggtgggacctccagcctcggctgctgcctaccatggcctccctctctgagctcacatctccctcccctctctctgagcccgcatctccctcccctctctctgagcccacatctccctctctctctgagcccgcatctccctcccctctctctgagcccgcatctccctcccctctctctgagcccgcatctccatcctctctttctgagatcacatctccctcccctctctgagcccccatctccctcccgtctctctgagcccgcatctccatcctctctttctgagctcacatctccctcccctctctctgagcctgcatctccctcccctctctgagcctgcatctccctcccctctctctgagcccgcatctccatcctctctttctgagctcacatctcgctcccctctctgagcccccatctccctcccctctctctgagcccgcatctccctcccctctctctgagctcgaatctccctcccctctctctgagcctgcatctccctcccctctcactgagcccgcatctcccttccctctctctgagcccgcatctctctcccctctctgagcccgcatctccctcccctctctgagcccgcatctccctcccctctctgagcccgcatctccctcccctctctctgagcccgcatctccctcccctctctctgagcccgcatctccctcccctctctctgagcccgcatctccctcccctctctctgagcccgcatctccctcccctctctctgaggtcttcaccacggggctggaaggagccgcgccagccgtgcaa

SEQ ID NO: 778 - DNA, 2282 bp, Homo sapiens
  misc_feature (1)...(2282): n = A,T,C or G
aagccttggccccgggcaaggaccagggctccctgggccccaagaggggcagggtcagagccttgttggtttaaagcaaccaccctctttctgaaggccaagcgtttaagaattcgaggccaaggcggcccggtgcccaagtttcaagcctggagcgcagccacgagctcagcgccaagagcttcctgcccatgccaagccccgcgctccatgcgcggccttgtcgggggcccccagcccgggttcccggagccaatcccttggttaaagaagggaaccccccggccccgggaccgccaacaccccgcagccgccacccacggaaagccccgcggcctgctcccgacacacgtgcctgcatccctgggcgccttcgcgggccacagccaggcggcagccaacggcctgcacggcctcaggtggggtccccgcgggggacggggcttgtgtggtctcaggatgggggctctgcaggggtcgggctggcaggcactgagccccgtgtcccgcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccggtaggtgtctcggccacaatctcgcccagggcaggggttggggggtgcggggacacggccaccggggaggggcgcacagcctggccctccacctgctgtggtctctgcggaccctgcgcgcctctctgagtggttcccccaggtgtgcctttccccaggagtctctgctgggccacgggccatctgtgtgcggggacaggcaggacacgtgcccatgcacgtacagacgcgtgttcacactgagacgggcgcacgggcctcccctcctggggccaggcctcccccgcagcctgctgggtcctgagccctgggaggagggggccgcacatcaagcaggcgccatcccagtggaaccccgaccgcgaaggcttcctccctcggcccccaggcgcttcctgaggctccgagtcagcccggcccaggctggggacggccccgtgtcccgggatgggaccaggatgctggcctgcgggtggctggaccctggctcccggggaggggctcaccgtgttctctcttgcctctagatgccagcctggcggtctcattcagccagccaatcatgtattgccagcctcattcgggaattctgattggtacttggtcacaggctcctctcttacctgcacccctgggcccgcacgtggcgagcggccaccccggcttggcctgccgaccccgggagtgccaggtgactatccgcctcgccccgccgggagcccgcggccaacgtgcctctctgtctctctctctttttctcttgtagatcacgagctgctcatgcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccggtgcgtaagcccgcgtgctggcaaggggcggggcgggcgtggggcggtgacacgcagcaggcacacacagacacacgctcgcacacacaccaccccaggaggaggtggggggcccggcggcacctctctgtcgtttgtccggtccccaacgtgccctctggtgtccccaccccaagctgtgccatgaggcccccaccctcggcagtgggcctggacctaaagcaggcaccccctgcccacctgcatgggacaccctcacgcctgcactagatccccagtgcccgggctgggggcccagacaggcctgagggcacaaggaccatgactcagggggccccccggggtcccccgccccggaaggcccggttttgaggaaggagttgctggggggcctggagntcccctccactcttttgagttttattccgaaactggcccctttggcagtaaccccgtgggggtccccaaggcgacacaacaatcaggggtttaacgccccaagccttaaccaggcccaaaaaactgcctggggggggcccaatttccccccccatgccagggggccctttaaaagagccgg

SEQ ID NO: 779 - DNA, 1274 bp, Homo sapiens
catgagcgcgctcggatccttccagccccgtggtgaagacggtctgggggtccaagaccctctagtgcccaggggtgcctggtcctcggaagcactatctgcccgtccacgatgtgggcggtgccccaggggagcccaggggtgcgtgctgggcccttcagggcagctgtgggcaatgagtgggcgctgcaggatcctgggaggtcaagggcttggcagctaccggggatggtccaggccccgtcttcagaacctgaggcccacaggtgaggaggcttcaggactgagagctgtgtgcccctccgcagagggtggggttacagcacaaggccaggaacagtgaggagggtcacggggttccctctcccctggctgagatggcacacaacctcctgctacccaggtcccctgcgggtgtggacggccccgtaaggcccgggtcccccacggtgtggacggccccgtaagaacctcctcgcagtgtggatggccccgtaagaacctccttgcggtaaggacggcctgtgaggctgctgtccacaccagggcctcctgccaaggactggaatgttctccttcgaggcttccacagtgtgctctccacacggtcccaccacctcccagggctgctcccaggctggaccccctgtccctcccacggtggccacacacagaccgcagggccccccatcctggcaggggctgctcacgccagcacccagatgacgacaggtacaagggagggaaaggggggtggttgtgggcagagagtttggcgaggttgtcatgcactccccccaaaatccacccacccgctgtgcccgccccacctgccaggggcagcggtaccttaggctgaaaagcgccctgcagggacccgaaggggccggggtgtgggagcagggtgggcagtcccgggatggcaggagggaaggacgggaagaactgtaagagaaggagagcggatggagggggggcccaagtcctcaccccaccctctgcctgtaaccagaaggtggcaccaatgcagcaggggcgaggccaggcgaggggcagccccacccaccgccccgtggccaggacctgcgtgcacagcgacacgcgccgggcccctcggggacactcacactcacgctggaatgtcggaagtaggggcttgtccacctggggcgcctaccttgtcaaaacttggaaggaaagaaaaggaggtgaaggccccgtacacacgaaaaccggtgcttgggccccgggccccgcccaacctggccggccgg

SEQ ID NO: 780 - DNA, 2448 bp, Homo sapiens
  misc_feature (1)...(2448): n = A,T,C or G
ctggagcgcccctttggcgcggctccttccgccccgtggtgaagactctggggtgtcagtggggcctggggtgtcagtggggtctggggtgtcagtggggtctgggatgtcagtgggggcctgggatgtcagtggggtctggggtgtcagtgggggcctggggtgtcagtggggtctggggtgtcagtggggcctggggtgtcagtggggtctggggtgtcagtggggtctggggtgtcagtggggcctggggtgtcagtggggcctgggatgtcagtggggtctggggtgtcagtggggcctgggatgtcagtgggatctgaggtgtcagtgggggtctgggggtgtcagtagggcctgggggtgtcagtggggtctggggtgtcagtggggcctgggatgtcagtggggtctggggtgtcagtgggggcctgggatgtcagtggggcctgggatgtcagtgggggcctggggtgtcagtggggcctgggatgtcagtggggcctgggatgtcagtgggggcctgggatgtcagtgggggcctggggatgtcagtgggggcctggggttgtcagtggggcctggggtgtcagtggggtctggggtgtcagtgggggcctgggatgtcagtggggcctgggatgtcagtggggcctggggtgtcagtggggcctgggatgtcagtggggcctgggatatcagtgggggcctggggtgtcagtgggggcctggggtgtcagtgggggcctggggttgtcagtggggcctggggtgtcagtggggtctggggtgtcagtgggggcctgtgggtgtcagtgggggtctgaggtgtcagtgggggtctggggtgtcagtgggggtctgggggtgccatgttaaccactgtaggctgtcctgcagagctgcctgggctgttttaggacgttgaggttccagaacagcaggaggttcccagaaggcaagctgggctccagcaccaggacctggggtttctggcccagagaccacagccctgtctgtgccgggcgctgagggtacggcaggtcgtcctggcggccttcttgccagtcctgtcaggtatcaggagcctaagaggctggtgaggggctgcctgcccacccttgctgactccggagggtaacccaactcctgccccgtcctggccctgctctccagagtgggctgtggtcggtggtccagcgccacagagcgctgctaccctctagtgggtacctggggtcctgcagctcagaaccgcgaccccagcccacgggagtctctgcgtccacgcacctggacctcctcctgcggtaggcgccccggaggcccctccagtgttcccacctcagctcccgggaagacctcagggtctacccccaccaaggcgcttcccccaagggccctccctgcagcccgggacccaccacaccctgttccagctgccgacccgtgctcggtgatttcaaaggacactggctgaggtttctacactatccctcaaccgggggctcctccagcgaccacagtggagtggagggtctggggcctccgtccaggctgcggtggtccatccctctgcaagccgctgtttctgggctccacgctctggcttcggaagtgggagcgagtgttgaaatccagccaccttcgggggaaggccagtagctggggtcccgccctgcaggcctgtcccggcgtacagagcaggtgacagcttccaggagaaggtgtgttctggggcttgaaggtgccggcgtgcagggaacagcaggtcacagagcccctggagacccaggcaggaggcagaccccacctaggcccgggtcgcacgcagggcagggcagaggctgtgggagccgggaggaggcccggggtctggggagccctgccccacaccaggaagctgtggagcaccccccaccaggcgtgggtgaggctctcccctcgtttcacggccgccatgcacaacccggggcccccgtgggtctggggccaggacccagtttccctgaggttgagtctctgtgatttctcctccagcagagagaagggcctgggccccggcacctgcacccctggcacagggacagttctgggaagggcgtggtgcccgtcctggtggctggaggacgggactgaccctctggccactaggggtctctcttgctccgctctgtgccagagccgtcgccaggaagccctgggatcccgaactggggcagaattcaagagcagggtgggcccccaagctcttaaggcagggttgcgggttccggccccgggcccctggcagaatcactcagccccagggggcccaaggattgcccccacaacacacctggcatgggccgggggtctttacacctggcatggggctttccccaaggcttggctcaaggttggtggggggcccaaggaatnttggatttcctggaggggcttccaggg

SEQ ID NO: 781 - DNA, 1489 bp, Homo sapiens
tagaaccaccgcggatcctttcgccccgccgtcgaagacatggtgaggcccacagagagctagacccacgcgacagctttgagaagtacaaagccctgcaccgccaccccagaggtgctccctgaactggtcacaggggcctggatcagcccttctagaccccccagggggtccaccctgcagccctgggaggacgacaggcccagggaggagtggcctgtactgcccgggggtgggaggaagcaggatgccttgggggtgacccaaggcccccctgcggaccgagggccaggccaggtccctctaaggctggggtgtggtgtggccgcctcctcccaggctcctcggtggacaagagttcggttcccatccctgcctccgcggctctagagctcgatcccacgctctaggtggtgagaaatcccaactcagtcattgctggggtttcctttctctacggcttgaatcacatcccccaaaaaggtcctttgccatcctcacccccgttcctccacacgtggcttcacggggacagagctgctgccgaagtaactggctccggagtggagcgtagaccagtgtgaccctgtcctgacatcaggatttggacagacgtgctcacagggaggatgctgggggaaggcgaaggtgttgaccagcctgggagcggcagacacgggccctggacgattctccctcagggcctcaaagcacccggccctgcagaggccccaccctcggctcccagctccaggtctgcaggattagtccgtgttaaggcggcttctgaggggctgtgatggcggccccgggacgcacgtggctgggctcctgtcgccctgagctggggaggggatagggtgagactctggggcgtccatcaaggagggtgaggggggcttggcagtgtctcccgcctccgtgctgtcctgggctcggtgtgcgggccccaaagcctcattttctgcactacacacgcatcctctctgggtgcctccccgagcccccatgtaccacccgccacgtgcacgcagctgagcatcccctctggttgacggttccttgcccatcctctcctctcaccctggtgtggatggtgagctccgggggttcaggggtcaccacggaggtggggtgtgggcgtccccttggtggccggggcttagtttggcgcctggcctcggcgcccgcgtctcccacacacgtggccggaccttgttcgtgacaccacacagatgtccgtggccttcccggctccgctccctgttttggccaatccgtgtgaagcaccagagcctcaggtgattccagcaaaagcaggtgtgtggcgggtacggaggccacccggcagccagatgtttttgcgtcacccacaggacgggggcaagttcttgggttccatcctgacccgggcaggtggagcaaggagctgggcccgtccttcttttttgggggcaacctgctgggacttggccacactcctgccagg

SEQ ID NO: 782 - DNA, 1458 bp, Homo sapiens
gttcgggattgcacccttagctccagaaggaattcggtctttggttgaaccaagtgcaagcttagctaagaaggtcttcctttctccggggaaccagtgctggccttaagcgaagtatgtcttctgtcttccggggaaccaggtcctgcctttagctaagtatgtttttctgtgaaccgggtccagctatagtgaagtatgtcttctgtcttctgtgtatcaggtgcagccttaggtgagtatctcttctgtcttctgtgtaccgggtgctgccttagctgagtaggtcttctgtcctctgtgtatcgggtgcagccttagctgagtatgtcttctgtctactgtatattgggtgctgccttagctgagtatgtcttctgtcttctctgtatcgggtgcagccttagctgagtatgtcttctgtcttctgtgtactgggtgctgccttagctgagtatgtcttctgtcttctgtgtatcgggtgctgccttagctgagtatgtcttctgtcttctgtgtaccgggtactgccttagctgagtatgtcttctttgttctgtgtaccaggtgctgccttagctaagtatgtcttctgtctgctgtgtaccaggtgctgtcttagctgagtatgtcttctgtcttctgtgtatcgggtgctgccttagctgagtatgtcttctgtcttctgtgtatcgggtgctgccttagctgagtatgtcttctgtcttctgtgtagcaggtgctgccttagctgagtatgtcttctgtcttctgtgtatcgggtgctgccttagctgagtatgtcttctgtcttctgtgtaccgggtgctgcctcagctgagtatgtcttctgtcttctgtgcaccaggtgcagccgtagctgagtacgtcttctgtctcctgtgtaccgggtgcagccttagctgagtatgtcttctgtcttctgtacaccaggtgcagccgtagctgagtacgtcttctgtgtcctttgtaccgggtgctgccttagctgagtatggcttctgtctgctgtgtgccaggtgcagtcttagttgcgtatgtcttctgtcttctgtgtatcgggtgcagctttagctcagtatgtcttctgtcttctgtgtatcgggtgctgccttagctgactatgtgttctgtcttctgtgtatcgggtggtgccttagctgagtatctcttctctcttctgtgtaccgggtgctgccttagctgagtatgtcttctgtcttctgtgtatcgggtgcagccttaactggaatctcttctggcttctgtgtaccaagtgctgccttaactgagtatgtcttctggcttctggggaccagggcctgccttagttgaaaatgccttctggcctctgcgtaatcgggtgcagccctaacctgaagatctcttgctggcttctgggcaccaggggctgcctcaactgaaaatgtcttctgc

SEQ ID NO: 783 - DNA, 1843 bp, Homo sapiens
gaagacagtgcatttggacgtgtgtgtgtggatgtgtgtgcgcgtgtgtgcatgtgaacgtgtgtgtgaacatggatgtgtgcatgtggacgtgtgcgtgtggtgtctgcatgtgtgtgtggacgtgtgtgatgcgtgtggatatgtatgcatgtgcattgcatcagtgcatttggacgtgtgtgtgtggacgtgtgtgatgcgtgtggatatgtatgcatgtgcattgccgcagtgcatttggacgtgtgtgtgtggatgtgtgtgcgcttgtgtgcctgtgggcgcgtgtgtgtgaacacgggtgtgagtgggtgtgcacgaatctgtgtgtgtgtgtatgaacatggagctcagtgcggggtctgcttcccctccagtcagagctgccctggcatctggctttgaccttaggatggggcatgacctcgggaggccgtccactctcccttcgtgccgtggaagccctggggactcagggctgcgtgagaggaaccgtgcggcagccggcaacagctcccaatgtgtgagtgaggccaggtgagacctccgcccagctgagcagctgatgaccgacacagaggtgacccggggagctcagcagaggggcctagacagcaactccctgcacctgaggctcacagaccctcggcaagcacaggtgttcacagtctcacagcagaagtgaggttcagacgctggaccccagcgcactcatctgccagagaagaggtcagggccccacagggcgaggggtccatgggggcgagaggcctggtgtggctgagggtcctgtggagcagagtgaggagacagctcctgccctcaccccaggctgagcaggaccacctggccggggggtgtggagctcctggtgctgggtgctgtccccaggacttgatgaggctgagtcgtgccccagaccagtctcatcccggccccagcacccaagaaggtgcctctgcgtggagaagggagctcgtgctggatggaggtcagacgtggccgccgtgctaatccccagagcctgcgcctgtgtcgggttaccgggcgggggagttaaggctgcagatggaaaaactgctaatcagctgaccttaaaacacaattacccggattatccgtgggcccagtgcaatcacaagggtcctcgaatggggaggaggaggcaggagacgaggccgggagacgctgcagggagtctctgcggccgccgaggctctgaagacggagggagggcctggcccggacgggccactcctggggctgacgaggcaggcggcgggtcctccccaggccccagcagaaccggccttgctcgccccacactgggcttccaacctccagagctgcgagatgataaatctgtgcggcgttgcggtcacttgctccggcagccacaggaagctctcacatggtgaggcgtcggtagaagggctccgttggcttccacgccccccacgtcgtagggctggaccgtccgtggaactcgctgggcgcgtgagtggcccgcagagcaactgggtggatgaccgggtgagtggctgggtgggcgcacggtcaggtgagtgcatggctgggtgggtggtcgggtgcgggagtgcatgggtgggtgggtggacgggcgagtgagtgggtgggtgggtgagtggacgggcgggtgagtggctgggtggatgagtggattgggtggacaggtgggtggatgggcgggtgagtggattgggtggacaggtgggtggatgggcgggtcagcgggtcggtgggtgagtggacaggtgggtggacgggcaggtgagtgggtgggtgggtggacgggcgggtgagtgggtgggtggtcttc

SEQ ID NO: 784 - DNA, 1630 bp, Homo sapiens
gaagacaatctgaaactttttgcgtactggcatgagctcggatgaaatgcatgaaatgcccattggaagagtttgcatttcagagtggattttcagatgagggatgcttaactgaataagtacaagtcaaatatctaaaatcaaaaaagattacaggtgcggtggctcacacctgtaatcccagccctttgggaggctgaggtgggaggattgcttgagcccaagagttcaagaccagcctgggcaacatagccaaaccctatctctacaaaaaataaatgactagccaggtgtggtggcacgtgcctgtagtcccagctacttgggaggctgaggtgggaggatcgttgaagcgatcaggtcaaggctgctgtcagctgtgattgcaccagtgcactccagcctgggcaacacagcaagaccctgtctgaaaaagaaagaaagaaagagaagaaggaaggaaggaaggagagagaaagagagaaagaaagagaagaaagaaggaaggaaagaaagaaggagagagaaagagagaaagaaagggaaagaaagaaagatggaaggaaggaagaagaaagagagaaagaaagaaagaaaagaaagaaggaaggaaggaaaggaaaaaaggaaggaaaggaaggaaggaaggaaggaaggaaggaaggaaggaaggaaggaaaggcaggcagaatccagggctcctctagacctcttggtggagaatctttattctaacaatacccgcagtggtttgctgcatgttgagtgttgagaagctctgttccatgaagtgggccctggggaagggagttccgtggggagggggtgtctctccaacagtccacaaaagagaaacagggaagaaacaccgaggggctcagaggtcagaggctcctcctccataccctctgcagcctgagagctgagtaagtgtgacggtggttgtgaatttctccaaatatattgtcttgttgatgtaaagttacccaaataaactctggaccctgcagcattcagtgcctgctgagatcccttcaaaaaggcataattcagggccggacgcggtggctcacgcctgtaatgccagcactttgggaggcggaggcagatggatcacaaggttgagaccagcctggccagcatggtggaacctaatgggttctaagaatacaatataattatgccccccgtggtggcaggggagcccttgtattccaagtttctttaggacgcttcatgcttggaaagattctttttaacccctttaaggcttaaggttgctttatatgtcaaaaaaccaccctatgccccttctttttctgtgctgtacaatataggagagacttttgtcctactgtgaaaataaaaacagtataggaccggggataagacacgcttgggctggttggttgatatcttcttgtgtcgcccgccgtcctttttaacatttgcaacctggtgaaaggggcggttgatcttcagccaccttgacactcgtgaccatttgtctccttctctttcgttcaaattccttttctgttctttctccaatgggaggatggctctcttagagccctctttttacctctaatccgtctgcgagagttcttttatactccccacttgaaat

SEQ ID NO: 785 - DNA, 2831 bp, Homo sapiens
  misc_feature (1)...(2831): n = A,T,C or G
cgggaagggggaaggtttccagttaacccgagtttcccgcccctgccatttttagccttgggtaccaaaagggaagattttattttcaaaaaaaaaaaaaagaaattgaaaaagcatgcttcaggggccccaagttggttcccaaaaatgctgaaaagttttctcaaggacttgaatttgggaatcagttttcaaagttaaatgttgttaaaatttatatgaaacttcaacattgtgcccctcacttgcactgccccacattcaaggtgccccacgtggccagccggctgtggaaggcagggccaggcttggttggagactggggatgcccatgccctcccatgggagcagaggggcccagagccagagggggtgtagccaaacaagaccccactgtcctggtgactgcgctgcctctgcctgtcctgcctctgacccgcactcaggctggcctgggccggcccctcctggtccctgcagtgtgctctggcactggggtggtttcactggccatgatgatgctggggtactctggcactacgtgggggcaggcgtgagggctgggcagaccctgtgtgcgccctctccctggaccgccggcctcttgcaggatctgccctcctctgtggagcaaccatgccccgagttccaaggacaaaaccaggagtgatgaggtctcccgactctgccgtggacggcccctcaccaggagcacctgatccctctgctgtgtgtccagaagttccacccagacatgcaagtataaagacatgcagcattctggccgggcacagtggctcacgcctgtaatcccagcactttgggaggccgaggtgggtggatcatgaggccaagagattgagaccatcctggccaacatggtgaaaccccgtctctacaaaaaatacaaaaaattagccgggtgtggtgacggtcgcctgtagtcccagctactcgggaggccgaggtaggagaatggcgtgaacccgggaggcggagcttgcagtgagccgagatcgcgccactgcactccagcctgggcgacagagcgagactccgtctcaaaaaaaaagaaagacatacagcattctgctctgagtcccgtcccaaagggcatttaggacaatgatttttcagagttgtgtgcggaggtgacgtgcgtcatcaggacagcgcagggacagcagaggtgcagggtcccacggggctgaggcaacagtccccctgtcctggcctcccaggaccctctcccgctcccgcagctcctagcctggtgggacctgcaccgagctgcccgcggggctcccgccttcctcagccttcccaggtgcacatcagttgtgagcactcacggtccccctgggtcactgctgaagaccgaagaacacagcagacactcaatcactgtggggagtgggggcggcagaggaccccagaggcaccccagtgacgtggggagctggtgcggcaccccgtgcccctgctctgctccccgtggcccagccggcacaccttgccgaggagagggccttgcggcacccgggcacccagcactgcccctgtggcctcgctgacctgcttacggtaaaagcccagtacccagaagaaggggcaggcggctcacgcgtgaggatcacacccgtgcacacgcgtgtgaacacacacagcctcatgcctggccttcagggcccgaccaggctggagtcgggttcacaagcgccctgccccagcccaggtggtctcacctttatcttctgctggtgacggtagatctgccaggcgatctgcacgtgcacgggacaccaccttcccggcttctgcgacaggatggaagcgctcagtggggctggtgccacccccacccatgttttctgcagactcctgctgtcacgggccccccgaggccgccccgggggcaccagagtcctcccttgccacgggccttcccaacacgtgctcaccttgaccaccgcccggtacgggtcagacacctgtggagacaggaaaggagtgtgaggtccgggcccctcaggaggctgagtcctgggggtgcaggggacacagcccgtctgctgtggccaccagcccgcacagggcccggccggggcaggccatcccccggggtggggacgggcgcccactaacacctaccccaggcgctttctgcaggagtgtgtgaaccgcaccagcccggcgggccacctcaatggggcttgaagtctgaggggagaaagagacagcttgtgtgcgcctggggccgcccaggcaggaggacgcctcgggcttcctggttctggcgtgggcctgtgccctgctttgccttgccgtggggccccgcacgctgtctcccagggacagcctgccctccctcgcaggaccaccacactttcggcccgccagtttctgcaaaggtgggaagcaggtgctcttgccagggaaggtgggcgaccctccccggggagccacttgccaccagggccgagacagccccacccagagggggagtggtgcacacctagtctccagcccaggaggagctgctgtgagcctggatgggccaaggggagatggtcgtttcccaccaggggcgccagggaaaggggggtcccacagcaaagaccggccatcacaccacagccccctcctccccagactggctctaccgccccttccctctgggctaccgccctgcccagaagcagctgtgctcggggtgcggccgggacagattccttccctcccagactcagggcctcagcgtcctggtcttcaccacggggntggaaggatcagcgatggtgcagatntncacgcccccaacacgtggcccc

SEQ ID NO: 786 - DNA, 3252 bp, Homo sapiens
tgggaccccggttggaaacttgagacctcagcgcgctccttccagccccgtggtgaagaccttccagctgctggggaagtagctggaaaccagaggacaagtcccactgcctcagatccctgtggggacagagtagatgggaagcaaaggtgtgcacgagaccacgccagacacacggatcgcacggagcgagatctggccgcatggagagccaggaggagcaggcggggaagggcctggcggtgggagagctccaagtgtctgcagcagagcaggtggtgcagccacggccggggcagcacagtgagaggccagaggggaagctgggccggtcccgcaggctctgcaggccctggctcgggctttcacctgcaagcaggaaggtgctgtgggtctaagcacatgaggtgttggtttcagctccagctgggcaggaggctgggccgtgggaggaggggacaggcaggggacagccaggaggttggggcggtgctgaaatctgtacccatttggctttgccatggcttcccacagagttgggtccggccgttcctgactttgtggaccgtgaaggggtgacactgtgggcttagtcccgcggccggctcttgaaaggcccaaggcctctgcctggttcttggagccactgcactgcaggggtggccactgcctgaggattctgaccccgggaccactgtgtgggggaccttggggagacccccaccaagccagggagtgcccagccagcaactgggccagtggtttcccacgtccggcccagtcaccctcataggacacagccctggccagcggcacaacacgagagaccccagtgaggaccccccagccaggccccctgagtccctgaccccagcactgtgaacaacgtagtggaggtgtcatttcaagctattggctgtgctgggacagaggaccctgatgcagagaccgggacggtggctggaccaccgtggcggctgggtgggtgggaggcgtttggcttcagcgtgtggtcttggcagaggtaggtgggatctgtccgtttctacctcctgccccccagggcttggttccaggttggtggcatgccacgggcggacttgggggcaccgctgagctacgggtcagcttggcctgagaaccccctgccctgcctctttgggcctgccgccagcaagggggtggggggctccatccgggaccccctggggtgttgggggctggcaggggtgggccaaggcagtagcactaggcagcaagggagcgtcagggccccgggctataatccctcagggggccattctgcgccctctggccttgacccccggagtgtggggcccttcccacactgggtgctgccggccatcagtctttttagaggcctctcctgctgtaggagcccactgtggggtggggaggaaggaccctatgctgcccccctccctctagggatgaggtctaaactccagagacctgaccgggccccctcccttcctctctcggcatgagctctccttcctcagggtctgctggatttgagtgggggtctcaggctgggggcactggctgcgtctgtggcctgttgtccagcagaaggctctgtccgggatcgggaagtggcaacgcgttcctcaaaccacagacagtcgtgtttccagagacggctgccgccgtgtccccacgtgctcctccaaacctcagaacccgggacctgcacccctccccacatctggagatggcccctgccctggctcgaagctgggtgggctgtggctcacctgtaaccaagaatccttctcactcgcgaggatggggtgggctgttactaagttccaggtggctcgttaggcagccgggagccgggacactcggatcccccgggcatgggggcctctctgggaggccaggacagagttgctgaccaggtttccagggctctggggccaggctgctagggcggtcctgcctgggaaggccacccacctgccccgagctggccttaatcattaggctggcctgacgtccttttagagaacagctcaagccgtgctgggagccagtcagcggcggtcatgagagcagccatttgcacttggcaaacttggagtggcgcaatgaatacgtcctctccttgaaaaggccagggcacctcactgagctctggccttgggtcaaatataacttaagctgcagaaaagggaaaacgatgggaagtgagtctattttcttctctggacactcctgcctggtccccagagacgccaccgtgaccaggttctcacatgtgacagccctgcagccccgtcctccagtggggtgggagccgtgccctccccagcctggctgtggccgtgactttgggagagggtcccgggtgtgtgtttgctacagtgagggcgaggggcccctgacttcctgggggaggggacatccttcaccagaggccaccacagccgaccttccgcactgtccttgcaggggcctggtggggagcctggacaaatggccgtgtcaccctctgcagcctgaggatggggcggcagctccgccggccccaggacacttgccaggaccccagggcacgggagacggagctggtggtgtggctcatccgagagggagctgctgcctcagggctatgggacgggacacccttggcagagggtggagaggtgcagggccaggagagcaccaggagtctgtacccgtagagctggggaagcactttgggcggggacagatcctgacgctgttctcaagcagaggcctaactgtcggggtggggaggggggtacacctgggactgtgctcctcccttgcggaggcgacacattagtttcgaggttacctggggaccctctacggagtgccgcatgtgttgccctcctcacccttgactccgctgtaggggagcctctaggtccattgtaaagaccctggaccatgccccgaagttgagggggggcaatacttgcgcccctcgggccttgattatcattggccatgggcctttggccggatgccctcccttctttccttacaagagttaggctcccctcttggctttggaatgggccccccattcccggctttccggggattttccaagcaagggtttatggccctgtggcgggaattttttatactccctagcattttggctaagggttacaagaaaccttgcttaccttcaccttttatggtggaaaggttcccctttttcctatatttgcgaaaaattcctaaggagcg

SEQ ID NO: 787 - DNA, 2879 bp, Homo sapiens
  misc_feature (1)...(2879): n = A,T,C or G
ggccaccttagaaaaattttccggggctcttacccaaattcggccacccaaaaaatccacccggaattttgcttttagaaaaaccgacttatgggatgcccaaggcccaaaggcccccatgtttttaaaccaccttaattggttgtggggattcccatcaccttatgtgaaaggggtttgctttaaaggtccaaatgaaaggtgcatccaatgttcttacaatggagagcccaacccgttagggaaaattagggcggctcaaccgnggttgggagctctgagaagggacagggctcaaggacctggtggctgggaaaggttccatcagcaggacaactgggcaacgcagtgcccatgtgtgtgcctgtgcctgtgtgtacgtgtgcctgtacacgtgggtatgtacgtgtgcatgcagctgacccttgaacaacatgggtttgaactgtgcgggccacttagacacagatttcctcccatccctgccacctgagacagcgagaccggcccctcctcctcctcagcccactccgtgtgaggacgaggatgaagacctttaggatgattcacttccacacagtgaatggcaaatatcttttctctatgattttgtgtgtgtgtgtgtgtgtgtgtgtgtgtgtgtgtgtgtgtgtgagacagggtcttgctctgttgcccaggctggagagcagtggtgcaatcacggctcactgcaaccttgacctcctgggctcaagcgaccctcctgcctcagcctcctgaggagctgggaccacgggcgtgcgccaccacgcctggtcatggtctgcctcataaggttttcttttctctagtggacttcattgtaagaatacagtccatcatacatgtaacacacaaaacaggtgttcagcaactgtttatgctatcgtaaggattcctgtcaacagtaggctaagtttcgggggagtcaaaagttatacctggattttcaactgtgtggtggggagtgtcccagcctctgtgtggttcaagggtcagctgtatgtggatgctcatgcttcacgtgtgcgtacacgcgtggatgtggatgtgtaactgtgtgtaactgtgtatgtgtagaaaggcgtgcaccgtgcaggctgagacaccatctttggaaaggtctgtgcacacagctggccctcagccagcctctaggcacccagactgtgtccatcccacactgtgggttgaacttcgagcccactttccttcctggggcctgtgccaggcagtggtgcctacagatcagcaccccagagtcttcgtgcctctgcgtgcctggaagatgacactcgggtgtggtcacgttgtgttgctgggggaggggtgacccgggggagggggtgactcgggggagtgggtgactgagggcacggaggccctcggtgctcccggcagatgccaccctgggccgtgctactgaggacagtacaggccaagtcctggaacccttcctaggaaaccaccgcatctgggcccgtcctgggaccccgggagcaaccatgcatgtgaggaaggggcactggggtgtgggcccagcctggcctcaggagcagcttcctactgctcagcgagaggtcgaactcctcctgggaaagcgggggctgggagacagaaaggggcatactcgcgtgggcctgggtacctgccattcctttgcctgtggtggggccagaacacggagcccagggaggacgggtggccagaacaagccgcctcagaggcgagagtcgtgggctgaaagccccccaggacacattgggcaggactgggtggggaggagcagcagccccaggcccaggtccaccctggggaggctggtggggaggacaggagaggacaggtgaggagaagacaggtgaggggtggggtgaggtgaggaagttgccaggctttgaacctgaataagtggtgagcatcaagaagcaaaggctggtgctgcggtccagagagcgctctcactcctggcacaggaaggcaggctcagctgggcacgagcgggaggtttctgtgccccccacctggcccgactccagtctcacctgtgctggggaagaggggccgggccaggtcctgtgggtagtggaagcctgcaaacacgcccggggcagggggtctgccgaacaggtccagctttgcacccacctccagcttgtgggggtccagctgcatctcctgggaggatagaacgggtgagggccgcctgcccggggactggccctgaacacagggagcccaggcctgaggggccacagggactgggtgtgagccagtccagaaaggggagcaggtgggatggatttcaagggtgtattctctactcaggatgacggaaatgttacacatgatcagcaaaaaagctgaacgggagagctcacgtcctctgaactgtggtacgtacttggcacatggcagctgggatgctacgctgtcatggaaaataacttactttttttgtatttagattcttttaaaagttaaggccaggcacggtggctcacgcctgtaatcccagcactttgggaggctgatacgggcggatcacctgaggtcaggagttcgagaccagcctggccaacatggcgaaaccccgtctttactaaaaatacaaaaattagctgggcgcagtggcgggcgcctgtaatcccagctgctcaggaggctgagacaggagaatcacttgaagccgggaggtggaggttacagtgagccgagatcacgccactgcactctagcctgggtgacagagcgagactctatctcaagaaaaaaaaaaagaaactgaaaaagcatgctcacgtgcccaagttgttcgtcttcaccacggggatggaaggttcagcgcgtggctctac

SEQ ID NO: 788 - DNA, 3341 bp, Homo sapiens
atggcgcggctccttctcagccccgcggtgaagacgggtcactgggggtcgctggggtcgctgggggtctctgggcgttgctggggtcactgggagtcgctgggggtctctgggcgttgctggggtcgctgggagtcgctgggcattgctgtttctcccaacgcctggtcggttttctctgctgtgaccggggagaatggagtaaagggcttgcgcgctgacacagcatcccctcctgtccttgtcaccccagaactcaggcaggaaacagagcaaccccgtgacgggagaacagggagtgggaaggtggggggctgtggggtcggaggtcatggctgctctgaggagggctgagacctcgatgagacctcacggccgtggccctgactcctggagtccactctgttgagccacgggacacggttctaggcatcctggggtggtgcccgagaggctcagctcctcctcctccctctgctgggagctggtggatgcggccaagtccagaaacatctctcgaccattgctcagcctgtccgctcccgcctttgccctgggtctgacaacttccctctgcgttcctaggatctcccgccgggggctgtgccggaggactgggcttgtggcctctttcccctccctcagttgcacaacctttgggcctgccgcctccggggcgtctgctaaaaatgatcgcttctgttgtgatggaatgtggaagcgcgttccatccaggcgtcgctgttatatctggtgttgaatttcaagtaaaataaaaattaaaattcccagtgctggttcatctgcgctcatgaacctcatccctgcctgccatgcggtgcgctgtgcattcacagaatggccgtgctaatggcgtcagagatgtaattatatttataattggacacataaatcagcttcttcttttgtggggctggatctaaatgtggtgtggtgcatgagctgtttacaggtatgtgtacaaggatacgcatgcaggcctgtgctcatatatgtaggcatgtgtgtgcgtgcacacgtgtgcatgcattgtgtgttgcatgagtgtgtgtgcgtggatatgcgtgagtgtgcatgtgtgcacctgttcagtgggtatttacaagcaaactcttctctaatcactccttgctgtattcctgggcagaccagggtgaacaaacaggatgtcctgccctcattcttcttggtcgcagatggtggaaattgagtgtgctgggcatccagggaaagtggacgccaccccccagggcctgccaccaggagcttgtgcagattctggtgtttgagatggaaagagtgcctggtagcagtgctggctggcggggcttggccctgggtgcccaggaaggcacctgccctcatggcacaactacaggctcgcccagtccccttccacggggcgattccctcctgctctcgcacctgtgaggctgtgtccagccaagcagagcagcagttgcttgagaaggggccgacactgctggttgcctaggcaacccctccctggctcaccaaggccagatttgttcaggctccgggcagcagccgtgtgcttagggaaggcggcccctccccagcccctgcgtgacgccccattggcctcagcccacggtggaattcagtcagccttaccatggttggagagacctgaaccagccaggccgccctgacggcgggaccctgggagggtctgaggggctgcagggagttgtcctcactctcacaaaggaacacgaggaagggctgggtcctggggctctgggatggtgacacaggagggggctgtggggtgggcagctgccatggagtccctatgaggaatgagctgcctcttatcctttcagttgcttttcagctgggttttctgttacagctgatagcatccggacgggtgcagggaccgagcattcatcggtgatttttacactcagcccagagccgagacttcttatctacagggcacatggccgcgtggcacctgggctagaaacccagagctaagggttattatctacagggcgcgtggctccgtggcacctgggccagaaacccagagctgaggcttcttatctacagggcgcgtggccacgtggcacctgggccagaaacccagggctgaggcttattatttacgtggtgcgtggctgcgtggcacccgagccagaaactgggaactgaggcttattatctaaagggagaatggccgtgtggtgcctgggtcggcttttcggtcaaggtgccatgggcctcagcaaacaaagccagagctctccttcctccctctccaggagtggctggcacaagacccatatctcagcctttgcaggcaatgctttgggcatccacaaagaatacggcaaacacggtggaatcccaggcactgccggaggctttctgggcccctccacagactcacttgcaaattcttccctcagtcctaacagctcctggcattagggtttggctatgccactgcctgtgagtgaccctggacaccaccttgtcctcagcctgtgagtgaccctggacaccgccttgtcctcagcctgtgagtgaccctggacaccgccttgtcctcagcctgtgagtgaccctggacaccgccttgtcctcagcctgtgagtgaccctggacactgccctcgcctccgcctgtgagtggccctggacactgccctcgcccccgcctgtgagtgaccctggacactgccctcgcccccgcctgtgagtgaccctggacactgccctcgcccccgcctgtgagtgaccctggacactgccctcgcccccgcctgtgagtgaccctggacactgccctcgcccccgcctgtgagtggccctggacactgccctcgtccccgcctgtgagtgaccctggacactgccctcgcccccgcctgtgagtgaccctggacactgccctcgtccctgcctgtgagtgatcctggacgccgcccctgtccctgcctgctgcggaagaaggtaggagggcctcacccctgccaacggtaccttctgagcctagttcctcactgaccactgtttttggaagtcctctttgcagaactggcctcaaaggctcaaggtcaaagcacccccatgagctgctttggaaaaagagatttcatctgacaacaagggaggcagctgagccaggaacttgtgatgtcactgggcttctgggccagcaggaggctgagaggcacacatgtagagaaatacaaaggttccctcttgtttaaattaagcaaattaagaggaagtggcctgaattccgcggatccttctatagtgtcacctaaatgtcgacggccaggc

SEQ ID NO: 789 - DNA, 3575 bp, Homo sapiens
gcgctggtacttccacccccgtggttaagacccctcaccgtgtttggtctcttccatgttcatgagcatttgatggcacgttgcatgtggacgtgtgaaggcagagccctgtccacataagggtgatgggcatgcccagcagccacatgaggctggcttcacaagcatggtggcctctgggccatggagcatcccagtagtctggctttctcagaaagcagaagtccaggctgcagtttctggctgtccgcatcctggctcaagccccccggacacgtgctcagtgtggcgcccagttctgggccctccacactgcccgccccaccgaccctgctcctcccccgcctccccttccctcctctggatacctggtggctgtccctcggtgctctgccatttgtcctgcgaggctgggccccctcagccccggggccagtgctgcctcctccatctccttggcaggtcttgatatcttgctggcagggggcaggatgattccttgttgctcttttctctcttccatataaactttcaatctgcctgttaggttccagctttcactggagttgggttaaaggggtacatcgacctaagagggattcgtacgtcatctccggtatcattttcctatccctgatcatggtgtatctcatttatttaggtattagtagaattactcatagatgctttatattttactaatattatgattggaatttgtaagttacattcttaagctgttgctagaaaacagaagtgcgtatctgttttgaagatttgtatgccatctcttgatgctgtaactagcaatcctgctaaattcttacgaatgcaaagacatttgtctgtcaattcctttaccttttctgtgtagaaagtcatatctaggagtggatggtttgcccccttgtgtaaactgtcggtacgtttctggagccactgttccagcgctttgttccagatgagtttcctgagtaagcctggcctttactttcctgtgctgcacctggcaggttttgtcacgagggctctttgccgtcttcagtgagttaaggcgctttccttttttctgctctctggaagagctcttgtgaggtctgatcctcactgccttcaaggcttggaggctcacagttcaggttccaagtactgatttttcttctccactgggtgtggtattcctcaagctgtttcttctggcatcggtttcagtaacgcgagtgtttccagtaagttgatttggggcaggctccgtagctgtcggtgtccatccgtcacgcctgaactccgcaggccctggcaattcttaatgttgcttggctgtgtcgtcttttttccttcattaatctcaccagaagtttgtccatttcaccagtattttattttaatttatttattttgagaggaagtcttgctgtgtcgccaggctggagtgcagtggtgcgatcttggctcactgcgacctccacctcccgggttcaagcgattctcctgcctcagcctcccaagtggctgggactacaggcaggcgccactacacctggctaatttttgtatttttagtagagacatggtttcaccatgttggccaggctggtctcaaactcctgacctcagatgatcctcctgcctcggcctcccaaagtgctgggattacaggcgtgagccactgcgcccggccaatttcaccagtatttttaaaggagcagctctgacctcgctgccttctctgtgtgtgtttccctgtgtgtcgctcacttttctggccctgtctagcttgatctggtggttgagaatattaattcctcagcctctcccagtgcgggcatttgaggcagtgtactctccatctcctcctgcacacgctttgacaagctgtgttttcgtagcatggggcaggctgtcttcctctctagtttagaagagtggcatcagctttcatgccacagctcagtggagaccagaagctctgaatacaacttgccgcgtcctacatgggaggcatgagcaccccatctttgaggtccctaagattagggctgggagggagtcggagtaacctaaagatgacgccctgctggtctttaccagaaacctgctctctggacccatgtggaggacggcccctgaccaacagcactgaatcccctgcagcagcccctcccagggcccgggcccgggccccacacggttgctctccaagggttgttggggggccagggctgatgttgacgtggtgctgtgggctgggcctgtgcccaggaatgccacaaggggctgccatgtgcagcctccaagacagaaccgtgtccatccaggcctgaggcccagcaccacattaagaagtgacgaccatctatcagctcccaggtgaaagctctgagataaaggcttcaggagtggtccgatcaaggtgcatgttacttggactttgtctctgcccaagttgcagcccctttgctccgagggttgcatcgcactcagcaggcacctccctccctgccccccttggggtcccaggatggctgccactgcggctccaagtcaaacctccgaattgtagggtagattccacctcttactctgactggacacgcttcacccctcagggcatgcgagagaatgggaggtgaaggttcacagaggaaattggggtgctccctgtgaacagagctgcagatgggaggccctggtgctctctcctggcttctgtcaaacctggctgccccccccaggtgccgcccatcctgcctccaacccatttggaccctcagcccatcctggcagcttcctgcccactggccccctgacaggtgggtgtctctgaattcagcccacgcagcctggctggttcctcagcagccttgtggcgggggaattaggtgggcgggaaggtggccccgagccccagggagccccttgggtcatgcaggcagtacccaccaggcccaaagcctctacagcagcccccactgggccaggtgggagcctcagcccacgcctcacagacctctgggtcccgcggttgcccccacagaccctttcagcagaccgagcacctttgggggcctgggcagcctgagcagccacgcctttgggggcgctgggcagccatgcactgggtgagtgacccagcctgtgcccccctcccccgatgcccgcgcccctcccccatgcctgtgtcctctgcaggaaccccgatgcctggctgacctccctcctctctgggctgggcctccttggggcacccccttctcagtgtcagcctgggaaccttctaaaacccctaccgggttctcctggggagtggctggggagcagacagacccaacctcatgctccccggcctctgcccccagctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacgtcttcaccacagggctggaagaagccgcgcaat

SEQ ID NO: 790 - DNA, 6438 bp, Homo sapiens
atagagcggctccttccactccgctggcaagactgatggtgatggtgatgctgatggtgatgatggtgatggtgatggtgatgatggtgatgatggtgatggtgatggtgatggtgatgatggcaatggtgatgatggtactgataatgatggtgatgctgatgatgatggtgatagtgctgttatttaatccagttcagattcctagttaggctcccctgtttctcctcaggcacactgtgggtcactggctggtatgtatgggtggtcagaatgcctgtgtccaatctgtgttgtactctttttctcaaagagaactcagctatgctttcacaaggagggggttgtgggaggaagagtctgccaggagagaaagctggatatgctggcaccaggaaagagcctcttagtttactgtccccaggcagcatccccatccacatctgagctcaccttctgggtgcttgcccagggggccttttgaatctcagcatctctggaacaagactaaggctgggagacatctggagtggagtttctgtccagcaatggcaagttccctgctgaagctgagaatggggaaggcatggctctcagggctgagcgcccttgtgctgggcggttcacccgtcagcaggaagggggagggcactttgctcttcatggtcagccttatgctgtggggatttcctgaagagcgcaccttagtattttgccacccagcttccagtcattctttgggttaatcaagaatgcattcagctgcaagtattagaaaacctagtaattaagcaacaaaggcttttgattctcttaatcagaagctccgagttacagtatttgaggctggttaaccagttcacccatgttttcaggggtttgctctgccatcctcagggtgttagatttttacctaactgttttggtgaggtataacacactaacagaaaaatgcacagctccttgaattctcacaaaatgttgtgtgttacatgttacaaatgtaacaatcaggaaatagaatattactagcagtgttggcttttgtttctcctacttgatgtcttattgacccaacaaggctgctgcagctccaggcatcatgtccacattccagcaccctgtgcagagaggcaagtaagcagtggtgtagcagccagagctcccacctggcttctcaaatctcattgaccagaagagtgtctcatggcattgcttgtggtgaagaaagctgggaaagtggaaatcaggcaaaggggatggatttactgtgactgtctcaacccaaatagaattcatcacaaggctgggggatggagtctatctttcttgagaccaagaggtttctgcctcttattggaacaaaactggggttctctgagcaggacagaggaggcgcgggtggctacgtggtgggcagtagcactgtgtaccatgccctgcctttggcaacagtttcccattttcctctgggaaacgctgctctcctgtgttccgcccatgaagttagggaggttcaactccatccttgggtccaggtgtgagtgtgtcccttaggcgttgccagtgggagcaccccgttcctctttgccccacgattggcccagtcttggggcatggcccaggacctcgatggcagtgagtggaataaagttccctccttccctcaggtcttggggcaggaggtgtaggcttgggtttttgtgtgctcgcatggaggatggtgggcaaagacacagagagacaaagaccggaggacaccggtagcctctggatgcatccatacttgaagctgacgctgctcatggacttcacagatgcacggttcattgcattccctcactgcgtaagctgagttttctgccacaggccacatcttactggaagaatgctgtctggaatgccactatcacctaccagagctgagggagccacagaagggggatgcgacccagttctccagctcctgggcctcgagccctgatcctccctccccaggctcctggcggcccctcactcagggctgaggccacgaactgcctgctcaggtcaggagaccagacttgaggggtctggcacccacagctgtcagaaaccaagctgtccttttctttgtttatacatcaaatatttcctgagctgccctgaactccagcatttatctcaggttatggagaacccacaggtgaacgagcttccagacacccgtgtctctgaatgtcccttttttgctgttgctgcaaatggcagacaccccacttttaacttcaactgactttggcaaaaaaaagggccacactggaaggatcctggaggttgtccaattggaggaaggctgaacaaagaactcctcaggaggtcaggtgtgggtgggcctcaggagcagctggaaggggggtgcaaacgtgcttcatgcggttaggacttgttttgttttttgtttgtttgttttgagatggagtctcgctctgtcaccagactggagtgcagtggtgcgatctcggctcactgcaacctccacctcctgggttcaagcaattctcctgcctcagcctcctgagtagctgggactacaggcacgtgccaccacgcctggctaatctttgtatttttagtagagacaaggtctcaccatgttggccaggctggtctcgaactcctgagatccaggtgatctcgcccgcctcggcctcccaaaatgctgggattccaggcatgagctgccgtgcctggcctatggttaggaatccgtagctgcttttgctgctgcgtccctctgtctctctgtcccgtgtctttccaggcacagcctcttcccaggcggcgtgaaatatggaaacgtgccctacagcaccccctgttggagagaggtgagctttcttccacaacctggttccaaagtcccagggaagggctctgattggcttaaacagcagtgttgttgagatacgtataattcacatacacgatttacccatttaaagtgtaagattcagaagtttttgggattattttttaagaattgtaaaatatatatggcataaaatgtgccattgtaaccgttgtgaacgtgcctggagtggccttaattccagtcacactgttgtgccgtcactgccaccatctgtttctgagtctttttcattgccccaaaaagaaaccctgtgactgttaaccaataactctccattccctcctccgcagcccctgctggcaatggataattttttggtttcatgcaccttttgggatgaactcatgtgaaaaatcactgttttggccaggtgcagtggtgcacgcctgtaatcccagcactttgggaggccgaggtgggcggatcacgaggtcaggaaatcgagaccatcctggctaacatggggaaaccccgtctctagtaaaaatacaaaaaattagctgggcgtggtggtgggtgcctgtagtcccagctacttgggaggctgaggcaggagaatggcgtcaacccgggaggcggagcttgcagtgaaccgagattgcgccactgcactccagcctgggtgacagagtgagactccgtctcaaaaaaaaaaaaaaaagaaaagaaaaaaagaaaaatcactgtgtttctctgacgttctaatttaattggttatcctgtcttttacccggcaactctgcctagcagggggtgggggccgtgagccacagcaccctccataacacagtctgctgctttgggcccagcttagggggctgaaaggtgaggcctgggtgagcacagggtccacacggtgggtccggcatggtggcaaggccagggagggcctgcctgggatagaggtgcgaaagggggagagacaggcggagaacgctgcacactcagcactcggctctttgctggagactgggttttctctggttggtttttgtgttcatgagtgtcgtgggcactgtatgcccccccgaccctccccactgctgggaacgctgggacgtcactgcatgtgtcctcagccgtgtcctccccaggactgccctccgctgcagagagcccccctgcacaaggttacacccctcccaaggtggtctcagcctggggcagtgctgacagcgtctcagcccagggcgtcctgtgggtcggccgggccggttgggtcagctgcactctacacaccctgccttcctcacctcctacatctgcctcctaagatcacgccctgataaacctgctcccagcccagctccttcgcagggcctgtctccaggagatccaagctaagacccgaagtacgtgggcggctttgggagttttgctttctgtggctcctccggccgctgcttccacggtgacgggcctgagatgggctggctgctgcctctggcctttcctcatgtccgccgctgtccgcgtctgctttttaaacatagataggatcatgctttgagtttataaagggacaaaaatgtcctgtgccttccaaaggttcagcagacacaaaagcctttgtgtgctgagcagtgcggaatagaactagaccacacaaaactggagaaatcgggctgggcgtggtggtggcacctgtggtcctagctactccgaaggctgaggccagaggacggcttgagcccaggaattccagactgcagtgagctaagatcgcacctgcactgcagcctgggggacagagcaagaccctgtctctgaaagaaaaaaaaaaaaaaaaaaggaatttcaagagaaatttgataaaacccatcacaggggaggcatcctgccctctccggacaggacaggtgcggtggccattggccattctttgcctacccagcatctgaacccatatcctgtgtagggaattctccacctcacgggcaggtgggacgcagaggcagtgtcttgctgttaaagccaaaagtgtgatgctcagtttcctgccccccaacccctgaggtcccaggggcctgtcccaggctcagctttcgggcaccaccactcctggacaatgagctgggagcggacggcatggagggtgcactgtggtggggtggacccagcagagtgcagccggggcctgaggccagcacagggctgaggtgctgctggcagcgttcatatttgcactcagccactaaccccaacagatcactccatccctcggcctcagtctcctcacctgtaaagggggaggatagcagcacctccctcgtggatgctgcaaagaccagatgagttaaagaagtgtggagaagagtgccagacacacagggaatgctacgtgtgtgtgggaaatgctcaatcaatactgacagcacacagaatgtttgaaggagcggaaaccggattcgatatatacctgtattcataaggctgagatttcaatacgtatctgcatctctctctacttaagatatgaagcttcacagccatctgtccacccacctgcccgcccagccacatcacccgcccatccactcacccgcccactcgctcacccatcacccacccacccgtgcacccacctgtccacctacccacccgtccattcacccacccacccactcacccacccacccgctcacccgcccgtccacccacctggtcacctacccacccgtcaactcacccacccacccgctcacctgcccgtccacccacccgtccacctacccacccgtccactcacccacccacgcggtcacccacccaggggctcagctgcctgtccacgtaggtgggcacctacccaaccgaccactcacgcaggggtcccctcacctgcccatacacccgcctgtctacctacccacccgtgcactggtcgacgcaaccgctgacacgccctggcactcacccacatagagggcctgggcggaaaggcgggatatcctctcatccgaggccgggggtaactggggcaatacatacaactggggagcggaattgaatcgggctgtatatacaggccaggtgggccagcgtttccactgatggctctgtagcgagggaacccggatagcccatggtagtaacggagggaacggggttgggacatggcgttttaagcgaccttttgagagggggaaatggggcctctttgaaatagtagggccaatttattggtcatagcgagttgaggtcagcgtctaaatatggagaatgtatgcttctcacaagggatggggagtacttgtggcatggggaggacatacccggtcggagacgcagtgtcgtgggtctggtggcccccacaaacgggtgtggatagcccagcgcaagtgtggggggtattgccccccttgggtatagaggcgaaggccgtcactggtggcgtgcactgagatcaaggaggcactaaggatatactggaatttttgtggggtctcacgggtgacggtggccactctcgtggtgtatgcaggcctataagagacccctgagctctagggggtggcggggtc

SEQ ID NO: 791 - DNA, 6542 bp, Homo sapiens
gaagacattgggggctgtctgacagcaccgtcggccttttatcagttgtgtttctgtggccagcatatcgctctgcctggttcaggacgtgctagggagcagtgctggatcttagggaggtggtgataaaatggatactccgcgggccatcccgttccctcctcccttcgagggctctgctgagaaggggagaaggagggttaatctcaagacccctcttggtgactgctgcctgctgcatggttaatagattggccaaaaatattgcttgtctggctgacggacagtatttgctgagcaaatactgctcctcttacatgaactcagctgagcagagaaggaaattaaatgctgtctgagagttggggcaggcgctgtctccccaggactggcatgggcaggaatgctagcaagttgccctgcaccagggccgagacccgcccagcgaggtgtgccccgtgcagcacttactttgggggaccctcatctgctggactttgactcccagaatcaccccatttccaacccctctcacttttccaggggcttgggagcccatggcctgggatcccccagtctcagaagctgagctttgggaaaaggggagatgcctactgcaggcccctgaagcagcaagtcctcttcaagttctcatccaaactctggggactgtagagagccttgggtcagggccggtggccagggaagtggccccagaacaggtgccgcatcgtgtcccgagtgcacagtcagagctggggcttcgtgtcccaagtgcacggacagagctggggctcctgtgggcccaggacggggtgggtggtggccaggctcatcacacaggctggccatcctctgtcctgcacattattagatggctccagggctggcacacgccattgctctgtgctgggacgggatggccctggggctgtcttctgccctctcagtggtgataatgacacagactgtacgtgtactgagcaatactgcaagccaggccctgcgctcggctcctgcactgcagctgagaccacgaggatgcccactttccagagctgtcgccacccacctgcacctcctgggtccctaaccgcggcttcctcactgctccgagcgggtcagcccttgtaccctgccgttctctgtctgctttatgtttggtgccattgtgtctttgcaaaaacgtcacctcagactcctctgaagtgggtgccccccacccccgtcgacgttgcccaccttctttttgtcatccccactctgcaaagctgttttagaatgtctttgctctccattttcgtctcccacaagaacttgtaagctgaaagagagcagacactgtgctgtcctgtgtgtctcctatggggtctggtgccgggaagagctcgatgtgtagaaagtgccccagatgcgtgtgtcaggaatctgagtgaggagatgaactgtactcaggagatccagggccaatcccaggcccacgtgttttgcccgcagcggctctgactggctgtccacctgctctggcagggtcacgtgcccccagcctgcaggcagtgggttcagtgggttttggtgacttcggcttagaccagctggcccctcaggtcatagtgagacaagtctgctgctgcgtggcgttaacacagccacagcaccccagggtggtttcatgtcccttcctctgcccttcggagcctgcctgggaaagtacggggcttctgcacaagtcataacctcgtgatcatcccatacgtgtctcttggttgtctacattttttgccaaagtatggtggtttttccccaaagttcagataattcataattatatcaatagtagtgactggttcagtaagcattctctccatcaggcagtgttctgagctgcctttcacagacatcaactcatttactcctcaaatgacccacgaggagggctggatgcccccattccacagatggggaccttgaggctccccattgaggcagagcaagagcaaggagcactgggtgccacgcctgtccggccttagagtgagcgggcgctgccctgcgaggccacccacacgggacaccgagggagatgtggccaccaggacccagcccagaggcacagcctgcccttggctctgccgcctttgctcacagtccctctgcccccacccgcgtcttgagggctcttcctactctgggatgctggaggatgggacgctcaggagttggaggaagcccttgtaaccccagaggctggcttgtgcccgcgggacactgcagtggtataaacaaccaaacacaggtgtagacttgccggggaggtgcagcctgcctgcaggagtcctgttacctcaccccagaccccacacacactgggaccaactctcggccccagccctggcccctggggcagacccccactcgcagccccttctgaccccaggcagaccaccctctccgcctgtctgaacaggcaccccttgccctgtgcccggggcaggtctctgtacctgttttgtgcccccggcaggtccctgccccttttctgtgccctggatgggacacacaggctgttctgtgcccggggcaggcccccgccccctttgtgtaccctgggtgggacacataggccgttctgtgcccggggcaggcccccagcatctgcacatttatatgtgctcctgtaggggaggaggagtccccgcttgtcctgggcctgtgtgtgctgtgaacacagcaggcactccctaaatggtggtggtggtggttgtgggctgaggagggccagggtctggcctggctcagggtgtgcctgcagccctggagacagcattaatgattaactgcccatagagatgggagccctgtggcagggctgaggacctgcagaggggcgtgctgggctgggtgtgctggggtgggtggggcggcgcggcagacttgagccagcccccgcttgactttctactctgtaaccaggggccgtggtatgtggggacaggaggcctgaggaagccccgctgggcctctcccctgttcttgttctgaccgggaactctgggtgcttgggaacgtggctcttgctgtcccttttgtttcctgtgacaactctgtcccctggttgtactgaccagaggacactggaagccccctacccctggagcagtgctgtgcccatacgtgcctggtcagtgctgctgttctctgcctggggtcctcccaagaagactggggtctgagaggtgtatccagggctgtgtcagaccccatcttcccacatagcaaaggccatccttatctggcctcaggccacagaacaggttgtgccggtccctgtgtctcctgggagataggccaggcctgcttagcccagtgggctgcaccgcccactcccacatgctggccgctcggccccagtgacgctggccatggtgctctgggctgcgcctgggccacagggaggtggcagggtgcccaggagcacattggccactagctccaggcggacaccaccattctggtttggtgtctgtgatttttggttaatttgcatttttcaaacagcaaatcactttcacctggtgactttcacttggtccacacgtcaagctccataagaaggtgcgtgctgaagcttgagctgttccctgactggcacacgggccacgcagaaggtccacgtgtgtcccaggaataaaggcggaaggaaagcacccagcctcctggctcggtggccagcggtctcctctaacgcctgtgcttccacattctctgctcagcataaaccacaggacatgcacccaaaatgctgctgaacctgcacagacggttgtgcttaagaaaccccaggctactgatcgtgtgcggcccccggcctcccagggctgtctgtgggcgagctgtgacccctgctgaaaatggcccagaaccctggtgggcatagggtgtgagcctggagccggtgggccttggccaaggggagggtacaggttttgagacacggcccgtcgtggggaatgtgagggtgtgagggactggcccagacactgccctgccctgcatcctggaggctgagccaggtggtctctctgtgagcccctagtgggcctggtgggcttcacagaggggccagggttccaggagcaagagcccaggcataggatctgggctggaagtgtgacctggccatgtgggggcggggctgggcccggcctgccgagcaccgcgtgtggggcctgacagtgtcacttggacctccggggaccgctgaggccacactgttggtggtgccagtgggggctgagtttgccaggggcactgtgagtccatgcctggcccatctctcagatggtggtgggggctgagaccgcagacatttgggttcagtgaggagagccagggagagggcaggcttcggcccaggaactccttgtggctgcttcctggtctccaggtggggaaactgaggcacagagaggggaagtgctttacccacagccatggggcaggggtgcggagctgagccggggcctgccctgtgacaatgaggggctgcctggaagctgcatggattcctgttcctcccacagagtcccacagctgtgggcaagggctgctccctccggggaggtggactcagaggccctgaaagcagcgtcgctggcccctcggtccacgtgggtgcccgccacctgtccaggccctgtctgggggccagcagctcctcaggccctgccatggctggagcagggcttgcacctggcctgctttggctctgggaagggttccacgtcctctgcctgtgcttctgcccctcacgggcccctgcccagtggcttgctggcctcggggtcggggctgttacagcaggagtcaccggccctcttccccatcccctccctcccggctgcttgggcctgtcagttcttggctcaggtttccaaggccttcctgtccttgccgtggctacgccgcgtgcctgcacctccgcacgtgctgcgcaccttcgcgtttggggcctggtgccggctgccctttgcctggaggggtctcccggggtccctgtgagtcaccgcacagtcctgcagcagggagtcagacccacactagaccctccttccccactaggctctcgtgccccagctgtccttacggggaggtctgtcgccagacgtccgccatatcccgcctttgtgtgattgcttctctggagaaagagaagtgcccagaactggccctgctgtctgtggctggcagttttaaggctcctgatggttgtgagggtctgttccctgccgaggggcccgtgttgcgtatttacccgggcttgtgtttttgtcactctggaagcctcgtttcactgtgttttctggctggttgttgctgtttgtcttcccacctgacatctctacctgggtactttgttggattccctcctcagcacaggcagtttctaggggactcttagggggttgtcattggccctgctggcgtctgcacatggctgtgacgttgctgcttccctgcggctgcgctggatttgtgagtgtgtccagagcgtgaggattggtgttgctgtttgtgggtatctgtgtccctccctccttccctgtttccccacattctgatgggcgctctgtcttgcacgggacgcatctctggtccagcatcaggtaggggtgaccctgctcacccagcttgtgccgccgccccgcgcttccttcccagggccttgcggtgtcctgtgttgcgcggggcgcgtctctggtccagcatcgggtaggggtggccctgctcacccagcttgtgccgctgccccgcgcttccttcccaggccctgcggtgtcctgtgttgctgtcaggctgtccgtgaactccggacgtggccctggcgggccgtgttggtggagtctcatttcgggttgtttgccgacggttcggatttttgccaccctgtttctagtaaagttagtctggtagtcttgcttccgctggttttgctgcattttggttgggaacttttcatttttttctgtaacgtcaaaatggcataagaatttatcactttctcagcacctggacagaatactcgggtcccagcactccagcccatttactggtgaccagttagagaccccaagtcagcatggtttggggtggggacacgggtaatgagggagaggtcatgggaccacctcgctaggagtggaggctgggggagaggagcccggggtggcctggctggctcaggagggccctctaagtaggaggaccacagagctggcccaaggtcccatggcagacccagtctggctgccctgagtcagaggcagccacgggaggagcccagcccacgtgagtctccaggagtccctgagtgacccctgtgtcccagaccgccccctccctccggactccccctccatactcccctacccagatggcaccaggaccccctctggcctcagctcctgctttcaggagcccacgggcgtcttgaccacggggatgggaggtcacacgctggtcaatcgccgggcacagcggct

SEQ ID NO: 792 - DNA, 4998 bp, Homo sapiens
  misc_feature (1)...(4998): n = A,T,C or G
cgggtgtggggtgtccagagaacaccccgcataatataaattaccaccttagtatagagaggaactcagaaacgagccccacataccaaagtagacaccttagtagaaggagaacactaaggaagnccacccgaatcaagggtgtcgggtcttaagtgagaagaacaccaagggacggccacccgaaataaaagttcgtgaaattattgagggagaacaccaggacacgccccaccaaacaaaaggttggagaattgaaattgatagaagggggactcaagaaccggcttagttgtgtacaaggtgacccttgaatggtcccgggtttatacacgtcctaggttgtgataaagattggtcccccttatgggccaattattgtgggaaacgtgcaagggtacagtctaaagggctttttgaaaattcatgttaaagaggtttgagcgggtccgacttttccacagggtcggcgtttgtgatatatggaaagttgcagtgacaaccaaatgacaatttgggctgcaccgtctgttaagcaacggttgaagatcaagcctgagaagagaggatccacgcttatgcctccttgcattttccagacggcctttcaacggccacaatccggaaagatcatcttcatggcgttgccagggcgccccagtgaatgggtttccggggtccgtcattccgggaattggtttaatgctagttaataattattgcctggagccacagtgtcaccagcatttactaagttatatttttctaattctattatcatttctatatgtattatctgccactgaaaatcaaatattgccaaaggagaaaagcttgaaataagcagagtaaatgtagatgaaaaagacgactgagagagaagctaatcaatgtaaggaaaatgggtttccctgaagtcaacagccagaaagtggaagatttagtgtatccaaagacaaatttctctaaaataataataataataaacacattggactaccagatctgaagagggtattgttttccagaacatgttgaaagaaaacacccaaccctgaatggatgttagttcagcccctgaaccctgaaggtaaagaaaactctttatgcaacaaaaaggaaaacattaacaagaaaaaatgagccacgctggcctcagatgttcccatcaatctttggagccaaaagacacatgaaaaccgctgctgggtatggagggaacagctgcagggccacagaagacatacccagctaaggctgcacccggcacacaggagacagaaaacatactcagctaaggcagcacccaatacacacaagacagaacacatactcagctaagacagaacctggtgcaaagaagacagaagagataccagctaaggcagcacccaatacacagaagaaagaagacatactcagctgaggcagcacctgctacacagaagacagaagagatactcagctaaggtagcacctggtacacagaagacagaagacatactcagctaaggcagcacccgatacacagaagaaagaagacgtactcagctaaggctgcaccggatacacagaagacagaagacatacttaggtaaggctgcacctggtacacagaagacagaagacatactcagctaaggcagcacccgatacacagaagaaagaagacatactcacctaaagctgcacctgggacacagaagacagaagacatactcacctaaggctgcacctgatacacagaagacagaagacatactcagctaaggcagcacccgatacacagaagaaagaagacgtactcagctaaggcagcacccaattcacagaagacagaagacatactcagctaaggcagcacccggtgcacagaagacagaagagatactcagctaaggctgcacctgatacacagaagacagaagacatactcagctaaggcagcacccgatacacagaagaaagaagacgtactcagctaacgcagcacccgatacacagaagacagaagagatactcagctaaggcagcacccgatacacagaagaaagaagacgtactcagctaaggcagcacccgatacacagaagacagaagacatactcagctgaggcagcacctggtgcacagaagacagaagagatactcagctaaggctgcacccgatacacagaagacagaagacatactcagctgaggcagcacctggtgcacagaagacagaagagatactcagctaaggctgcacccgatacacagaagacagaagacatactcagctaagcctgcaccccatacacagcagacagaagacatactcagctaaggcagcacctggtacacagaagacagaagacatactcagctaaggcagcacctggtacacagaagacagaagacatactcagctaaggcagcacctgatacacagaagacagaagacatactcagctaaggcagcacccggtacacagaagacagaagacatactcagctaaggcagcacctggtacacatgagacagaagacatactcagctaaggctgcatccgatacgcagaagacagaagacatactcagctaaggcagcacccgatacacagaagacagaagacatactcagctaaggcagcacccgatacacagaagacagaagacatactcagctaaggcagcacccggtacacagaagacagaagacatacttagctaaggcagcacctggtacacatgagacagaagacatactcagctaaggcagcacccggtacacagaagacagaagacatactcagctaaggcagcacctggtacacatgagacagaagacatactcagctaaggcagcacccgatacacagaagacagaagacgtactcagctaaggcagcacctgatacacagaagacagaagacatactcaggcaaggcagcacccgatacacagaagacagaagacatattcagctgaggctgcacctgatacgcagaagacagaagacatactcaggtaaggctgcacccgatacacagcagacagaagacatactcagctaaggctgcacccgatacacagaagacatactcagctaaggcagcacctgatacacagaagacagaagacatactcagctaaggcagcacctggtacacagaagacagaagacatactcagctaaggctgcacttggtacacagaagacagaatacatactgagctagggctgcatccgatacacagaagacagaagacatactcagctaaggcagcacctgatacacagaagacagaagacatagtcagctaaggcagcacctggtacacatgagacagaagacatactcagctaaggcagcacccgatacacagaagacatactcagctaaggcagcacctgctacccagaagacagaagacatactcagctaaggcagcacctggtacacagaagacagaagacatactcagctaaggctgcacttggtacacagaagacagaatacatactgagctaaggctgcatccgatacacagaagacagaagacatactcagctaaggcagcacctggtacacagaagacagaagacatactcagctaagggtagcacccgatacacagaagacagaagacatactcagctaaggcagcacctggtccacaggagacagaagacatactcagctaaggcagcacctggtacacagaagacagaagacatactcagctaaggcagcaccctggtgcacaggcagaggtgctcaccctccagcacgaaggaacgtcagcgcacaagagcccttcctgaaaacacagattccagccggcaaagcaatccagagtggattccgacttcaggaatagagaagtggcggccactgtgtttactgggagcaccgggtggtggaaagacggcccatacccagtggcgtaggaattatcgtcacagagtgcaaacccacgttgcaaagcaagacattctaaaaggaaggatttaaccaacaaccgtcagaacgtgggaggaaaagagacaggcggaagaatcaacacacgaattcttcacgttttacagccatgtctaaaagtgtcatatatccttaaaagatgactcgcagcttgcaacgctttgtaaactttttacaacagccttagagagtgctctcagaaataagttgacagagaactacgcatttgcaattcaaaactccttgagttttctcatctgaagctcaagtgaatgaaacataactctgactgaaaatagcacctgcagcgtgttcacattcgaagagtgtttctgcttctccgttactcacctggagtcacagtcaccggaggccagtgccagcttttcctgggcgaaggcatcttttcttggcacatttctgcatggattaaattctttgtaatgagcatgtgttatttttacagaaacaatcaggtaccttaaacagggaaaacacagagaggctggaagcgagcctgcaggattttacgcatttttaatgctgggtcatgaccaaaggaacatttccacactgttcagtttttaaaaatctttttaaaggagaggaacgcggctccacctttcatactgtattttcctttgtctgtttctcatctgatgaatttcatcacagtccatggatccaacacagcaaggcggcctcaccgccctcaggagagggcccctctgtcctggctgtccttcaggtgcaaagtgattcccagggctccgggaacatccgcgtgcctggacggcccaggtggcattgaaccagccactgaggtcacaaatgtcccacaaggagaacaaaggccaagaaggggtcagccgttggccccgggccagggggttcctcctggtgggcaaactcaagatttcagccactgcagtgcaatccgtgaattggggctagaggcacacgggcagggattggagctaagggggtgtcttcaccacgggcntggaaggatccgcgtcagcgcgtcat

SEQ ID NO: 793 - DNA, 5260 bp, Homo sapiens
  misc_feature (1)...(5260): n = A,T,C or G
tttgaaaattcgatccactcgtcggcaaccttccagccccgtggtgaagaccgggctcgaggcctgaagcagggaggtgggggatggtgtaaggggcaggctggtgtgaggactgcagtggagctactgcttggccctggttttatcccagggttccagtccagccacgcctggagaaccgtctgataggggctgagcctggagggtgaaagaggctgcccagtcaccctctgaccagcccgactgggaggccactgtcacgtgccaggcctggaggtcagtcctgctgtgcactcggacgttcctccctccagctccgatttactggaagaccacggatcacacctggctgtggcccgcagtctcacccttcaaaccaaaggccttccgcaggattcctctgggtggccataagggccgggggtggagggctgaggtggcaccagggaagatggcccagggcggcagtttgccaggagggaggtgacaaagggctggagcctgccccggccaccagtggggtctgccaaggattctagaagggcccccagaaggacggaccacaccattgctggcaggtgggggaaagcaggcagctgccccctctgtccctaaggaaatgcggggctgccgcaggttggggcatgaggacgcatcaggatggtggtcaacacactgagtgggacgcatcactcagacccgggaggtcacctcttcaaaaccaacatatgtcccgtccatgcactctctgtacaaacagacttcctcacaataacgaaaagaataaaaggaaaggcaagtcatttggatttagatttagaggaagacaacagaaagaagccaggtgctggagacaccgggcaggtgaggctgtccccaaaggggggacgcagggcaggaccctgtgagcagagatctgggcagtcgaaggaaggagaggagccacgggcctgggtgtcctgctccccgccagctcctgctcagccgccctgcatgctgggccctgctgtgtggccagcgctgctgggacgaggaatccaccactggggtcccaccctctccagaggcccctgtcctggcccctcccctcactggcccctgcacaggaatgggccgtgcatttgctcacggcagcccctctcactcctgtccaaggccttgggccccgagcggaaggcaggctcaggcttcatttccatggcccacactggcccctgtgaactcatgacagcagtgagggcacccagcgcaccaaccactggggctgggctttgtcagcccacactggtctctgaggctcctggccctgggagcccctcccccggccatcacccctgctgacagctgccactggcgatcccacgcagcagcctgggacacacagagcctcttcctcagccatggggagggcggcccgggcccacgctagccaggtgtcgctaaagccacaggcctggggcgcgaggaccacaggggcagccgccgctcggccccagctttatcccggaattctagtccagctgtgcccacagaactgacgacccctggggctaggggctggtaggggctgggctcccagagtgaacaggaccacgaggccgacccacttctgacctcagggccccagggagcagagttgcagggggaccaatgtagcccccacccagtccagtccacgtcaggggcccggtccacatcagggtcccctccctggcagtggctgcaggccccttgggctccttccccgcccagctcctggccacatggtccctggggagaggcacgcagccacgccggccacaggacagggtgtgaggggcaggcgagtgaggcatgggatgagggtctggccgaggacagccagaggcctgctggggtatgagcagcagcaactggggcaggggccaagggctgtgggggacactgcggcaggagaggttagagagggtggggctgtggcagggcctgagctccctgtgaggacacagactgttccaggctggacggagtctgcagggcctgggctccctgtaagggtgtgaatgggctgtcccgggctggacggagtctgcagggcctgggatccctgtaagggtgtgaatgggctgtcccgggctggatggagtctgcagggccctgggctcccaggcaggacagcagctggatgaggtcggattcaggaaactatggactgggtgggtggaggggccaggacaggggatggcaacagggccaggactccccggaggctggtctggacacacagcaggaccggctggccctatgggggacagaggacagggagcagagaggccggccccatgagcccaggccagagaggggcagccccagcctccagcccttgcctgagttctgatcctgctcagccactcgccagcagtgtagacacgggaagtgactgcacggctctgtgcgtcaggttcctcatgtgcagcatggggacagcacagcacccacagtgggggtgtaagcctgggacacactcggctgctctgctccctaaagccgccagccaggaccaagttctcaacagagggaaggtggcggccacagactgggcaggtgtccctctggcctcagtggggcagggtcacggcgtgcggctcccagccccagacgcttgatggctcccgcagagtctagagggcagtgccggcgcctcctgagccagacaccacggattccggccagagggtcccgggtgcacgtacatggtacacacgtgggccgggaagacgggcgtggagaccttcacacctgtctgggctgcggagagcccagtagcccacccagcctcctccctgacgccagcacagctctggggaaccccatccaccccacaggccagctcacaaaccagatcagcacagctctgctgcgccaacggagctggggctcagaggccgttctgtccctcacactcctgaggacgcctgccgtcctccacaggtacgtggaaccaagtaccccatttgccctgagtccccagagcacctgatctcacggagtttaggtgctgcgcagcgccccaccccccagccctgcagccccccagccacagcccccagctgtctccagcctgcctgccaccggcaccccaaacctgtaccacctgctacatgtgcccttcctgacgggctctcgggaaccgccacgccacggtgctgcccctcacagcctgcactcttccccagaagccctcgtggcctcctctgtgactcctagccttcgacgacagactctttactgccatcccaatactcactggcaatggggcctgtgggtgtatcttgggggccggcccagggcctggcacacagccggtgctcaataaatgcttataaagtctgtcagggaaagcagaacagctcagaacccttccctgctggccagcggctcacctggcctctcccagaggtccagcaccactgctgcccagcaccacccctgcctggctggcccttccctgctggccagcggctcacctggcctctcccagaggtccagcaccacccctgcccggcaccacccctgcccggcaccatccctgcctggccggccctggaggctccactgtgcagcatcaagacctgggcagagcagagatctggaatgggcggggcggctgccgaggccggatgaggcccaccagtcccagggaccagtctggccacccaagctcctggaggccttgcagagcactgtcccaggggacagcagaggtggcaggtacccttggtcacatacacaggcagaaggggcccagcctgccgtggtgagagcagaggaagcccgctgagcagacgggagcatgggcaggtggccacgggacctggctggggttgtcggcctctctgcccagcccccagtggggtgagtaccatggccaagcctcagtttccacgcatcacacagggtagctgcagctgcgcctccagctgtcctggcccacggggacaccagcacctgatggctcttcagcctctgacctccctcccctagaataggttggtggccacccaagcacagccccacccagctctgcaaggcccacgcagggccgcctgctgaccaggatggggggccctgtgcagtagcacctcaaggggccccggcacctcccaaagctcccaggggatctggacattccaggctgtagagcaggagaacccagacttccatgacccacatccccacatgggggtggtgggggcagcccaggacaggtgtgtggggatggcccatcctcctcatttccctggagggtctgtaggatgagagtggagggctaggggccgggaggggtcggcagccacagatccactctgctgcggtcctcgacagcctgtagctcagcctccagccgggattggccagaaggtgtctgacaggcaggtagctgctgcggcgcctctgcaagggtggctgggggcctgtgggtcccgcaggcctccccactggaacattccgactgctgtcacatcccaacacagcccccggccccatgcccccgacacaggcctcactgtgagcgaggggcccggagagagacccacacccacacagggggcacgtagctgtggggcttgacagatctggacggccggctttccctgccagccacctccccaggctcccaaagaaacagcaggcaccctccccagaggccctgtgggccagctctcccggggtgcagccagccaggctgtgacgggccccccagctctcccaggggtgcaggccaggctcagcaatgggcctcccagctgctgccacacgaccacttcagatgccatacactcctggggtggggccggggaggacaccaggcccgaggggtctctaggggaggcacatgcgtggcacaaacacacacatcgcacgccacaagccctggccctccctcagggacctgggggctgcttacatgctcacccttctttagggacaaatggctttgtcatgggccacatggcgggagtcagggcctgaccccgggccactaagaagggttagatccccagcccggggttgcctcagcaggtgtgaggcggcgccctaggggtcccgaggcccagagcctggattctagcctggggccactcactcagctcatctggacaggggcaggaggcctgggggcactgaagggtggtcaggcccgtgggctcctgaaagcaggagtcttcaccaggggctgaagggccgcgccaaggacagcgcaattcaaatttnnccc

SEQ ID NO: 794 - DNA, 5232 bp, Homo sapiens
  misc_feature (1)...(5232): n = A,T,C or G
atgacgcggcaccttctagccccgcggtgaagacggctgcccagccccttgtgcccgtcaagaagagccatctgcctggctatgcccacatgccctactctgcccccagtagcacccacttggccacagcccccccaggcccttcctgtccccactggcaaggtcctccatcagggtcacagatgcccaccctgcacaaactgaggtgtggagaaatccgtccccttgcctcccctccagcccatgtgtgctgagcgtgtccatggccaggcatgcacacagggagaaagatgggaaagacctgggtaagggaagccaaggagtcgctgtcccaggcggggtgttaagcgcagcgcaggagggtgggagggggggccaggccagccgaagcaggcataggtttgaacagaggggccggtgagaggccctgaggcccctgaggaaggagcccaccccgtgtgcttgggggcatgcctgggacagggaggctggaggtgggtgggaggagcagagacccagccaggtgggacactgcagatgcccaccagccgctggggtcccgctgccctcgctctgtgccagggcccgatacaggcgctgtctttacaaggcaggtttgtgacactcattacggngctccttgggcctcttctgagcagccacaacttgtacagaagcaataaaaacccatcagcctctccctggagtcagagagccacggtctcctcccaacccagcctctccctggagtcagagagctgcagtctccttccgacccagcctctccctggagtcagagagctgcagtctcctcccgacccagcctctccctggagtcacagagccacagtctcctcccgacccagccacagtctcctcccgacccagcctctccctggagtcagagagcctcagtctcctcccgacccagcctctccctggagtcagagagcctcagtctcctcccgacccagcctctccctggagtcagagagtcacagtctcctcccgacccagcctctccctggagtcagagagcctcagtctcctcccgacccagcctctccctggagtcagagagccacagtctcctcccgacccagcctctccctggagtcagagagccacagtctcctcccaacctctgagcatagaagggtctttcaggctggctgctgtgtgggtaccgtaggggtgggggctgagccatgtcctcgccccatggtgggcacagcccgcacccatctgctcacccatttgtccatctgcacccacccacatccatgcacttaccacctgtccctcgtctgccacccatctgtccgtccatgccacagtgatcatgtgcctgagggcagtggcctcagcacagcctgactctgggctgggctccatgccgggcactgggttgtgaggagcacgtcacacagggtccctgcccccagggagctgccattccagaggggagaggagccagtcagtaaagagagcagcagctgccaggtcggaaggaaggtggccggggtcagggcagcatctcagaaggggcaggccagggtgtctgagtaggggcaagcctgtgtgtgcagaacctgaggcgggtgggtgccactgtgggagagaacagggaggggtgcaggggagctgggccgtagaggatgggaggctgtgcagatagtaccactatcccccaccaccccaggctaagtgacaaaggggctgacccacccagtgctgagaggggcagggtccaggccaggtttgttccagcagcccaagcaccaccactcagccctgggaggtcagcatgggggcagcagggacttggggtcctgggaggtggccatcctgccgtccgcctccactccagtcctggcctccatgggctgcgggagggtgggacgccacgtgcgttgtcgggccccaggtgaagggagtgtctgcgtgtgagaacaccttcatctccatggcatttagatcatctgactcctccacctgtggtatttgattgcaaacaggtgaggtccatgaggagacctcgcctccatctgcagatgcggaagccgaggcccaggcatcagctgcacctgtcgcaccctctgccagggcggggtccagatggggccaatggatttggtcccctccctgtccacctttttctcctcgccacctacctgccccacatgtgcccacacagggctcacttcccgcagcgggcacgcgctcttttatctcctgttttgtgggtcagaattgagcaaggctcagcccgggtggctcctccatgctgcactgtgctcactggggtctcctggggatggtggctgggctgggtggagggttcagggtggctttgctgacgtgcctggcttctgggccttggtggctcaaggcccaggcagctgtggccagcccttgcagagccttagccaggctggcagcaccattccagcacattctgcaggtcagagccccccagcccagcccaggttctaggggaggggttggaccctggcctggaggggcctcatgagtgccgcctttcaccccacccacagctccctgcagcgctcccaggtatgggggccacagccatccaccaggcaggacagccccacagggcagggagatgcctgaccaaggagggtggcacaggcagtgaaggtggcggcgcacagccctgctggagagggccaggccagagtctggggtgcccatcaagctgaaatccaattatgagaacaggccgggctgctgtgacacgggggttaggaattaatgttaacactgtttctggttaagactttttgtgttgataaataattcatgaggcagttagcactttgagcctgacaacacgagaatatattaatacggtcggctccaagaaaggtcagccacgtgcttggggccagggggccatcttttattcattccctgacacaggctcattaattattctggcccagccggagctgtgctcggagggacactaatgagaaaaaggagagtggatttgagatccacacgccatccgctgtggggacgtagagggagagatggaaagaaacactggtgaggcctctgaggcgggatggggcctgcagcctggctccctgacagtgctggttgggtgtgaagaggtgagcggagctgatccgcaggtgtgtggggcactggctgccacatcccagctctcccagagagatgaggaacaggagcagatgcagccagtatcagagagcaggaggtgcatggggaagtgaggctgaggctgtgggtgccccaagcacactaggcccagcgggtgcaggaacccccagagaagccactgagcagagacccagaggggaggctcgcagggccagcggttaggagtcctgcatgtgtgcacgtgtacatgacagtgtgagtgcacgtgtgtccatgatggtgtgcgtgagtgcacgtgtccatgatggtgtgagtgcacgtgtccatggtgtgtgagtgcacgtgtgtccatgatggtgtgagtgcacgtgtccatggtgtgtgagtgcacgtgtgtccatgatggtgtgtgtgagtgcacatgtgtccatgatggtgtgtgagcacacgtgtgtccatgatggtgtgagtgcacgtgtacatgatgcgtggatgtttgtacatggtgtgttgtttacatgtacatgacagtgtgtgtgccacgtgtgcatgatagtgtgttctgtgtgtacatggtgtgtgtgtgcatgtgtacatgacagtgtgccatgtgtacatgatggtgtgtgagtgcacgtgtgcatgacagtgtgtacacgatggtgtgtgagtgcacatgtacatgatagtgtgtgtgagtgcacgtgtaaaatggtgtgagtgcacatgtacatgacctcgtgccatgtgtacatgatggtgtgtgagtgcatgtgtacatgacggggtgtgtgagtgcatgtgtacatgatggtgtgtgtgccacgtgtacatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccatgcctgtgtggtaacgatcacagtgaggccaggggctctgcgggcactcgggggtcttcaggctgacgtggggtggggtagagtggaagcggctggtggccagctcttgtcaccaggaacccccttgctgtgtggagacagctggagggccagagcacaggggccccaggtggccacgctcgacaggatgtgagggcagagggttagggatggccgccctgtcgtgtggtgggtgccctctgctgtgggtgtgaagcccacggagtgtgtggccagggacatgtacttaacaggaagaggtggcactcgggtgtagaatggaaagctgttcagagtgagactgttcctgtccagtgtgtgagtcgggccgagcccagaggtggctgaggtgggtgctttccccacccacgtcccatggcgtcacagcacaaatgccagtccagcctgtccagtgtgtgggttgggccgaacccagaggcagctgtggtgggtcctccctggcccgtgtcccagggcgtcgcagtgcaaatgccagtccagatgttcctatttgtggcagtcgcgacttgagaaaattaaaggtgattttgtgcattttaagtcttcaccacggggctggaaggatccacgcgggcgctatgtgttccag

SEQ ID NO: 795 - DNA, 5032 bp, Homo sapiens
gctctaataaatttgcggccgctaatacgactcactatagggagaggatccgcggaattccaggttcccgtcagtggtaggaagatctccatggcacgatctctggaacctgcgagtacatcacctagaaggccacgtctgagcaaatgtgattaaagtaaggatgtggaggctgtgcagctttcctggattacccagatagagtgtaaacgcagactagtcctcacgagagagcaggggaagccccgacacagaggtggccacctgaggacaaggcacggagaacaggctagtttggacacccagggcattccagggtccatgcctgtcctgggactccactcccttgctggtgaggggtccaggcattgccaggaggagcccagcagggcgtctgggaggcttcgtccttcttcggtgcctttgcccgtccaggacacacctggcccctgctgcgtgccaggccctgagtctcgtagtaacagaatggactttgatgctgttcctctctctcctgggctggccaggagtcactgcagctgcttgacaaatgtcacccaggttgagtgtttttaaagccctgtatctattctatgaaggatagaatgttaaaacatatattaaaacctttatttttctgtcaacatcagatgtacttccatttgcctgactgcatctttcaggtcttgttgaaataaagtagaatttcaactcctgatttttacagcagggtcagtcttacccaagttctaagttacccaggttccaagttttacaggagggtaacttagcccaagttctaagttaccaggtgagatggaaatagcctgaccaaaatcctccagggccagggggtgggttgcttggactgctgaccttctgagctatgtgccccctcacagtgtttccaggagcgtgtaccctcacagaatgctcccgggaaggggctcctcctcacagagtgctcccaggagggtgctccctcacagagtgctcccaggaaggtgcccctcctcacagagtgctcccaggagggtgctccctcacagagtgctcccaggagtgtaccccctcacagagtgctcctgggaagaagtctaccttggattctgcaccatcagagattactcccctcaaggatgatgcctggggagggatggctgcctcagtgccagggctggccctacattggaaggcagcccagagggactctgcctggatggggtcccctccccgcttctctgtgcctcaatgcaggctgtgtgctttgacttaaaggcggacatttcaccatttcactccttcacatggcatccctgggctcgcaggtagttctggccagcagatggccctggagtgctgcccaccctccagctgtcctccctccagccgcactgccgtcctccctccagccgcactgccgtcctccctccagccgcactgccgtcctccctccagctgcactgccaccctccctccagctgcactgctgtccaccctccagctgctgccctccctccagtcacactgctgtcctccctccagccacactgctctctaccctccagccgcactgccgccctccctccagccgcactgccgtcctccctccagccgcactgccgtcctccagccgcactgcagtcctccctccagccgcactgccgtccaccctccagctgcactgccatcctccctccagccgcactgctgccctccctccagccgcactgctgtccaccctccagctgccatcctccctccagccgcactgccgtccatcctccagctgctgccctccctccagccgcactgccgtcctccctccagccgcactgctgaccaccttccagctgcgctttacaggtatgttcccagatctctggggccacagggctgggccctggccctgcctcctcctcgccgctgggccctggccctgcctcctcctcgccgctgggccctggccctgcctcctcctcgcctctgggccctggccctgcctcctcctcgccgctgggccctggccttgcctcctactcgctgctgggctgccctgcaggggccttggggctttgggtcagaccagccccagggcagagcaggcctgtgtgggtgactaacacaatcagctcactcagggcagaatatgcgttcctggggtcttcctgaagattagatgcataggttggaataaccaagacaaggggacgtgaagcatagccatgtgccgtccagccgcgctgtgggaaagggcaggctgcataggcaggggcggccctagaagattagaatgctggattcttttctttctttcttttttttgagacagagtctccctctgtctcccaggctggagtacagtggtgccatctcagctcaccgcaacctctgcctcctgggttaaagcgattctcttgcctcagctgggattacaggcgaacgccaccacgcccagctaattttttgtatttttagtagagatggggtttcaccatgttggtcaggctagtctcaaactcctgatctcaggtgatctgcccacctcagcctcccaaagtgctgggattataggcgtgagccatcacgtctggccagaatgctgcattcttactgtaccttttcatgcgccgggttacagctgccgatgggattcaggagtcacatggggtgcagcccaggagcaataggctgccccatccaggtgtgtgccacgcgctgtgatattcacacagtggcaaaatcgcatgacacatttcccagtgtctccccatcgctaagtggcagctcactgtaaaggctgaagcccaagttggggcacagaggcctgcagggacacacaggcctgcagggtggtggggctgactccacaggaagcaaacccttatatagaagccccacatggcagatggtccaggccccagacaatgacctggtggggcgtggattgggacctgcccctcctgccagcctggaagggtcttgtgggacgcagggcactccttgctgggcgcgcagtgtgggcccacgactccttgctgggcgcgcggtgggcccacgactccttgctgggcgcgcggtgggcccacgactccttgctgggcgtgcggtgggcccacgaggcctccttcttaggttgcagccctggggccccttagtgaggagtgaattggcagggacagggtgggggtgacactcaggtcaaggccaggtgtgcacctggagctttcctgaccatcactcaaggcaggtgggcctggcgctcactgcactggagggtgggggctgccacctctgcacctggctcctgccctctgagctcctgttccttcgggcacagccagggcaaagccaatcccacaagtccctgcggggccagaactctctggcacaaaggcgggaactaagagcaccttctatgcagaaaaccccgtggatgtgagggaaggcggccagtggggtcgctgggggtgggacgacgggaggccgcgtgacacccccaagaacgaaggagcacaatggggcatccggcagagccaggagctggggtttccaccgggagaggtggcactgggggagggggctgggcagagccggggtggcagcagggctgggaagctgggacctgctgtgcttcacttccggggcgatggcaccggacagcgtggggccgccgaggcgcccagcatcccaaggtgctgcaggagggacgcacggctgtaggggtcagcctgggtgagcctggccccccaacaccacagaacacgcgaccacagtttcatccaaatcaaggctgtatttatcgtcactgattgacatgggaacagaatatttaaaacaaacagggtccaccgtggaaatgtggctgaaacacagaactgagcaaagcaagtggctcgacggctgaccccgaaggctgggaatcccggcagggacacagcccagacatcggggaacacaaaaggccgcaaggggggcagggcatgggggggctcatgtgggtgagggcaaaacccaaactgagaggaggccaggccaaggggcctgggaggcgacgaccacaccgaggtgacgctgatgcctcaggcggaagaaaacacacagcagtgattttgtgtgtgtgtgtgtgtgtgtgtgtgtgtgtgtgtgtgtaaaatcagcctttagactcttgcacttctatacctccaccgatctggtctacagattccgagaacactgcaccatccacacaaacgtccacagcatcgcccttgcggctggagccggccagtcctgaagcccacaggagccgcccaggagtgctgttctgctggcccaggggctctgctggggggacccaacccctccacggacccaggggctgggaggtcgctggcggaaccttcctcccccaaccagcagagccgccgggaagcgcttgcatagttgaaggaaagttgctgccattaaacttctgataatgtttacagccagcagcgcctgggtttttgtgaccatgttagacaaacaaccagaggggtttctggaaacggtttttataaagtctatctagattaagaatttagtaacgtcatatatttatatcaacagactatttacacgtttcgtttgcttttaaaaaaacaaaccaaaaaagaaattacacttctgcataataaggcaaaaaaacaaagttttgtacattattattttaatataatctgtaacttcggttccaagtaccaagggggggccagggctggcctgagtgggggcctcacagtgcgctggacaaagtgaccggtttttctccataaataagacaaagaaaccctggggatctggagaaggatctgaggccattaaactgcaaatcccaaccgaaaacgaagaagcaaaagtttcttttttggttcttttaaacgtctaaagagcataaaattaagaaaaatacaaatccattacaaacacttctcatctgtggggggaaaaggtacaaacgcgatttttttttcccaacagccgaatcccaaactcggaaaacgtcttc

SEQ ID NO: 796 - DNA, 9278 bp, Homo sapiens
cgccccgtggtgaagacatcaccatcaccatcatcatcatcaccatcaccatcatcaccaccatcaccatcatcatcatcaccatcaccatcatcatcaccatgatcaccatcaccatcatcaccatcagcatcaccatcatcaccatcatcatcatcatcatcaccaccatcatcaccaccaccaccatcagcatcaccatcaccatcatcaccatcatcaccgtcaccatcatcatcaccgtcaccatcaccatcagcatcaccatcatcatcagcaccatcaccaccgtcaccatcatcaccatcatcaccatcaccatcaccaccgtcaccatcatcatcaccatcatcaccaccatcaccatcatcatcaccatcataatcatctccatcgccatcatcaccagtgtcaccattatcctgtgctctggttcccagttgggctcagcagcagcagccccagagcaggtcctagggctcctggagaaccgccttcctctccacttcctgtctgcatcccctttccatggctgcctcgtttagccatgttctggcaccactaacttctcccttgcccttgccggcttctgggtggtggtggcttcccacagtgcacatccctgggtcctcagcaaccctcatgggctcccgtcctgcctgcccctggagaaatcaggcctcattagccccctcacagcactgtgcctgtttcttgcggagacccccgctggcatgggcttaatgaatacacacataacaagcaggcaggcccgggggcttgcatctccagggagcccagagcaacagcccctgcaggtgctcccagaggcggaggacgacccaacatcacccggacaggaggcaggctctgtgtgtaggaacactcacagaagaggcgccgaggcagcccagtccccatgcaacttgagggggcccaggccccagtgtggacctgaaagtctcgggggttggggatggtgagtgtccatgtttaggtgcaggttggagaggaagcaggctctgtgtgtaggaatactcacagaagaggcgccaaggcaccccagtccccatgcaacttgagggggcccaggccccagtgtggacctgaatgtctcaggggttggggagggtgagtgtccatgtctgggtgcaggtcggggagggacagtgcaggccgttctggggatgggccaggtagcccataggaagagcctgcacacctcgctctcagaggcagggccccggggcgggagctgccttgcaggggaggccagggcaaggggcccatcccccagggcctctcggccacctggagtgcttgctgctcagtttaatccttgtgtgctcaggagagcactgacaggaaatgagtgttctgccatgtgggagagctgctccctccctggaagggggcacccctgtgtgcacagagcctgagcccctcccttcactgatgggagctttcccggagctaatcccagaggagaggccctgccaggcgtaatcttggatcagatgccagggagtgaaggatggtgacacccccacacaggcctgatgtgcagggtgaaggcagacggcagcccaggggtctctcctcccctgccaacctccgttctgtgccctggcggtgacttacagaccctcaccggactgcccttcagcttcctgtaagatttggtcatggaaagctgtgtggggagcctggagccaaggagagggaggtcggaggtcaaaggtcagaggatttatccttgactccagaggctttgagctgaccacagcccctccgggtggcccgctcctccctccctcccctggggcctctgtgtcctcatcgtcccctcagcctggcccacttttctggaagtcttccccaggaagggcagaatggaaagtgtggtgaggggtccaggcactgcagcctccctgggtctctgctgcccgtccccctcctcctcttcctctctattcatgtctactggatgcttttctccaaccatttctgtttcccatttcttctgtctctcactctcttttctttgtgtctctgtttctctctgttccatgcatcggcttcctgtggctgcctgtgcctggggacacctgtgaccaggaactcctgtgcctggggacacctgtgaccgggacacctgtgcctggggacacctgtgaccgggaacacctgtgcctggagacacctgtgaccggggacagctgtgactgggacacctgtgaccaggacacctgtgcctggggacacctgtgaccatgggtgcctgtgaccagggacacctatgcctggggacacctgtgaccggagacacctgtgaccggggacacctgtgcctggggacacctgtgacctgggacacctgtgaccggggacacctgtgaccagggacacctgtgcctggagacacctgtgaccagggacacctgtgaccggggacacctgtgacctgggacgcctgtgcctggagacacctgtgcctgggacacctgtgcctggggacatctgtgaccagggacacctgtgcctggggacgcctgtgacctgggacacctgtgactggggacacctgtgcctggagacacctgtgactgggacacctgtgcctgggttacctatgatcaggaacaccctgtgcctggggtcacctattaccaggaacactgtgaccagtgacatccgttctggggacacctggactcagtcgtgaacaaccccaggccagccgtgcagggaggtcgggcttcctccatggcacggtggaaggagaaagctgggtgaggaccaggcctcaaggactgaggccgggattggagctttgccagagcccggagcagctccaggtccaggctcctccctaagagctgaaggccttgagcaactggcaattcattctcacctcggggtaatgggattacaaaaacaaaatccttccatgtaggggctgtcatcgtagtaaatgaaataaaaagacaagcaacccagtcaaatgtggacaaaggacttgaataagcatttcccaaagtagatatacgaatccccatgagcacatggagagagactcagacatcatgagccataaaagcaacgcaaacccaaaccagagggacagtctgctccacatccacttagatggctatgtttcttttttcttttttttaaaggaaaatgttggggatgtagagaaattggaattctcacacattgttggcaggaatgtgaaatggtgcagtcactgtgttaaaacgcctggcggctcctcagaacgttaaacgtaaagtcaccatttgacccagcagttccactcctaggcgtatgcccaagagtgcacaggaacgtttattccagcactgttcataataagcgaatagcagaagcaacccacatgaccatcaactgatgagtgggtttctagcggtggattcacacagcagactattagtcagcagtaaaaaggaatgatggccgggcacagtggctcgtgcctgtaatcccaacacttcgggaggctgaggcaggtggatcgtctgaggtcaggagttcgagaccagcctggccaatgaggagaaaccctgtctctattaaaaatacaaaaaaaaaaaaattagcaggacatggtggtgcaaacctgtagtcccagctacttgggaggctaaggcaggagaatcacttgaaccccagaggcagaagttgctgtgagccgagatcacgccactgcactccagcctgggtgacaagagcaagacttcatctccaaaaaaaaaaaggaagtaagtaccgatatagatgacaacatgggtgaacttaaacatcacagcgagtgaaagaggcaggcacagaagactgcacgcaggtgtgtgaaatgtccacaaccggcagatccacagagagatgcaggtgagcagcctgcggccaggaccagggctggggtgggaggaatagggggagggacagctagtgggtctgaagtttcttttagggatgatgaaaatgatttaaaattagatggtggtgatggttacacaactcggtaaatatattaaaagtcactgaaccgcacacttcaatccataagtgaacttcaagattaagtgagttatgcttctcagacacatagtccaatgactgccatgtgcgttgactccctcacccttccagtcaagactgattatgcacctgctgtatgtatacactgtcccagacacaggggacccagcactgaagaatgggacagatgccccgccctcaggagtgcacagcccagtgaggaaaacatacaacaaacaagaacatttacaatatccatggccaggcatggcggctcacgcctgtaatcccagcactttgggaggccgaggtgggaggatcacttgaggtcaggaattcgagaccagcctgaccagcattgttgaaccctgtctctagtaaaaaaaaaaaattccaaaaattttagcccggtgtggtggttgcacactgtaatcccagctcctcgggaggctgaggccagaaaaatcctttgaacctgggaggtggaagttgcagtgagccaagatcattgcaatgcatttcagcctgggtgacaagagtgaaactctgtctgaaaaaaaaaaaataggccgggccgaatggctcatgcctgtaatcccagcactttgggaggccgaagtggaaggattacttgagcccaggagttcgagaccaacctgggggcaacatagggaaactctgtctctacgaaaaaaacaaaaaatttagccgggcatggtggcgggcgcccgtaatcccagctacttgggaggctgaggcaggagaatggcgtgaacctgggaggcggagcttgcagtgagccgagatcgtgccactgcactccagcctgggtgacagagtgagactccatctcaaaaataaataaataaataaaaataaataggataaattttgtatagtaggtctggggtgattcatgccatggagaaaaagtaagggagggggtgggacatatggggcacagggcaccaggggggccaggaagggtccccatgcacagttacggccaactgaccttcagcaaaggcgccaaggacacacgacggggaaaggggcatcctcaataggtggtgctgggaaaagtggaggaggatgaaagggcctcatccgacaccacctacgaaaatcaactcaacacggattaaagattcaaacctaagacccgacaccataaaactcttagaagaaaacgtaggaggaaaacttcttgaggctggtccgggcaatgatttttttaaaatatggccccacaagcacaggcaacagaagcaaaaatagacagtgagagtgcaacaaaccagaaagcttccgcaaaggaaaccaacagagtgaaaaggcaacccccagggggaggcgggggtattggcagggaaaaggcagaacccacggggaggtgggggtatttgcagggaaaaggcaacccccatggggaggtgggggtattggcagggaaaaggcaacccccatggggaggcgggagtatttgcagtgaaaaggcaaaaccccagggggaggcgggggtatttgcaatccatgtatatgatgaggagttaatttgcaaattgtagaaggaattcaactcaataacaaaaacaaacaaaaaaaattttaaaacgtgcaaaggacctgaatctgcgtgtctcgaaggaaaacatgtaagtggccgaagtgtagacgaaataacgtccagcatcactaatcatcaggaaaatcaaataaaaaccacaggaggtaccaactggcacctattgggatgactgtcatcaaaacgcaaaagatagcgagtgttggcgaggacatggaggaaaggggcccgttgcactctgtccctgggaacgtcgttggcacagccaccatgggagacggcagggaggttcctcaaaaatgtggaaatagagctcccacctgatccagcaatcccactgctgggtgtatatccaaagagttgaaattagcgtgtaggagaggcgtctgtaccctcgtgttcatcgcagcactgtcccagcagccaggacacggaatcaacccaagtgtccatcaacggatgcatgaatgaaaatatgtgagaaatatacacacacatgcatgcacacacacacaggagtgttattccacaggagggaaagggaagggtgggagagagagagagccagagagagagaaaggagagagagagaagggaagggaagggagggcagggcagggcagggcagggcaagcccgccatttgtgaggacacgatgaacctgaagggcatttgtggtaagtgagataagccaggcacagaaagacaaacagcacatggcctcactcgagtgacgtgtgaaaaagcggaactcacagaagcagagtgaacagtggctgtcagggctggaggggaccgggagttgagggtcacagggaacaaaggtgcagttatgagattagcgggttctaagatgtaatgaacgtggtgactacagctgataagaatgtgtcctttatttatttattttgagatagggcctccctctgtcgcccaggctggagtgcaccgcaacctccgcctcccaggctcaagtgattctccagcctcagcttcccaagtagctgggaccacaggtgtgcaccaccacgtccagataatttttttatatttgtagagacagggtctcactatgttgcccaggctgtgtgtcctctatttaaaatttagtgttctcaccacagaaagaagtaaccatgtaaggtgatgggtgtgttaattagcccaattgtgggactcatttcacaatgcctacgtgtgtcaggttgtgatgctgcataccttgagtgcacaccgtcctgaattgtcaactatacctcaataaagctggagagagagaaagaaaagaaaaggtatcctgggacggtgacgtgggtaacgggccccaggacactcacagagagagggaatgcaggtgcaaaggccccggggcagtgacaaacaggaagcaggaagaagggccagggtacggggatggggcctggccgacctccatgcccagagccttcctttcccgagtgggaagagccgggaggttcctgcggaacaaacgcctgggttgaggtggcgcagagccctgagggggctcaggcgagggtccaggccaggtgggcaggcgggggcagcactctgcaagggcaggagccatcaggagagcatcggctgtccctggggaaggcccctcatggaaggagtgagccggtaacagggagttggggggcggatttgggggtcaagcacaggctcctgagcggccaggcggtgagcgtatgcactgccctgcagacctcaggcatcactggcatcttgaagcagaaatgacataatcaagttttgctttaggaagaaatatctctatccccaaagccagcaaacatatgaagagatgctcgaaatcatcagtcatcagagaaatgcaaattaaagccaccacgatgatcccgtcccaccatctagctgccaagatgagaggccggatctgccaagtcctggcaggggtttgggagcatcccctggagggacggaaccctcgtccactgccccctgcccgaggaaggggtgaggcggcccttagggagagcagctggagccggggaagggctgggaagtcctcacccaggtccatgggggcaggtccaaggctgcgcaccgaggcgccatcatggaccccttctctgccggccgcctgcagttctggggctcaagcacagggtgccctgccagggaaggtgcggcaggagatccagcccctccaccaaagcctgcctggagagagaggagggcctgttcctcatctttcttctgatttacacaaaggcacgatgtgggccggcaggagacctgaacccggggtcccttcctggaaagtgcgtgggcagctcgtgaacccggtgtcccctcctggagaggacgtgggcagctcgtggacccgggtcccttcctggagaggacgtgggcagctcgtgaacccggtgtcccctcctggagagggcgtgggcagctcgtgaacccggtgtcccctcctggagaggacgtgggcagctcgtgaacccggtgtcccctcctggagaggacgtgggcagctcgtgaacccggggtcccttcctggagagggcgtgggcagctcgtgaacccggtgtcccctcctggagagcgcgtgggcagttcgtggacccgggtcccttcctggagaggacgtgggcagctcgtggacccgggtcccttcccgttgacgacgtgggcagctcgtggacccgggtcccctcctggagagggcgtgggcagttcgtggacccgggtcccttcctggagaggacgtgggcagctcatgaacccggggtcccttcctggagagggcgtgggcagctcgtgaacccggtgtcccctcctggagaggacgtgggcagctcgtgaacccggggtcccttcctggagaggacgtgggcagttcgtggacccggggtcccttcctggagaggacgtgggcagctcgtggacccggggtcccttcctggagaggacgtgggcagctcgtgaacccggggtcccttcctggagaggacgtgggcagctcgtggacccggggtcccttcctgcagaggacgtggccagctcgtggacccgggtcctttcctggagaggacgtgggcagctcgtggacccgggtcccttcctggagacgacgtgggcagctcgtgaacccggggtcccttcctggagaggacgtgggcagctcgtgaacccggggtcccctcctggagaggacgtgggcagctcgtgaacccggggtcccttcctggagaggacgtgggcagctcgtgaacccggggtcccttcctggagaggacgtgggcagctcgtggacccgggtcccttcctggagaggacgtgggcagctcgtggacccgggtcccttcctggagacgacgtgggcagctcgtggacccgggtcccctcctggagagggcgtgggcagttcgtggacctgggtcccttcctggagaggacgtgggcagctcgtgaacccggtgtcccctcctggagaggacgtgggcagctcgtgaacccggggtcccttcctggaaagggcgtgggcagctcatgaacccggtgtcccctcctggagaggacgtgggcagctcgtgaacccggtgtcccctcctggagagggcgtgggcagctcgtggtcttc

SEQ ID NO: 797 - DNA, 7866 bp, Homo sapiens
  misc_feature (1)...(7866): n = A,T,C or G
ccttcctcagccctcgatntcnagtataagatggttaattttagatgtcaatttggccaggccatggtttttggctaagaccagtctaaatgttgtgaaggtaagttttagatgcaattaattttttttttttttttatgagatggagtcttgctctgtcacccaggctggagggcaatagcacagtcttggctcactgcagcctccacctcncaggttcaagcaattcttctgcctcagcctcctgagtagctgggtttacaggcgcccaccaccacacccagataattttttgtatttttggtagagacggggtttcactatttggccaggatggtctcgatcttttgaccttgtgatctgcccacctcggcctcctaaagtgccgggataacaggcgtgagccaccgcacccggcagcaattaattatttttaattgtggcaaaacatgcgtgacataaggtttgcagttttaaccatttttaaccattcttaaaactgcatcttcagcagcaggaggcacattcacgttgctgtgcagccatcaccagcacccacctccagaaccttcccatcttcccaaacggaaaccctgtccccatgaagcacaaactccccactgccctcccccggctctggcaacctctgttctactttctctaaatctgatgactctggggacctcatgtaagtggaatcactggctcagttcacttcgcctaacgtccttgaggtccatccaccttgcagcctgcattagaatttccttcctttttaaggcagaataatgtcccattgtatgggtagactgcattgcgtttatctgttcacgtcaatggacatctgggctgtgttcacctgttgtctgttgtgaataatgttgtatgaacatggccgtgcaaatatctctttgagaccttgccttcaattttttttttcttgagacagagacttgctctgttgcccaggctggagtgcagtggtgtgatctcagatcactgcaacctccgcctcccgggttcaagccattctcctgcctcagcctcctgagtagctgggattacaggagcccgccaccatgaccggctaatttttttgtatttttatagagacggggtttcaccatgttggccaggctagtctcgaactcctgacctcaggtgatccgcccgcctcggcctctcacggtgctgggattacaggcgtgagcccccgcacccggccgttgcctttaactaattaagggggtctacccagagaggaaattggtgatcctaccagagctttaattttaaatttttcgagggacttccacacttctcttccgcagtagctacgccactctccttcccaccagcaacgcacgaggattccagcttctccgcatcttcaccagcacttgtacttcctggttttcggcagtcatctgactaggtgtgcgaggtggtttctcactgtggtttgatctgcacgcccctaacgatgagtgatgtggagcatctttccatgggtttgttggctttgcagagcttctttggagaagatgtctatgtctccatttcctctttggagtaatttgtattttcccaatttttaaatgttttgacatagaataattgtataatattcaagggttacatagtgctcttttgatacatataacccacactgatcagattaattagcatatccattgttgaatcaagtttggcctaaagctgcaaccttacacattttaagttcggcctgaaggtttctccgtacatggtgaactgtagcctacatggaggtgcaaacagaccgtcacctactctcatgccaatcactgagctttggccagtcgcaggtggtcaactgttcaaaccgtgttcaaataagacaaatgccgagctgccgccaatccagccatttctgtccctcgcttctgttttctgtacatcacttgccttttcccgtccataaatcttcttctgccacgtggctgcgcgggagtctccatacctactctatttgcaaattgttctttgctcaattacactcttttagatttaatttggctgaagtttctttttttaaacaccattgtctcaaacacttatcatttatttctgttaggaacattaaatgtccttccagctgtttgaaactatataacgtatgaactctggtcatcctgtagtgccatagacactcacacctcccccccactgactggtaattttgtttcctttaacaaatctttccctctcctttcccctccccttcccaccatccagtatgttctgttctaatttttacttctttgaggtcaacattttttagcttccccatgtgagaacatgtgatatttgtctttctgttcctggcttatttcatttaacctaatgtcctccagttccatccatgttgccaccagtgacaggactcattgtttttcatggctgaatagtattctgcggtgtgtgtgccacactttcttcatcagtcatctgctgtcggacacccaggttggttccatatcgtggctgctgtgaatggtgccgcagtcaacacagggtgaggatgtctctctgatgcactgacttccttccctttggataaacacctagaagtggtttctggatcgtgtctgtctgcagtttcccgagtagcctccgtgctgttctccacagcagctgtgttcgttcaccttcccaccaacagggtgcggattcccttttctctgcatccctgccagcatttgttacttcttgtcgttttgataatagaccagttctgactggtataagatggtatctcctcatgattttgatttgcagttccctgatggttagtgatgttgagcatttttttatagatctgttgaccatttgcatgtcttcttttgagaaatatctgttcagatcattcgccaatgtttaaatcaaattgttgctgtttaatctggttttttgctgttgagttgtttgagtttcttgtatgttctggacattagtcccttgtcagatgagtagttggcaaatatcttctcccatttggtaggttggcttttcactctcttgattgtttcgctcactgtgcagaagctttttagtttgacacaaactccctcgctgtgcagaagctttttagtttgacataaactccatgtgtttatttttgcttgtgttgcctgtgcttttgtgatcttactgataaaatattttccgggccaatgtcctaaggcattccccctttgtttcgtacttttgggtcttctacttatgttttttatccgttttgagttgatttttgtgtagggtgagaggtgggggtctagcttcattcttctgcacatggatatccaggttttccagcaccttttattgaagaggctgtcctttcccccaatgggtgctcttagcacctttgttaaaaatcagttagtgctagatagagggattaatttctaggttatctactctgttgcattggtctatgtatctgtttttttaacgccagtaccatgctgttttggttaccacagctttgtcatatattctgaggtctggttatgtgattcctccagcaggctttttttttttttctttttagatggagtttcactctgtggcccaggctggagtgcagtggcacaatctcagctcactgcaacctctgcctcttaggttcaagtgattctcctgcctcagcttcctgagcagctagaattgcaggtgtgtgccaccacatccaactaatttttgtaccagctttgttctttttgctgggaattgcttgggctattctgtgtcctttgtggttaagaatgttaatattaagattattaagatctttttaatgttaagatttttttttctatttctgtgaataatgtcatgggtattttgataggaattgcattgaatctgtagactgctttgggtagtatggccattttaacaatattaattctgacccatgagcatgggatgtctttccatttgtttgtatcgtcttcaatttcttttacatgattatagagactgagaagtcccacaggctgtctgcacgctggagaaacaaggaagctggtatcatgtctcagtccaagtctgaagtcctcggaaccggggaaggtaatggtgtgactctgagtccaaggctgaaggcgtgagaacaaggggtggcggatgctggccaagccctgggggccaaaggccagggaacctggagttctggtctccaagggcaggagaagaagggcattcctggctgagcacggtggctcacgcctgtaatcccagcacttcgggaggccgagacaggcagatcatgaggtcaggagattgagaccaccctggctaacacagtgaaaccccgtctgtactaaaaatacaaaaatcagcggggcgtggtggcgggtgcctgtagtcccagctactcgggaggctgaggcaggagaatggcgtgaacccgggaggcggagcttgcagtgagccgagatcgcaccaccacactccagcctgggcgacagagcaagactctgtctctaaaaataaaaaataaaataagaagggcattcctgctccaggagagagagagagaaagagagggtgagagagagagaaagagagggcgagaaagagagacaggaaggaggaggcagggagaggaggagagagagagagagagagagagagagagagagggaattcacctttcctccaccttttcgttctatctgggcccccagccgactggatgggctagggtggagcttctccactggatgggcgagggtggagcttctccactggatgggcgagggtggagcttctccactggatgggcgagggtggagcttctccactggatgggcgagggtggagcttctccactctgtccaccaactcaggcatcacgcagacacatgcagtaagaatgcttcaccagcgttcgaggtatcccttaacccaggcaagttgatacccaaaattaaccatcacagccactgaggtttggcagtagcttttccctgcagcgacccccagcctaggttgactcgtaccctgaaacagcgagggaagagctccacatccagcaggaggagactggctggataaatgcggtgtgtttaaacaatggctacccctccggcatttaaatcatgttataaaaagtataatgtatacagaatctattacgtttttaaaatgttacaaactcatgcccagtatgtgctcggttttgtaaaatcgaggcgagttatgtggaatgcgtaaccgaaatgtaaagtgtgattttcatggagctacagctgtagagacaacacttatcttcttttttatgcttcagtttattttacaagttatctacaataaacatcaattactgacataatcagaaaaagtttgctttatttttctacatgcgaaagcacaaagaacaataaacatgtcacagatgtggcacatttgcgcacaaccccatttttaacaccgaggacacccccgtctctctgctctgcccagccaggtccagcgtccttgagccaaatctctgcaaatgttccagtcaggacagattaagtttcaccataaaccagcagctcatctttatttctaggcaatttatttaagagcctcctaaaatctactaacttccaggccgaaaatcatttaaaatcaaatgagtttcctcgccgataaaacttgagatcatccttcagctttggagataatagaactgagcggtcatttcctccccgcgctgagggagctgagtgatggagaggcggcataggtcctccgaggaggtcccgtgagccccatggctgtttcccaacgccagcggaagagggaggttagaggctccctctgctgttatcctgcgggtggaggaagccctgagcatcccctccagcccctgaggcctgagtcctggggggccccccgcccccgccagcccagcctggcgtcaatcccgcttatgcatagcccagaccaccccctgcccagcgagctcccctgaggctcttcctcgtggcaaaagagattctcagagccctctgcagagtgccaagtgcgcagggaagtcacagctgacccgtcaccccagccccaactgctcagtgccccagacctctcactgcgtgtggcccaggccctgcagagtctgccccaccccctccagcctcctttcacacttcctcactgcatcagtttgcctttgtagcaataatgcttagaaacaaatcacccggaaactctggtttcaacccgagtatgtatttagctcacaagccgcaggtcaggggtcaggctgggctcagcaggtggctcttctgtcctcgccggggtcactcgggactcactcactcgtctagggctgcttggctctcggctgccatcaggcagctctgtcccatccctcgagtgtgtctcattctccaccggggagcctagacaccgctcggagagggtgacaggaagagccagcaggtgccttcccagcctccgcccgtgtcccatcccacggccagacacagaacaaaggaacgggaaagagactctagtagggtgagcagctgagtcacatcacgggggtgggagacaggtgggtgagagccagggggacgaagcaacccctccctcagcgcctgggctgggacccagtggccactactgaccgaggcccgccctcctcacagctcagcgggcagcgccactggcccaggcggcctcacctccctcctctccagccacacctgcacccaggacagtcgtcccctccagagaagcccccaagagcaccgcagcctgagtcacagcctttgacacactctgacactttccttcccacagctgtcacagtttgggacaataaatgattccccagtgcatcagcccaggatggaggccgcacgtggacagagacctttaccattgcattccgccaggtgggacctcctggcccatggtgtggcatggcaggtgctcagtggaccctggccggcagaacaaacagcagaggtgccatggggatggcctgggggacagagcaaccgatggaatgcatgcgatttgctatacgtgatttactcctcacctgagggggccgagccgctgccctggcactgctccctacctgcctggtggagggcactaccctgactatgacgccaatgcctgccctcagaccacctacggaggatggtcaatagcatccactaacataagcccatcatgaatgattaacgtccacacctctgctgatatctgctgctgtacctaggaattcttgacgctacacatagtgatcatggcaaaaatggcatgctcagccttgagaacaacatgcatgctataaactgagtgacgtgcatgagaactaaataaggaacttgaccatgactatgcattacaccacacgaaagcagagccctcatgatctttatgaagatgcccatcctaaaatgagacattgcgaatgaactctttattgagaaaaacacaagatctgtgggttatgttggcattgacttcaggaatagaaccctgattagttttaatacccggaagcttttggtaacataaggctttgtaaacgggcctccaaagggcacaccctaggaggatgcgaaacccgttgcctaattatttcaggcactcgaaagactcttgatgtcctttacccagggtttcctaaccaacagcctttgaaaacgggggctgcccaaacccttcgttttttagaaaaaaatacccacctggacattaaatttttttggagtggaccctgcacctaatctcagttttgcaaggagcctcaccccgtaatggataatttctaacccccaattaatacccactgaaccctaagaa

SEQ ID NO: 798 - DNA, 7465 bp, Homo sapiens
  misc_feature (1)...(7465): n = A,T,C or G
atgacgcgcaccttcagtcccgggcgaagactcccctgtgaaactggggagatttgggatttcggtgggagtgaaactagaccttccaggtgatgcagcttctgcttggggctcctagaatgcagctgccattctgggatgaagcccaagcagcccatggagaggccctggagagaaaaggaggccccggcccccagcagggagagagccagggccagccctgtttacagcaggggccccagcagggagacagccagcgccagccctgtttacagcgggggtcccagcagggagagagccagggacagccctgtttacagcgggggccccagcagggagagagccagggacagccctgtttacagcgggggccccagcagggagagagccagggacagccctgtttacagcgggggtcccagcagggagagagccagggccagccctgtttacagcggccccacccccaccggggcagagaggcccctcccggccacgccctgcccagactgcagatctgtggacacagcacagtggtcctctgggctctacgctttgggttctctgctacacagcaggctctgggcttcccactgcacacccgacccatatgtgccgggagcgggtagcggaaaagatgtcaggagcccgccggggtctgggagaggctcaggggcctctgtgaagcgtgactttggcagggatccgtaggtcaggcaggggctggcttggcttccgggaagcaccacacggaggccgcggaacggcttgtgcgaggcccgaggcaggaacacccagaggccgggatgcagccagggccagagggccgagaagagagggggatgggcttcctcgcacccgccactgagcgaagacctccagggctaatttgcttttccgctgcctggcgtgtggcacagctggcactgggaacccctgctgagagcagccgtcgctggattgttaaactctgcaattctgtccgtgtgtcttcatgttctcattcaggcaaagaggggtttggggtgggctccaaccctcccgtcctgctctttcctccagcgatttggatgtgcttgtccaggttgcactggggcgggatggggggcgcacgtctccctcccgctgggctccctcgcacccgggcgtcgggcaggcggcagtcagaatattcagcggtcaggtggcagctcctcctgactcccaggcgtccgggagcccgcgggtccgcagatggttctgagtgagcccgggttcctggagactcaggcgttggaggggctggagtcctggggaacgggcttcccggcctctccgtggggtgcctgggcgtcacctcagagggcactgtgttccaggaggcccgggtagacgccacatcgccctccagacctgatgtcactcccactgaagccccaaatcctgtgggcttctcagggaggggtgagaccccatgtctccctgcagggagggcctcttgcaaaagaacatgagtggtgggggtgcgtgggggcgggagccgggtgaggcagaagttccttatttggttcccagcctgccactcattggatgagcctctggaaagttccctggatgctgcatccatgtttcccctgatcagggtgtgaagcaccaggaaggccctggtgcaggagccaagctcgccggagctggtgctgctgagcacatgcacttggcatctgctggggggtgctcctcaccctcctcctcacggggtccgggggctgggcctggggtctgagcatgcgtcgtccccttaggagggcagctgggatgtggagggacgggatgcgctcagcgggtcagggcggggcgggtctggcctgacttggctccaaaaagttggcggcagctaagtgtggggcaggggctgggccggcacgcctgctgccccccgacagaccagcgccatacactgtgagaaagaagcatgaagacagcagaacatctgaaaccttcgtgccgactcacatcccctgtgttaacgtttagcgcatgtttctggagcgtctgctgggtccagggaaccctccaagcacttctcgtggaggatccctcccatccctgtagccgcctctgaggcaggtctagacccgtccccatggaggcaccaagaggccagcagcctcacccccggatcacacatcagtgagggctggagccgggaccaggtggaggcgggcggccccacatctgtgccatggatcacagactgggcagcctctggagcattctacgtggcctgggtggctgcgctgccgtggcaggtgtagctgtacagcagcagcgccgaccgtggtggctgccaggggaggcagaactgcctggtgttctgaggtggtgctcaagaactcaggtgtttcccaacagctgtttctgccttaagtggcaaagtcacagctgggaaacctcagtgcacaacaccgggaggccctggagggacacggctggagcatggactcaggccacggggacaccggtggatgacccacgccagggtcaaaggccacgggaatacaggtgaatgacccacgccagggtcaaaggccatggggacacaggtggacgactcacaccagggtcagagaccacagggacaccagtggatgacccacaccagggtgagaggccatggggacactggtggatgacccacgccggggtcagaggccacagagagagtgcagggaaaacaggagcaagaagagaaagtccctggctgtaagtggagccccctcccctgcagccctcagcctggagccctggcagccagtcacacctgccccaggctgagaaagggggttcccatgagaaactgaggggccagggcaaagggccaagacttgcgtccagcagggtgggtgccgcccttgcttggtgggtccctcttgcccaccgtgtagacaaacgcctggagacacaggtgaaagcccacgaggggccctggggagggcggctgtgaagacaaacgcctggagacacaggtgaaaatcacccagagacgcaggtgaaagcccaggagggtccccggggagggcggctgtgtagacaaaagcccggagacgcaggtgaaagcccaggaggggccccggggagggcggccgtgtagacaaatgctcagagatgcaggtgaaaatcacccagagacgcaggtgaaagcccaggaggggccccggggagggcagctgtgtagacaatcactcagagacacaggtgaaagcccaggaggggccccggggagggtggccgtgtagacaaatgcccggagacacaggtgaaaggccaggaggggccccggggagggtggccgtgtagacaaaagcccggagacgcaagtgaaagcccaggaggggccccggggagggtggccgcgtagacaaaagcctggagatgcaggtgaaagcccaggaggggccctggggagggcggctgtgtagacaatcagagacgcacgtgaaaggccaggagggggcccggggagggtggccgcgtagacaaatgcccagagatgcacgtgaaagcccaggaggggccccgggggagggcggccgcgtagacaaaagcccggagacccaggtgaaagcccaggaggggccccagggagggcggctgtgtagacaatcactcagagatgcaggtgaaaggccaggagggggcccggggagggtggccgagtagacaaacgcccagagacgcaggtgaaagcccaggaggggccccggggagggtggccgtgtagacaaaagcccggagacccaggtgaaagcccaggaggggccccagggagggcggctgtgtagacaatcgctcagagatgcaggtgaaaggccaggagggggcccggggagggtggccgagtagacaaacgcccagagacgcaggtgaaagcccaggaggggccccggggagggcggctgcgtagacaaacgcccagagatgcaggtgaaagcccaggaggggccccggggagggcggccatgtagacaaaggccaggagggggcccggggagggcggccgagtagacaaacgccctgagacgcaggtgaaaggccaggggggccaggggagggtggccacagctgcttgttcactgtggtctcacttctaaaacttagggacacaggttaatttcataaaaatgtaaaagacaagaagaagaccagcttttaaaagcaccaaatctgtttctattcaggaaatgaattcgtgaattgttttatttctgcctttgcctcttacggagacttctccttcacaccttgctggccaagcgaggtgcttgcggggaagaggatcgagtggggcaggcagaggttttcctcttctctagatttgggggtatggggatggttgcggtgtagcagggcgagccgcggacaaaacccctcagacaccgggttaaggaaggatttggctttattcggccgggagcatcggcagacccgtgtctcaagaactgagctctccgaagacagattccctggccctttttaagggcttacaaatctaaggggttccacgtgaaagggtcgcggtaggttgagagcacatgtggttagagtggggggataatcttttaacctcaggcctctggtcatcagtggcaccggctgatcttgccactgacttcattcctgttatttttcagcttttacttcctccttctcttcagagacaggagacaataagaaaaatggcctctctcctcagtagggctgtcccaagcacatgggagtggctgcaggagaaggccttgctgctggaggggctgggtccctggagatccagggtccgcggaggggtggggacgcaaagacccccgtgagtctcctgctgcctcacgttccgcggagctgctcactcgcttgtttcctgaagatgtttggtcagtgtcttgctgcaacctcccggtctcggcagtgccgcgggggccgtcgcctgctctggggagtgagacggaaggagaatgtcccacagacgaggcaggagatgggggccggggtcctcgggcttctgacaggctgcgggggatttgccgggtcctcccagcaggtggggtgggcacccaggccgcctcatttggacgttaaggaaacgtgggtgactccagagctgtgaaggaccggggcccaaggtccaggttacagtgtgtttctctcccacacacgcttacccagggctggtttcagtgtgatgccgaggcagcatggctgcgcactttaagtctgagcccccggcgcttccctgccttcacgttcagctggtggtggaggcactgggcccttctcaggcttcctctgctcggtggagggccacgccacccctgccgtgccactcctgtttctgtgaacatgtgcattttgaattacgcatattcaaagtgcctgcacgttttgggggagcgtgccactgcgtcactggacatgggtgcgcctggcccccggggacaggtggtaggaaaacccagccagagctggctgcgggatcaagcatcaggcagattagagaggagcgcatcctgctcattggtgctcatttttttcacacatggaaccacagaaccctcaaagccaggacgatgcgggtcccagggcgctggcgtccctgagatgccgtatctgtggaacatgcaggagtgggccgatcggggtctccctgcacacccagcctttacttggatgtctcttgttttgcctcctggcatccttggacccttcctttggtaacagggccctgcgtcttcctccaggaacctcccaccccgcaggctgcatctggcccgagaggtgctggctccacccctcgctctgtagggccaacgacctggactggccagtgagcaggtttcttcccccagctgcgtcggtgggtcagagtgagcaggtgacccacggggccggggggggcacaggcttccctggcactggctggggctctcccagaaagcatgagacaagggcctaagtgtttgtagcttactgggaggcgatcccaggaagcaccaggggtgtctgtctgtgcatgtttgagttcacatgtatgtaggtgtatgtgtgtatatgtgcatgtttgtgtatgcatgcatgtgtacctgcatacatgcacaggtgcatttgttcacatacatgcacacatgtgtatatgtatgttcacaatccatgcacgtctgtatgtctatgtgtgacttcatgtgtgtgcatatgtacgtgctcacatgtatctatgcatacacatgcagcccatgtacgagcatgtgcatttgcaagtgtgtatgtatgtgtgcacatatgtgtacatgtatgtgttcatgtctggacgtgtatagctctgtatctgtgcacgtgtgtatgcggggcatgtgtgtatatgtgtgtatacaagcatgtgtgtggcatgtgtttacatgtgtgtggcatgtgtttacatgtgtccaggtgtgtttgcatgtacatgtgcttgcatgtgtattcgtgtgtgcatatatgtgtaggtgtgcatatatgtgtgtgtacatatgcatatgggtttgctggaatgtctgtgtgtctgtgtgtgcatgtgtgtagaagtgtgtttggaagtgcatgtgtgcatatatgtgtgtgtatgtacatgtgcatatgggcttgctggcatgtctgtgtgtatgtgtgtgcatgtgtgtagaagtgtgtttggaagtgcatgtgtgcatatatgtgtgtgtatgtacatgtgcatatgggtttgctggcgtgtctgtgtgtctgtgtgtgtagaacgccgtaaggatggagttcaggattcactgcaggctgtgcacagctaagcggctccccggttgcaacgcactagtcagagctggtcagcatcacctccagtacaggtctctgtgggaggccagtgacggcctctgaagacctcgggtcttaatccatggagcctgtggctgtccccgggtgactcagcacccactgtctcagagtgactcagcacccactgtctccggggtgactcggtgtctactgtcccgggtgactcggcgcccactgtccccggggtgactcggcgcccactgtccccgggtgactcggcgcccagtgtccccggggtgactcggcgcccactgtccccgggtgactcggcgcccactgtcccaggtgactcagcacccgttctctcttggatgactgactcggcctccccagggtgactcggctttctccttcactctcccccagtgatgcatgacaagggaagtcccaaactgcggctgtaacccgggaggcttctttgccttcactcaagaatgaattcaagaacccanctggtggtgggagaaaccagtttacaaaggttgcagggtttgaaacccccccataggcaaggcgtttaagggaatcctcaacaaaacaagttttgcaaccttcttttttaccacacccttaatttttgaggcacatg

SEQ ID NO: 799 - DNA, 8943 bp, Homo sapiens
aaacctggtttcccttcaggccacccattaaaccacccccgtgccacccccggggaaggcacagcaccacattgaaacacaccggctcccccggaacacacacccgttccccccaggcagacacccgctccccccggaaaacacacccgctccccttgggcacacacccgtcatgaaggctgcacacaggtctctttccccctgcccgccacggggtgctggctccctgggtgttgcccagcctgggcccaggcctttctgtccggggtgaggcaggtgccggtcagggcattggaggtggctgctcacaccatgggcacctcccacaccaaatgtcccaggcccccaacaggaccccaagaagcagcccggccttggccccgcggatcccggcacccttagctgcagctggggtctgtgcaggctgactactctgaggctcctggcaaggccacagccacagggccagcccgtccccctggggcagcatgttagcctgggggccccctggcaaaccgtgagcaggacgcacccccaaatcttcactctggagcttgtccaccccccaccagccccatggtgtttgaggccagaaccagtctggggctccagagggaaagcgggcacgggactggggtgagctaagttgtggggcctcggacaggtgaggtggggacctggtcctaaggccccagggggacaaagatggaggaggggtgctgggagacttacagagtagcctctccccgagaccgcatgcgcagagctctgcaggaaggaagaggggacagtcagtgaggctgccactcggaacaaactcccagggatgcacccgacagctgccccgcagccctcagcccttagccctgccccgcagccctgcagctcacagccctgccctgcagatccacagacccgaagccctcaaccctgcccggcagccccgcagcccacaaccctgccccacagccccacagccctcaaccctgccccgcagccctcaaccctgccccacagccccgcagcccacaaccctgccccacagccccgcagcccacaaccctgccccgcagccccgcagccctcaaccctgccccgcagccccgcagccctcaaccctgccccgcagccccgcagccctcaactcggatggggacaggtccagatgcccagacccaagaccaccagcgagacatcctctcaggcaggggccacgagggctgaggccgcagggaggaggacagagttaggcgtcgtggtggggtcctccccaggggctgtcgtcctcctgaggggcccagacagtctgaggctcccctgcagcagctctgggatccaaaccccgaggaggctcccacagggacgcccttggctagctccctgtccccaagagggaaggccccaccagaaatgctcctcagaggaggcaggaagacctgggggaggtcagcccagggccccagcttctgctgacctccctccgtgcccacccgccagaggggtccatggttgcaggactttggggagggtgccctggctagacaaggaaggcttccgggaggaggtaccagatggagccctcaaaggagggttcaccacaggggcctgacaggtggtgggggttggggctgggggatggtagctgggggcccctcagacatcagggcacactctggtctgcaggggcagctaggggccccccacacctctggtggggatccctctggcctgcaggggctgctgaggtcccccacacccttggatccctctggctcgagtgggtgttgtgaggtcttcaggacagaggtatggatcacaccagctacacactcagaccaccagggcctcccccagcaggaggggtggggaaacaggctcagggctgctgtagtggatggggtgggtcactgagctgggcaagtggggctcacagggagggtccagagccccctgaggagtggggggcagatgcaaagatccaacaccccctctgaggggcaaggcagaggaagaaaaggagggctttggggccagctgacggcagccctccactctcccaaatcaatccacaacccccactgcagagtcagggaggacaccccctccccttcccaagacagacccttgccggggacaggtcagctcctgaagggccccaggatgtcaggggacagagcccaaggccctgggtcccgatgggcccacccgccagctcccagctgccagaggggtgggagggccttcgttgccctgagtatgagcctcagccccagctgctgcattgtgcccagaatgtgactttcttcaccaggggctggcaattagaggacaaaccaaggcagcggcagtcccaggtaattcccagcctattttcctaacttgtggcaacaagatggggagccgggcagtgaggccttcatttaaatgataatgagatgcctcaagttccagtcagcagaaacctccccactgccccgccagtgcccatctcaagactcggcggccgtccgcctgccctccacccacaggccagcagtgcaggcacagcgtccaaggcttaacgttttggcctctgggctcctgccagctcactcaccatttcttcatttaaatctctcctaatgggaaagtcctaatgagtaaaaaatcacgctttaacgaaggcaaaatgctcattgctaagacaaagccttggtgggaaaccggaccctaaccagcggcttcctggacgcccttgtgcagggtgcagcgggcagggggcccagactcggactggacgcccttgtgcagggcacagtgggcaggcggcccagactcggactggacgcccttgtgcggggcgcagtgggcaggcggcccagactcggagcctccgggcgcgggcagctgggtactcacatcgctgagcgggtcccgggagctggtggcttcgaggacgctgtcgtcgtcactgtcccggtcgccccctttggacacggtgaccttcatctgggacagagagagacactgtctcaggcaaacccccacctcaccgcgtccgcatcggggccccctggctagggctacatgcctgctcccggcaccccagcaccccggccccaggcgccccgacagccgctgggcgctttgggatgtgacgagctgtggtgggctgggtcctggtctgggggcgggagcagcagcaggacagagctctgcacagccaggaatgccatcccagctgacagcgcacacactgataacacactctaccaggacggggaggacctacccaggacccaccggctcagtgacacgagaaccgccacgtgcttggagccgccccttccacaagccgctgactttgaaggcatcctgggggtgctagggaccacaggcagggcctccacccacaccctggctggttcgcaccacccaatttggctggacaggggctatgacctccaggtcagccctcaatgccccccacattttcccctgggctggggcccacaaaacctcccttggttgggttccttgccaaaacaaaaaaggaaggggggggttgggaccttgcctgaccctggccatgggcccctgggccaatggtttggcctcccccgtgcctcagtttcttcccctgctgaagggagcacccatactcccttcaccccacccacacgccccaggcccaccgccaccacccttgacaccagccaacatgggcgccgatgcgtgccaggggcctggcccgggcgctttgcacacactcacacatttgctcacacggtggccccgagtagaaactattttcctttacatttcacggatgagaaaacagaggcgcagacaggttaagtgaccatgcagggaccagaccccgagccctgcatgtatttactttttttacttggaaataatttcaaacctgcacaaagctgagggaagtgagaggccagagctcctgctggccagcgcccagcagagacgcccctgcacagccagcgcccagactcacgtggaagcccagcggtctccctctctggccaacttggatctggaacaattctgcaccttgtagtgacacgccccagcacatctgggcccccaggcctcgcatgccagggcccctggtgaggttctttactttgagtcatccaagtcaggagcacgccccagcccggggaaacccgtcccaggactggctggtgtggcttgctgcagccatgagcctggctccctgccgaccttcggctcagccagaggcccgctctgtgcacctcctgcagcaacaggcctccctgggtggctgacagggtgcacacaaggcagacggtgccagtgcgaattaagggatgtcacccaggcccctgaggtcaaatgcccccggcccatgaggtccatcaagccgcacagtagcaggcacccacactggaggaggccctggccgggcagggatgtagccccgaggagtctgagccttactgggcgggagccgggggcagggtggtgggctagtgacctgctcagctgcacagtagccctcacaggccctggccaggctgcccggctcttcctggcactgtggcctcgggcaagcgactggcctgccccagcctcagtttcggcatctgtaactgtaacattcgggaaccctggcagggcccctcggtgcaatgaggtttaggtggaggcacggcctgtgcagcagagcccggggccggcaccttccaggccaccaggggtcactgttgtcaccagctggactctcacaacctctcctttctcacccccggagctggcaccacggtcccagctgggcagccctgcccaccgggtcccacacttgctgccctgctggggccatcaggggttctgtccacctctgcaggaagccacgtgtcccactcctagcggttctcaacgcggggtcccgggaatgcatcatcgtctcccagagcctgcaaggaatgagtttccagcccgctccaggaaccgtgtatcaccggccccctggggagtctgaccattggcgatggccccatgagccctgcactcacttctagggacagaggctcagggcagtacctggcagcgatgggaaaggctgccacagggctgctgagtatagtggtgcaggctgctcactgcccaaggacacctggccgatgggaagggaggtgggtcggaaacacccacacagctgagccgtgaggagtagggcacctctctacacttcacacccacacaaaagccacctccggtcagggctgggcgcagatggaacgcgtcacccccatgccacagaggggctcggtgggctgccctgcgtgtgctcctcccaaacccggaggccctgaaaggtggccaggccggtcgtggggtggggtctcttccccttcctcgggtggccggttttagctctgaaagtcccacgtctcgaaaaaccctgtagaactgggaatctgtgtcctggtcaccccactctgtccccaggcaggacctcaaacagccaaggtggctgccctcagcccagccgcttctcagtgctgccagccacaccaggggccggggaggccacacgtccactcccagcaggagctggagggacaagatcacagtccctggatgacaagtccacgtctggggccagagggggccccttttgccctggagggtgggcaggagctactgcacctgtgcccaccccagccttgtggtctgcccacctatctgtccacccgtccaaccgatgcttatggagccctgacgagccaggtaccgttctgggcagtgagcagagccgacccaagcccctgccccccctagagtgacaaaggagtgactgttcccagtgcacacagaaggtggctccgtctgccaggcggcaggtgcggggggaaaggcagcgcaggccggggagggccccggacacagctcactgacggcaccaacggcccagcacacacactgcagccctgagttgccctcctcacagggcaccctgctgctccaccaagcctgtgcttcctggggtggggaaggaaggctgagtctgtccagttatgtcagcaggtggggcgtgcagcaggagcagggcaggaggaacagctccctgtgggccagcatggagcgcctgtcagtttctgtgacgtcagtatccaaaccaaagctgatggaagccactaacagtttaacagccggcttcaaatttcctgaaccctcagcaacctgctcctacaagctgcactccactgggcagccgcagaccagccgctggtgggaccaggagcactggggccctgagggttctggcagtaaccgtaggaacatggtggctccaggcgcacagagcccctcccccaaggtcccctcccctcaccaaccccctccctccacaccgtcccccagctccaggctgcacgtccaaaaatcactgcctctgggttgcccacagaaacatggttccactgggaggctcgggctcagtcgggggctcaggtgcggcctggcctgtccggttctagtgcccttgagctgtcctgttgctgggaaggggccagagagacgggagccagcagtggccccgccatgcagccaggaaaccctctagggtgcacggagacccgcaggcacacacaccaccccaggctgaggggccacgccggctgcacacagagacccacgcagacccacaggcgccggcaggctgaggggccacgctggctgcatacacacacccacacccctctctaccacagcagtcacactggccctgtacacacctcaccccatgcacacggactcatcgccccacctgctccccagacccgccccaaggctctaagcacgcactgtcctgcgcaggccccgcccaaagtggagcacccaagaggccccacaccagcccccgtgtcctcttgtgcaaactgagcagaaggtgccctcccggggaatgtgcaatggtcagggcaaatgcacgcactacatacggcacggtgggaatggcagccctggagcggtgcagtgcacaactctgacagccatactctgcagccctggtgaagtctcacaccaatcggatcacaccagggcgactctcacaccccatcccatggcatcacattcagacaaggactatcctacaggggcatgaactgagactggccggccacgatgcctccagcctctgcacctgcaggcctgggagcgagggtgagagtcgggggctgcctgggctgctgttctaatgcagaccctggagaaccctgagaaggggcctacggcttcctcagacctgccaggccaaggacaggccccctgggagatggggcagaggtcaggcccccacaccccctagttgggctgggccacagttccagcaggagacgggaacgcgacgcccctgcagaaatggagcacaggtatgcagaggcggagctgccgccatccgtgtctgagtggaaatgagtgtggacacagcgcacccctgccccagccccacagcctgcgctccctcctcctcgcagctcccgcttcctcttaaggagctgagcccctagaacatggctcctggcccagtgcaaacagtgctccctcggggagctttcaggactcctgggcctcccccagggactggatgtcatgggtccagacttgagactttccaagttccccacccaccaaggttgagcagcctcaggggactgcagtgggtgtccagctccctggctcagggcagggcagggcagggcaaagagggagtggctgctttcgtccacaacactccatttccccacctcccacagtccctaccagctcccagctggtcctggtttcctgcctgttttgggagcccacaaagccgtccccgaatcctgagagcaggtgcctggcacaactgtgggtgggtggtacctctctccgctgccttcgctcccgacgggacagtcccagagccctcacagtgtccccaggcctggttgagccatggatgatgactatgggcccctcacattcagcaagagcagagcccgactctggggcccctctgtcccgaacctgcccaggccacagggacttgcaggcagatgctacgccctgccttcagccctaccacagtcccctgctgctacctcctgggggctgggctcatgtccctggtcgggaggagccgatgccgcacccacagcacgtgacaccagcgactgcatcctgctctgttttgtggactgttgtccccaccctcgggcgtttggagggcaggggctttgtggcagtcactggtgctgctccagaacttgtactcctaaagtgagcctgatggggaaaggaagagacccacttacggcgtcaacctgagcatgggctggcttgggaaaattgccatctgcaaagaaagacatgggagagccctggggagcgtcccagacagcaggagcagccagagaaagggagctctcccacagctgctggacgtatacaaggagggtgtgctaaaggtgtgcaatgagggccgctggaaggcgcacggagggtgtgctggaggggagcaaggagggtgtgctggacgggtacaaggacggttgctggagggagcaaggagggtgtactggatgggtgcaacgatggggtgctgcatgagagcaacgagggtacactggacgcgagcaaggaaggggcgctgatagagtgcaaagaacgctgcgtacctgctggtggaggcactgaaacaggggctcaacttctgaccaagcatacaatctggctgtacaaccttggagctattttaccacttgcttcaaggtaaaacctatagactggaaaagtccacaacgttaatgataccagttcaggggacagaaggttgcccatcttagaaggccaagggcagattttggttaactggcaacattccctgccgggattaacccaatacttttccgtcctcccttttaaaacccg

SEQ ID NO: 800 - DNA, 8406 bp, Homo sapiens
  misc_feature (1)...(8406): n = A,T,C or G
ttgacgaatgagcgcctcttgccagccccgtggtgaagacgtgttttcaaagttgagaaatccctagctagatcaatcagaaaaagaaaacacaaattatgaatattaggaacaaaaggggaaatatcattacaggcactatagacacgaaaaaggtgaaatggggacaattttattccaacaaattcaacagcttaggtgaagtgggcaaattacttggaaaacaaaactgacacaagatgaaatagataatccgaatagtcttttttttttttttttgagatggagtcttgctctatcacccaggctggagtgcagtggcacaatgttgcgcaagctctgcctcccgggttcaagcagttctcctgcctcagcttcctgagtagctgggatcacaggcaagtgccaccacgcccagctaatttttgtatttttagtagagatagggtttcaccatgttggccaggctggtcttgaactcctgacctcaggtgatccacccacctcggcctcccaaagtgctgggaacaggcgtgaaccaccacgcccggcttagataatctgaagagtcttacatctgttagatggagtttctggatgtccacgttttctgtcttcagtgccacctcccccagcctgctcagcaccctgtcgccagcctagcctaacacttgaagtcttttctgatcgtaccaggcacatttccaccagttaacatgcatcagcttgtttaactgcaaccctgtaactattcccatttgccggatgaggatgctgaagaaaaaaagccgcctgtaaataacttgcccaaggttcacacagtgagcagctggaccaggattcaagcccagcggcttggctttgttgtggaatctgtaccctgggccattacctggagggcagctttctgggcctcagttttcctgtctgtaaaacggggatgttactaaatagttcatttgttttcgggttgttgagatgataaaatgagctaacatgcaaggtttgtactgtctacatagctgccatgatgatatcgattcctgcttttattattatgaattctcagagtaatttctcccgcctcctgggcccagcctggctggtttgaggcccagacgctagaggcttatctttgtcccggttgccaggcaagggtcctcctgtgcagggcctgtggagagaggcactcagttaatcagtgccttagacactgggcctgggcctgccacctgcagggagcagcaggctgggtcacagggtcctagagcttcctcccacctgacagggccctcctacaaaccaagagttggtccaggggaaggggccactcaggagggctgggggccacgccggccagggtgctgttaggtgggagtggaagaggaaggctgagcacctgggcctagcaggcactgctccccacagcctggggctagccgttccggggcgagcatggccacctctgctttcccagcctcactctggtcgggaaggctcttccgactggcatccattttgtacttttggtcattccgcccctgttctgggcctggggctgcagtgacaaacaagacaagtgaccgtgctgccctcgagaagttaaactataactgggacaacagcagagcgggtggagactgttctgagtgtgagcacagctgtgcctgggaaggagagaaggcaccgttagaccaggcggtcagggaagagcgctctgggtagagggtgtagccacccaggcctctggtggcgtgtgcctgaggagccgagcgggcatggggtgggcagacagggctaaggaggggcctggtctcatacagagggaaaccactgagggttttaagccagggaacaacgtgagctcctgtgtttttacaaactcgtgggggaggcagcacggttgtgggggtggtggcgcctgtcgggaggctgctgcagccgttcaggagggggtggcagtggcttgaattaggtcattcttctgttggacagggcgccaactgagcaagaccaagtgatgcagcccaggcggcaaatgtggtggagccaggagtccagtggccccaactccagagctggcggcacacacctgctagagtccactctgacacagcatagctgctgttcccacccctcctccggcacacaggactgcacaggcagggccttgcagacacttacctgcacttgcccacacacactagtgtccccaagagcctgctggcaacgcacttcctaggccttaactcagccagcatccctcatatcatctgtagtgtatctcatccatccatccacccatctgtccatcatccacctgtctgtccatccatccacccatgcatctacccatgcatccatcatccacccatctgtccatccagccacccatgcatctgtccatccacccacgcattcatcatccactcatctgtagtgtatctcatccatccatccacctgtctgtccatccatccacccatgcgtccatcatccacccgtctgtagtgtatctcatccatccatccacccgtctgtccatccatccacccatgtgtccatccacccatctgtccatccatccaccatgcatgcatgcatccatccatccatccacttgtgcatccatccatctacccatctggccatccatccacccatctgtccatccatccacccgtctatccatgcatccacccatctacccatctgtccatccacccgtgcatccatccatccacccatctgtccttccatccacccatctgtccatccatccactcaggcatccatcattcaccccatgcatccatccacccatacatccacacatccatccatccacccatctacctgtctgtccatccatccacccatgcatccacccatctacccgtccatccatccacccatgcatccatcatccacccatctgtccatccaaccacccatgcatctattcatccacccacccacccgtctgtccatccatccacctgtctggccatctatccacccatgcacccattcatctacctgtttgtccatccatccacccatgcatccatccatccacccatctgaatcacaatagaagaaggtggagcagcgtactggagtgtcccgcactgggcgggcagtaccctgctccctgacactgtgctgactcagggaacacttggtctctcccaaacattgcctgagtccctgtttactgtgtctgcctgtgctaggtaggcaaggataaaagacagccccgcccactggatgcttacagtctactgaagagagacacagaaacaagcaaccccacttctcttttagagagacacttaggggactgtgggagcctggaggagctctttacctagcctggttggcatgtggagtgaatggagtgtcaggaacggtttcaggaagaagcagggccacagccatactgcgtggtgttagcctggaggaggggatggcatgctttgctaataccagggtcctggagacagacaacagagtttccctcattctggagcttctgactccccactcccaactctgagagtcgttctccttcccataggctatgcagtctcatacagctgggctgcagtgccacacctcaccagtaggtgctgccttcagctcaatgtgactccagcctgagcttcgagctgtgggtgctaagaagtggctacccctggctgggcgcggtggctcacgcctgtaatcccagcactttgggaggccaaggcaaatggatcacgaagtcaggagttcaagaccagtctggccaagatggtgaaaccccatctctactaaaaatacaaaacttagctgagtgtggtggcaagtgcctgtaatcccagctactagagaggctgaggcagagaatcgcttgaacccgggaggcagaggttgcagtgagccaagatctcaccactgcactccagcctgggcgacagatggagactctgtctaannnnnnnnnnnnnnnnnnnaggcataattcagctgccacatgataactttcaatgggcccctcattttacctgcaaactgaaaggggggtaactccgagctgccctctaacctttgccttccttcctccactcaattttcttgccccagggagatgctctgagccctctcgcacctcaaaccctgaaatccattctccagcctgaacccacagggcagctttcttctctctgcctccccgtccagatgttttctgtagatgacttggcgtctggctgtgccctcccagccctctgccgcccacacactccgtttcgtgaaggctctattcttcctgatccagcttcctaatttttttaatcggaaatgttccaggagctaaattggcaaagaccctcctttatggatgaaagggaaggaaaacagaaagctttcacctgttcctgaatcttgccgtggtcagtcacggtaacacgtgttgcctgacaatccttttgtgaaggcggaacagccatcgggttttggaccgctggctggctgagcgcattcaggccggttaattcaccaaagcacaaaaagcaaagccggagttaagagatgcatgttcccatgcccagaatcggagaagtggtatcaacgggggcattgttagagctatttcagctacaaatgtgtgggaagaagtgaaatttttaaaaaagctgcattttaaggtaaagaaaattagcccccgaggaaaccgtgatgcatggtaagtatgaataccagcatagaggctgggaatcaatgtataacccacacacatgctcttgaaagattattcaatggtctgtatcagggattatttgtggcgttgcaaaacctagagcacaccgtcataattgtaagccacattcgtgtcacgaaattttttttattgtaaggcggagtctcactctgttgctcaggatggagtgcagtggcgtgatctcagctcactgcaacctatgtctcccaggttgaagcaatcctcctgcctcagcctcccgagtagctgggattacaggtggccaccaccacgcccggctaatttgtatttttagtagagacggggtttcgccacgttggccaggttggtctcaaactcttgacctcaagtgatccacccacctcagcctcccaaagtgctgggattacaggcatgagccaccgtgctgggtctaaaatgttattttaaaaaaggaatcaattgttttgttgttgttgttgtttggagatgggatctcactgtgttgcccaggctggtcttgccccataatcaaaatgttccagtgcgtcaggtaagagttgatccagcatctcaaatgttgccacactctgcctcacacagctgggtcaagttcaggctgcagaagaggctgcgtcaggtgaccggtcaggcacatagctacttccttccgatgcttggctgtgtcctggccagtggtgagttcagagtggaccaacatctcgtcaattgggctttatgatttcggggcctggccaatgttggtgtttgcctttgtgatgactgtgagaaaagactttgaagcaaatcaatggtgcaaaatattgaaggagaaaatgtccaacttactatttaaatcccattagcagagtcaacattgccatgcaaagggagattgctaatttagtttatatatagagagagagacagagtttcgctcttgtcgcccaagctggagtgcaatggcacgatcttggctcactgcaacctccacctcctgggttcaagcgattctcctgcctcagcctcccgagtttctgggattacaggcacccggcaccacgcccagctaattttttgtatttttagtagagacggggtttcaccatgtcggccaggctggtcttgaactcctgacctcaggtgatccacccgcctcggcctcccaaagtgctgggattacaggcgtgagcccctgcacccagctgagatgggtaatttgggataacgtcatcgattcattaagacaggtcccgcagatgcattaacccacatcagaggaaacagatgagaggacgctagaaatggggctgggaatccccaaaaatccccaggagaccccccagacaggaaactcctgtggatgtgagatgcccactggacatcgcagaagggcatggagcgggcaggtgggtgtgagaggctcaaaccacaggaggcatccaggccagtgagagaataggcaggaacaggcatggaagccacgaggccgggtgagatgccgggggtgagtgtggacagggcagtgagaggataggcatggaggccatgagactggatgagatgtcaggggatgagtgtggatggggtatccacagaggagagacagaggagaggctgtgggtaccaggtcctgtgaccggatgagaagccaggggtgagtgtgcatcaggcagaggagaggctgtgggcactgcgtcccaaggcaccccctcaggaggcggagggaggagagagaaccaacagcaaccaagccccatagcaggaggacagtgagaaggaggggatggggggtgcctggaagtctagggaagacaccgattccaggggaaggactggacgggtcggcgtggaattaggacacccggccactgcgacaggctcaggaacaagcacagacctcagaggctgggctgacatcattcctccttcggatcatggcctgggaaagccccatggcatctccactgagacagtcacacagtcaggctccagggaggggaacagactccacctctcaatgggcaacagtcagttctggaagagcaggaggtcctggaaacacctggggaaatgcgagcagcagcaggatgctggacggctcagcctggctggcccagggttcagaccctcccactccatgaccaggggcggcagctccccctgcagacgggtatccttgccggggcctgacctgccagtccacactctaggagctgccactggcaactgttccaccccacaccaatgtgtgtcagggtctttctgatgcaagttatggaaaccaactcacagaaaacaaggggatgaaggacttttaaacacaggcatccgggcgcctcagatttcacagagggctcagataacatcatcagagcacagtcatctccgcctctctctctctctgcccctttccatctgtttctgcctctctttctcttctgtttctctgtccctgtctctttatctctatctctgtctctgtctctctctctttgcctctctccatctgcttctctctctctccgtctctctctcttctctgtttctctgtccctgtgtctttctctctttatctctatctctgtctcagcctctctttgcctctctccatctgcttctgtctctctgtgtctctctccctctgtctaactctgtctttgtttctctgtccctgtctttctgtgtatctctctgtctcttaatctctatctctgtctctgcctctctctctctgcctctctccatctgtttctgtctctctgtgtgtgtctctccctgtctctctatctctgtctctctcctgtttctctgtccccgtctctctctctgtttctctatctctatcttcgtctccgcctctctctctctctctctccatctgcttctgtctctctgtgtctctctccctctgtctctctgtctctctcttctgcttctctgtccctgtctctctctgtctatctccatctccatctctctctccctcctgccgacccagccctgtcggcctcaggctgctccactccctctgggaccccaggggcctctgcaccacctgcaggtgcagactctcccctcctgctcctgcgaaccccgccaaaatcccaggcctggctttcattgggctagcttggatcacgtgctcatcactgagccaatcacggtgtccaggcgacccagagccgagacgggagccaatcagcagcgctgggtgttacactgggcagggcctgggtggccacgcccctcccctgaacaaggcggaccagggcagggagcagcggccccgggagggcggggcggacggggtccgcggagggagaggggcagggggtgcggcggctgcaggcggagcaggggctgggcctcccgtgggaccggaaggattgtgcggtgcccaggacagggcgggactttcacaaagggcgacaggaagagtgaattaccgggccccagctctgccactgtgctgtgtggcctcgggcagatcactcaacctctctgtgcctggttccccgcctgtgaagtggggccagcaagcgggtgctgtggggttcaccctgatgtgtgcgtgactcagaagggcggctgcacctctaagttactgtcacaggtcttcaccacggggctggaaggatccgacgctggcgcaattcaaa

SEQ ID NO: 801 - DNA, 8446 bp, Homo sapiens
  misc_feature (1)...(8446): n = A,T,C or G
ccccactcccaaacataggggagtaggtggttttccgtcaaagaaggcttcccccagtttgggtttgaacccggggcccgccacatggcccgggattgaccccagttgtatcggtgtggggcaacccaaaagggtgtggggggttccaccccggttggaatcttaagggtaccgtctgaacagggtttcaagtttgtgtccatagcgccggggtgttgcccaaagaaattccaaccggtgtataggctccagtgtccaaacggggccactggccctgcctggatgcccaagcaaccccactaggccccagaaaggattaaatcaagtgcccagggaccttggagagacccagtccctgaagacgaggccttaccagagctagcacagagggcaatgtgacccagaatcctgaggacccacgaggctacagggtcccttgcccagactgcaggcaggagccccccaccctcagccccctctgaggacctcctgctcccagcagctctgcaggtaaaatgctgcttgataaacacgctcctgtgtctccttccctggctctgtgctaacgagggggcgtgcagagccggcggggggggcgtccagagctgggaagggggtcgtgcagagccgggaggtggggcttgcagagccggcaggggggggcgtgcagaggcgggagcgggggcgttcagagccagcagggccaagagcagatggcagcagctgcaggggcaccaacagccaggccatgatgccgcgatggccgtggaggactcgggtccctggccttctcaggaggggctgcctgtggagcaccgccgggtcccccgggtgtgtgcacagagacagaggctgtactgggaggtcctgggaagcaggcggcccagctgtccccgccgagggccctccctcagctgccctggtctggcctggggagctgctccctgattgcagcagccggggtcctcgctctccgacttctccttgggtccagcccgtgggggtcaccggcaggatggagaggtgggtgcttccctgccccatgccttggggctgtatccctgccgcagctcctgtccactggaggccctttgtccccagccctggctctcctgggttcccagaaactccacttcctcccctctcccttctggggcgggcacatgtggagctgcagtcaaactctcagagacagaaagcagaagggaagccaacggctggagatggggcgccgtgtttcgtggggaccaggtttctgcctgggaagatgggaaggttctgggcaccgcgacggagggaatgtgcttcacgccacggagctgtgcacttgaaatggccccggggtcgattttatgttacgtgtattgcagcacattttttaaaataaataagttttttaaagcagacggcaaaaatgccaggtgcgctggacctcgtttgggcaggaaggggagtggctgcctcctctctgccacggtgcagctcaggtgcccgaggcccggcctgtgcctagtgagggctgagcacatacagatgggctgtttctgacaggcaggtttaggctctcgggacagcagaggcagcctcggggcctggggctcccaccccacgtggcaggggtgtgctgggaaaacatggggctccaggcgtgtctaaggcagcacctacccaacccgcagggccctgggctggggcctcgctcctgcccagtcctggcccctggaggacccttttgtctggcacctctcccacagagcccccgatgcttgcaccggagctgaggaagccgccgtccagccctgtggaaggtgacgcccttttctgttcagaagacaaagccgagaatgcggcaatgacctgcgccccagaggggatgacctgcgggccaccctgaccccggcccgttcccccactgccagccctgtgggcctgacccaaggctctgtcccccagggaagtccagccacatcctgcctgaatcacagaccccaagaagagtgagacgagaggcccgtgaacaggaccatggggcaggtgggcagaatgacccaccgtgtggagacaaaggcccccctgcctggggagaagaaaacacaggccccctgatcgtcccgaatagaggggccaaggggcctaaaatctccctcccccaagctccaagcaccacagcagacggggtctccagccctgggggtaagagatggcccacagcaatgagccgggctttcctgggttggtttcatagctgagccgccttgagctgggggacgccgccctcgacatccccagcacagacgccgccgtcgacgttcccagtgcagacaccgccctcgacgttttcccagccaggacgccgccctcaacattcccagaggggacgccgccctcgacattcccagcaggcgcagctcaggagcaccttgccatctgcagctccctgggggacgagaagaaacagcagccacccctttctcgggcaccttcagctccgccgagaacgcccgacactcagagaccctgctctttgttaaatgggaatgagacatgacacagacgcggggcagcggccactgcagcacgggttgtccactgcccagctctggggccaaaccctcggcgtcgcgcaaaccatacctcccgcgtgacggccgtgtccggcctgctcacctgtgcgaggcagccctgcagagcaggtcaccaggccacaggagcaccagaagagaagccacgtccactgcgagggccatccggtgtcatgtccctgcctccactcagccccaggcccacagctgcagccacgcagccccgcacagcgtcaccgtctccaggatccatcggcagtggggggggccgtctcccacctccctcctcttacctccccccgcctccccagggcacgcactccctggctcctgcgcgatgcccagcagggtccaaaatgcacctggatgcccgggagccgtcgtccgccccacaggcagccccaggagccatcgcccgccccaaaggcccccccgggagccgtcacctgccccacaggcccccccaggagccgtcgtgcgctcagtcgggtcgtagccttcattcccgtggctgatgatccaacagcggggacctgtgcggccccagcacccgttccactgatgcttggtgtgggcggtggctcgaccccttcgaccgcgcacgtcatacagggggtggttcctccagcacaagccgcgtgtggcgggcaagccctgagatggccccagcgcccccgaggtgcctgcacccctcccgtgagggcggggccgtgatgcgaagggctctcctgctgggtgaagtctcctcgtggcgttggcggtcgggcagttactccgccatcagccccagaggctcggcagagtctcctgagctcccggaagggagtccggtgctgtgagggccgcgagccaagcgggaggctcagggcctgtgtctattgcagccatttggccaaggatgtttcctgaggacgatgtcaacgaagggaggccgcctgggggtggggcaggtttcacagcctcccatggatgtgggtgcagtggggccagttccagctctttgtatcccacgagccaataaatgcctttttggcactggagccagtttgagggatttttttttctgctatttgtaaccaaagcctcctaacccatcaggatccctaatagaacagcaggaggggaaagagagagctgtggtgccagataggacaggcatgggaccccggccccggcccctccccaccagccacatgacggaggctctgtgggggcacagggaggccacatgtccccagtaggaacatttgggttggagccaggccaggggcagcctcacaagttaagacaagaacatactctctgtggctcgagtaaagatagtggcggggccgggaagacagcccagccccaagtccccatcggcctccgtgcccggagaccagagacccctgtgtgggggtcccagcacagagcccagctgcctttgtaatgaggggaaaccagcggagcaaggggttgggaatagaaccagctgtaagaaatggtccaaatccccaggtagaggtaccagggggtcaagccccctcacctggtctctgcccagatgtttgcttccaggaaagccatgcgtcagtcagctgggacccaccgagtgacaaacagcccctcatccagaggcacagaacaaccggcccacaaaatggcagagcaagctcagtgtcacgttgtcaccaccccaggaccctgccagaggacagacaggacaaaggtcctcagagggccacacatgaccactgctgagagacgctggtcacgtccactcagccagacctgtcacaaggccccacaggaagtgaaattccatctgcatccagcgtgggaagaggcagaacattcagggaggaccaccagggccaaatgtccacacggccccaggggagcaggcagggcctgggaggctcagaccccggttcgggccagaacatggaccccagggccagcaccacccggagccccgaggggctgcccacagtctagcgagtaacggctgaggggcttggagcctgtgtgcctcagtttcctcacctgtgacgtgggccatgatagcacgcccctcacaagtgtcctgggggccaagtgagttcagaacactgctcagagctcacctgctgctgatgacaagtcgtgtcacgggacctgttgttttatgacacactcaaccccaccccacatggagccccgtccagtcagccggccccgttctctgctgagccaccagccctgggggtggccgggccaggcaggagccccacagaggcccctcagtgagctcagcgcaggcccaagcaccgccggtttctctgccgtccacaccgtccccagacgggccgcacccctgacgcagggagggcttccaggctgcactcgccctcgccctccctgcctctcgctcagaacctgtcctgcccagccctgcatcccatgtccctgcctctggtcccgagccctgcctgccccctccagcccctcacgtctctaagcctgaacctccctcacaggcgtcactgcagccaccccacaaatccttcctgataccaaaggccagcaggctgggggacatttgggaggggccgggagcaggccctgcctttgctgcagcctgtggggggcttctgggcgggagaggtaggggcaggcccgggggatgggagctgtggggccagccctgatccgctcctcctgctgggtcctggacacaggatcgatttctccctgggatttgggcgcacccgtcagtgcgatatgccacccacccacccattcatccaataacccacccatccacccattcatccaccaaccaatccattcatccacacacccatggatccatctatccacccacccattcatccaataacccacccatccacccattgatccaccaaccaatccattcacccacccacccacccattcatccaccaaccgatccattcatccacccacctacccacccatccaaacacacatccactggtccaccctccacccatccatcaacccatctaggcattcacctatccaaccatccccccatccacccattcatccacgcacccacccatccatctatccatccacacgcccatcatccaccatccatccacccagtgatgcatctagccattcacccatacacctagccacccacctatccactcacccattcatccacccacccatccatccatctatgcatccacacacccatccacctgtctacacacccatccattcacccacccacccacccattcatccaccatccacccatccatcaacccacctaggcattcacctatacacctaccacccacccacttatccacccacccgttcatctaataacccatcctggacaactgctccctcccaggcagaaaacctgtgttctcatggaccttatatgtggccagggagatgaaaggtgtatggagggctctgccaactgtgggagggggcagacctctgaggagagctgatgtccagtgagggtcccatccccagctgcccaggtgaggaccaaagtcacagacagattttcctgtctggctgggcagctgtggcctcagggggctggagaaggcctgatgtggcctcacaggctgcaacccaagcccctgcctccacctccccgacttgtggggggtgggcagtgaggagccggggccactgcgggggccgaaaggacgtccatgctgagcacgcatcggccggctttgcatttcagggaggtgacaggagatttgcttatgtgttttatctttcacccaaggatcagtaaaatgtagttaattttaaaaaaaagaccaccagtctgttctgcacacttggtaaacgtgggaggcgtctgcatcacagccgtggaggcaggagggagcagggacgcgcaggaggccctgccaggcggccgaggaggagatgaagggacccctggcgtcctccttcccaggagcagcttctccatggacaagaaactgaattctccctggaaggaggtggcgtctgggaggaatcacagccctcagaccagagagcagggcatctgcgaggtcaaggaaggccaggagccgcagggccgggtgcacggtgtggagtctgcggaggggcaggtggtgggaggcgcggggtgagggctccggccctgcnctcacaagtaatgctgtgggcccagctgctggactctgggagggaaagagggggcgggaggtcctgaggtgcagccggaggggtagcatggtttgcccagggggaccccaggcagccgctggagctgccgtggggcccaggagccctgtggggtgaggcaagtgttccaggaggcggccagggaccctgctggattccaggatctcagggacccaagtaggaggcccgcctcatagagccatcagggtaaacaaacagcatttaaaggcaacagaaccctcgtgttgagggcgcctggccctggtgcggagctgtggtcttcggggctcagaaaacaaagctttcccaggaccttgaaaatgttttagaccaaagaacaaaagcccttgctccaaagtacaagaaaagaaaacttcgtcttagaaatcgatcgggttggctgacatgtttaaaaccggtgtcaccatatcagggaggcaggacagtgtctgatgccaccagggccaggccgacttcccgccctgctcagtcccgggccccgacggacccctgtgcggaacgactctgggtcccacagaacggccttgcccttgagttgccagcggctgcctggtggggatggatggagggttgagcctcgttccctgagagaatgggtggatgcattcgaaccccaggacctcgcccaggagccagggagggagggcacaacttggggaggtgaggggcctggggaggcgaggggggcatgggaaagtgagggagcctggggaggcgagggggcctggggaagctcccagcccacgacaggaccagtgctgtcacctggagaccgggcgctgacggcgggaactgcagccgccactctcgtgggggtcttgtgctttggtgcccgtcagggcccagtgaagatgcggaaatccgccaagcagggctaagggcccagtgaggaccacggagtgaggcggaggctcttcccacggaggggacccagagcggcaggaaccgccatcccccagcctgcaggtgtgggaggagaggccgcctatgcagggacacagccaggccaatgacattgggggacggagaccccgacctctcgcctcccaacctctgaccttctgcaggtgccacaggggctgaatctgacccagaagcctgtggccagtgccacagtcacagcataggtgggagggcatctccccagccagggtcagccacctgggttggctgcgggtcaggacatggacaggctgagccacgtctactgtctggggaaacactagggtctgtgggttcctccctggtggatcctgaggggctgtctctgcagggtacaaggctgtgtccataggccccggggtcccccaagagcttctgctgttctgaggctcctgcgtccaaacgggaaccacttgccctgccctggagcccttacaaccccacctttgcttcacgtaaggagccaaatcaatggccccaggaccacggaagccacccccaccctttaccacaaggccccaacagggcgttggccctaagccaagggggacccacaaattctgaggacccaccaggttacggggtcccttgccccaaattgaagtcggaaaccccccacccttagcccccttcgaggacctcttgttcccaaaagtttttgaggtaaaaagccgctttgttacacacgcctccgggtctccttcccg

SEQ ID NO: 802 - DNA, 9664 bp, Homo sapiens
  misc_feature (1)...(9664): n = A,T,C or G
tggcgcggtggcgcggctccttccacgcacgaggcgaagacagggtggggtgaggactggcccccagcacctagtgccccaatctttgcgacagttgggagcccccacgaggatagttttgtcccctccaaccacagtgtggggcaacaggcaatgcggacttcagagcccaggccgcccacacgtgtgcctgctatgtctccagctaagtggaccccatggatccttgggaacaggatccatgttctcaacagacaagaccatggataacaaataagcagctgatcggagatcatcgctgggtgggatcagggtcctgagcaggagctggccgcactcgtgtgcaggcgcagtggccaccactgcacggagagctcgggggaggggccgcagagccctgagtgccaggaggagccagactggctgggactcgaagaagagcattgggggaacgggctcacccagatccctggtcagagtgagcttgggtgtggctgggctgaggccctgtgacccaggggccggtccctggggccaggcctgggagggagttagtttgattcatangaggtcctgagacggaaggggcctgggagggtgtgttctccagctgcctgtccttctaaccagggctccagccccacgttctcgccgacgcagggctctncaggcctgctcccttggcagctctcagggaaagttcagaaatgcatcgggagatcctggggcccgaggcaagggtgccaaccctgcagccccaccactcccctttcccatccccagctgtctcttcacgggcctggactggaggtcaagggctgcctgaattcttgcaagggcccaggcaagcacggactgtgcccaggtgcactgggtggggggccttccaggggcgaccccaaaccaaaaacctttccctggcagtgatggccacggggccgccacgtggcacagcctctcctgagggcttgagcccccaccgggaggcaccctcgcaggcgggcgcacagcccatggggccttggcactgtggggagggtgcacaggcaagtccggctctggcgtgtctgctccagagcctcactcacctgcagctcctggaggctgtggctgttggctgcagtgacttgattgcttgttaattgctcattaattgggtaattagtgctttgttgtgctttgaagcctaaatactcataaaaactgaatttgctgagtaagcaaacatagcatttttcttcaggacccaccacccggttatcttgtgtaaccaggttgcaagggtgcctccacctcccaggacagcgagaggaaggtgggcctcagtgtggcggggccctgaccggagggtgagagtggcctccagggcttctgccacagattccagagcctggattcaggattcagaacccacccagtcacccccggtctgtgccctggtgggctcccatgcactcagtcctcagtttccccatccggcagcaggtgggtctgtggcgacttgcaagtgagcccagtgtgagccgcatccccacacactgcccggcccccacccctcgggctccatggcagctctttccaggcgcctgctcttccagtctccagagaagaaaggcctggggagcgggcggagagtgtctatgctaggatcagggtcagagagggaggagctggccgtcaggtgggccaggaagcctcagtcccatgccccggccctccagcccgatgcccacccagtcctgccctccagcccgatgcccacccagtcctgccctccagccccgtgcccacccagtcctgccctccagccccgtgcccacccagtcctgccctccagcccgatgcccacccagtcctgccctccagcccgatgcccacccagtcctgccctccagccccgtgcccacccagtcctgccctccagccccgtgcccacccagtcctgcccttcagcccgatgcccacccagtcctgccctccagccccatgcccacccagtccagtctcccagccccatgcccccacccacccagtcctgccctccagccccgtgtccccacccacccagtcttgccctccagcccccatccacctagtcgtgtccttcagacccatgcccacacagcccagtctcccagccccgtgcccccacccacccagtcctgcccccagccctctctcagttgaccccaggtccctcccgccaggtgccacctcccctcggccttgggccccattccctgtgggccaccctgagagtgcgcccagctggtcccggccacctacccaccctggcccgggccacctacccactctggtccctggcacacctccatctggcctggtgcagcagcagagcccagccccacactgtctcctgcacccaaccctgccagaatggaggccagacatcccctctcagtggactccacacgccccctgacccgcccaccacacactgtcactgccagccatcccgtgggcttccgagccacctgtggtgtgtgtggcgcctgctctgggctcaacacatcagcacctggaaccaggctccagggcaagcccactgctcactgtacctgccttacccgggggggcccctccccgatggcaggaggactcccagccccacacctattggccccacaagcccagatccccagatccccagatccccagctctgagtcctggggctcagctccaggcccttgctgagtagccatacagctgaagaaagttctttccctctgaacctctgcttcctcacctatgaaatgggctgatactgctgtgacactgggggtacagcctcccaccacacccctaccccaaggcacgtcaggtgcaaatccactgtgagcctggggggcagagccccacaccacacccctaccccgaggcacgtcaggtgcaaatccactgtgagcctggggggcacagcctcccaccacatccctaccccgaggcatgtcaggtgcaaatccactgtgagcctggggggcacagcctcccaccacacccctaccccgaggcacgtcaggtgcaaatccactgtcagcctggggggcacagccccacaccacacccctaccctgaggcacgtcaggtgcaaatccactcagtgggccccacccatccattctatgccagtaccgtggatggccaaaggtgcctcaccctcaagtgccagatttgggccctgcagctccagcacccacacccgtaaccccctgcccacgaggggccagcagccccgccagaggtcatgcacccccccaccccggggacagctgcccagctgcgtggggtgagtgcacaagtggctcccacctggcggtgcccccccaggcagcccagttctgcccatgcaggggaagggaagtggagcctgggctaagcccacatggtggaggggtgcggattcacaggactgaggcggccgaaaggggctgagagtgacctttccaatcgtgagacatttcacacagtgtgaagctcaactcgaaatctccccagctgctctcagccctgggggctgccggtgccatgccagcccctgccccttatttcagccgaatcgcttgattggaatgcattgcatatcccgcccgagcgtgcggcccaaatgaaggtgggccccttggcactgccatctgggaagatggggtcccacagggcagggcacggggcccacagccactcatgcttctgccccatcccttccagagctgctccccccaccaccccgaaccatccgggttgctggagtttctgggctgcaggttcagacagaataggtgaagcagccaagctgccgtctgccccacgagggcccagcacaggtggcgcaggtggtccttttccccactcggcggcacgtggctctgtggcaggtcctgaggcacccacatgccacgtacagacattgggacaagtggcaggacactgagggcagaagccaccaagggcaggatgaccagatggcacagggaggggccaggaactggcacacgcaggacgcgccacggcacatgtgcacacggcagatgctcctcgtatccccgggcacctgggtgggcacgcgaggctcaacagggccccacggaggacacatgtgcacactcaggccacacatgctcagccagggtggggcttccgcaccggtgttcccagcagctcggcctctcacccgacactcaggctgggcctttccactccatcctgcccacaccttgccactgttagaggtacctcgggttggtgcaggcgcccgtgttgttggggtgttttttctgctggtgaggaggggtcagggccccctgccccaggtagttctgctcaggaaccttcatgcagtgcctcagagcagaaacccggccctcactggccctgcctcagcccctctcccacccactgggcccagacagctctcctggatgggaagctggggaggtggaagcagaggctggcagtgtttccagcacccttccccaatgctgggcctagaccctccgcaggacagccccttggcccctctgtctcctgtctcctccccaccctgcctggtcggggccagacactgagggacccctgggagcagcaacctcagcgcagggtccctgcttatgaatttttcatgcctttgtttgagcagtgggatcaggcggcccctgagcacaccgaagccataattaacacttgcactgggaaggggaggcatgtgttctttgctgcttaatagccgtgctgctgatttgtgtctccccatgtgtggggctgacaggcagccccaaccccaacccgtagccgcccagggtctggaaggggtgcagggaggcctgggtgatgggggccaagccccctccaggctcttcgggtagcaagggtgcactgcctggctgtggggtgggctcagatgcctctgagggatgagggaagggggaggggttggtggcagtggtggtgacagtgacagtgaagatgacactgatggcagctcccatttatgaagcctggccgccagcggctgctgtcctgagcctgccacgcacgttgcctcctccgactcagaagccctatgaaggtgccactgtctctgcagatgaggaaacaggctcggagaaacgaagagacctttgccacggtgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacagggagctgtcaggtggggatgcagtttcctgttctcagcaggaagcagccatcggtgctcatgagaagtctccaggtgctcaaatgttggcagccgattttaaaaaaataaatcaggccagaccaagcccatgtgcccccctacccagcttgtggctctaaaagccatgtctcaaggccgttgtccacccacgggtgagggtctgggaaggccgctaatggagcctggaggtgctaggcatccccaccgcatagccacatctgtgaaaacagtgacacgcagtggcccctggggtggttggggaagccactctcacggaggacgaaaccggtgcctgtgcttccgagccccactgcggctctcacacccagcccgggatggaggtggggcagatagagcttcccagggcctgggggagctgagctgcgggcttggggtggggagccctgactcacgcctggcctctgactcgtgccgctgagtggtctggaacccctgtcgggtgcctccctctggccaccccacaccttaggcgtgagggccggggccctgggcaggaggaaggaacagagcccagtggttcaggggcagagcctgcccccacggccaatcaccggaatcacccggctgctactccccaccccaggcacccgggtttaagtggtctaggggccccgagcctcggtgcggcttaaaaccagactgactgagggcgtgggtggagacaacaagtactgagaagtggtcacgagggccattattggatggtgaggtccgacagactcagaggggccttgtaggctggcagaccatggtacagggagctgctgcctcctggctgccattggagctcaggacaagcagagaaggagagacttgatatcggggtctcctcgtggctacaggaaggctcacctttccagccttggccatcagggtcatagacaagcgtgagcactgccagggctaagagactctaaaactcccagaccaggacttcacctacgccagggtaaatggcatcttctcgttcttggctttgtgggcagacaatgatggtgatgatggtggtgaggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgacgatggtgatggtgatggttgtgacaatggtgatagtgattatggcggtgatggcgatggtgaggatgatggtgatggtggcaatggcgaggatgatggtgaaaatggtggtgaggatgatggtgacggtgatgagggtgatggtgatgaggatggtgatggtagtgatgatactgtcatgtgtataatgtactgactatatatcaagcactgccttagtgctttgcacatattcacttatttaagccacacagtaatcctatgagctgtaagggacaaccctgtaaattgttcctatttacagaagcacaaactgagacacagagagctcagggcctcgcccagcatggggccgtgcggcacggagctcagggcctcgcccagtgtggggcagtgcggcacagagcgggcgtcttctttggagcctgagtcttggcctcctgaccatgcccagcatgtcccttcggggcctggggtctgtcctctgctcccaggcattcctgcctatcacaaacccacaccagggtgacgttccctgagcccccgagcccagccccggcgccgtgaatggtcgcctcactcgggcagctcccgagaggtggatgtgtctctccttttctcctcgccctgattaattgcctcattcaatgccgactccactgcagttaaacattaattcagtaggacttaataacacgaattcattcacgcccctgcctgcgcctggctgacagtgccgtgctatttggttaatgagaggatccatgcagcgtcctctggtgcgcttgctggaaagcacccctcagtgtctccttgctgttggatgcattaaaccctcgcctgtgtggtcagcctggctgggtccagccacagacctgaaacccacggggagatccgtaaccaggtccgggcttgtgggagctgctggctctggcccatgggtctcggggccaacccaggctcaagcagggatctgggtgcggggataagagcagaggctggactgggcaggtggcccccaggccacgggtgcacccatgtggccccaagtgtcaggctgctctcgaggcctgattggccagaaccctgacagtctggtgggattgcagtttccaagtcaaaggctctgcagcgcaaattcagcagggagaggcctcactgggggtccccagaaatcccactgtgaggctagaagggcacctgactcccctgcaggcctctggatgctggtggggctgcctcctgtcccacctccagggcgcactccctctcggccctccccaggctccccatgtgcagagggcatccttggcacagtctcggctcctgctttgccctcttccggtcccctcagccctggcgtgttctggcatgttcctcccctcccctgcgctccccgcaggagcttgtggctttcccctgccccacgtcctggtctttgcttcctttgctcctggctgagcctgggcagttccatttcatactttcctcaccaaacaccaaggcccgcccatatcacagcaggggagatggaggactcagaggcccaggggccaccagcaaagctggtctgcatgtcggggtcctgtggcccagcccttggtgagctccgcacctgcagcctccggggcgggatgggcccggttctgacttggagccctcagttcttgtgtggtgggccgggctgggcgggtgcaggtgggactgaggcccttctctacctctcaccctgaaggccagaccgggggaaccctaggagagggcttggccacggctgaaaggccagaccggggggaccctaggagagggcttggccacggctgaaaggccagaccggggggaccctaggagagggcttggccacggctgaaaggccagaccgggggggaccctaggagagggcttggccacggctgaaaggccagaccaggggggaccagcacacagccgggacagacagcctgggggagcctgtcagcctcaggagaccccccccacaggcccaccccagctgcccagcttccccaggggtcccagctggggtcccacttgtaggagccacctggagtgtgactcgtcatgcgctgggagcagcacgttctcgctgcagagtgtctgctaaagcgcatttcacaccgtactgtgagctccgtcgctgaacactcggcagccgcggctgcacatggagggtggctgtgcgtttggttccctgcattaacccagtgggctccacataggagggcgccgcccacacatccggctggcactcaccaccctccgtgcactggggggtttattcttccaccaggtcattcattcgacgtgaatgcctcataattgcagttgccaggaggggatttttccccttttgactgtttcgggggacattgcagtcagtgtgttcttcgtagagctctgcttactgaaaacggagaacggacagtcagtgtgttcttcgtagggctctgcttactgaaaacggagaacggacagtcagtgtgttcttcgtagggctctgcttactgaaaacggagaacggacagtcagtgtgttctttgtagggctctgcttactgaaaacggagaacggatttgttttcgggattatcacacccccaccctaaccagccaagctgacaaatggcgctggcatcgagtgtctaaccctgagcggccgtggccctccgtgcgctgccagcccctcctctgcccccggctgtcctgaccccaggggctcccaggctctgcccaccatcaggagctggggtgcctggatctcccagcccatgtggtgccatcgatcccctcagggggtcactggggacagtggggctgtcctgggccggaggctgccctccttcctggtgtgaggaaggctctggctggcccaggatgggggtcttcatggccgccctgctctgagggtctggccagtgagggctcctctcgggctgcagggccagtcttgtccccaccgctggctagtcggcctggctgtgcccctttgtccatcccacccggggggctgtgatccaggtctgtctggtgcagcactgggccctggatcagtcttcaccacggggcggaaggaccgcgcagccgtgcaa

SEQ ID NO: 803 - DNA, 9136 bp, Homo sapiens
tttaacgattcaggggcgggggggtttccttcttcacccaaggaattgggcccggaacccgggccgggggcccccgggcaagggcacgggcatgggggcacggggcttggcaatgggcaagaaagcttctcggcgttgagctcgcgggtggcgctccagggcttaacacttttgggcccgggcccgggcttgggcctccgacttttcaaagcgttgggcctccaaagagaagggtggctgcgttcagaccagcagggcatcgtccctgcccctcatgtggcacagggagccttggtacgtgcccggtgcccaggctatgtctgggctccggttatgcccccatttcagatgaggaggcaggcacggaggccacacagctagctggatctcacccgaggctccaggccccgcccggcggagggagctggcttgggagcctgggccgtggccaggggtgggggtgggtagcccacctgcccgaagacgcatcactggcagggacaggacaggccctgcaagagtcagtccctggacaggggctgctatgacctcatttaacagacaaaaccaagatacatcaaggacttggcccaagaggggagctggatttgaacacgggagctagggcctgtgtacctaggcctcatgttcacggcccctggatgtgccctcagcccagggcatgggtctgccccaccccaacagcagcgcccacagctgtaaccaccttttctttctggaaccccctggtggaaggcttgaccacttcctggaaacttgggcagggactgggtgggaggctgccccctactgtgactgcccgtcacccgccaccctcagccctgctccctggccacccttctgcccacctaggcacgtcccccgcaggtcctgtgggcccctctgagcccctggggcctgccccccccacccccgcacaccccaaaccctccttttcaggccccttcgggcaggtctcagatcaagtccccaggagtcaggagagggcagcgtccatgtggtggagctcctgttgcctggggtcaggagctgccacggtcagggggccagtttcgcaggagaaacaaaacaacgttccacgtgccgcatgcctcctgttcacgtccccggcagaccctgcttccttcctgaggccttgggacagtgagccatggcccatggggacagctgcggccgtccctgccccatgtgaccatggggcctggtcttctggggcctcaaggagttcctcccaggtgaaaacaggcagcaggaagcagccccatcttcactcttcacctggggccaggccttccacagcagccaccacccagcgaccacagagaggctgcgcggaggacacaggagagagggagcccacgggcactatctccaccggctttcccagctccctgggtcagccccacgggacctctcctcctctctcccacatctccaagccagccttgcatatagtaagagctgtgatcaggatggaaagaggcttgggccgcacagacctggactagaccccacgtgcggggcctcctgtgcccttctagcacctccagccctcactgggacattgtccgtccagatgcggcagcagccgcggcagtgagctgagtattcagcagccccccgtgacaccgtctgcgaagccagctgtcttttctaccggggcccgtcccatgcacgccccttctgacaccaccccatctgcgcctgctttgctgtgatgctctgatgtgaacaggcttccaacttgaaggcaggtgaaggccatgcctgctgaagggcagtagggcccatccttgccggcattggcagggcctgtcctgtccaatcacatccggatgaagccgtcccagcaaaagggtggttccagctgaaacccagggaggcaggagccgagaccccgtggccctgccggagatgctgcccgcctaggccttggtgtgggaatcccaggatcccagcgccagggaggccctaagaagacgctggggctatcccctctggagagggttgctggcccgtggacaccccgccccacagctcacagccacaggttacgaaggcccctaagacgccggggctaccccctctggagagggttgctggcctgtagacaccctgtcccatagctcacagccacaggtttcgaaggcctggcctggaacagcaatccaggcccctccactgcaccacagaggcgcgcaggcagcagagccagggaagtgagtctcagtcccgtttctctttaactcagcagccacaggtgattgtggtgctcgtggcaggtggcccttcagtaccgagcatctgaccccacgaacctggggagggcctgagagcacacattcctaacggttccactctgggagccgctgctacgagcggagcccaggccctgcctagggctcagtggcttcgtctactctcccctgctcctgggggcttcccagcaatcccagcaccctggtcccacccagctctgcaccccaggtgccaagaccatctctcccctgacttcagggggatgtcctgccgccaagacgcagggcgcattgtgtctcttcagaggcccaggagctgggccgaggggacccacttacctttatcggttcccggcgcaaagagcttctcagagcccacggatgcctggagagagagaaggggggtcaggggcagtcagggtggtcctcatcctcgtggaccttgcgcccaatgcccacacacaagtctgggtggttttccagcagggccaggcgggatgtgcccttgtggatgcccccgtgtacgaggtgaacacgcttagtcctgagctccacgcatgtgtatacatgtgctcacgctggggacacacaggcccctctctgctcagagcagcaggcttcctagagggggtctgagtgaagacggggtttgtggggggatcgggaaccaaggctgctgctggcgtggactgggggagcgccggcatttggcaaatctgcacccctcccaggagaaccagcaccagtagctgtgggccctgctgggcccccacccatcaggccagaggcggatgatggagagccccgggacacacctcctgctcccaaccactgcccagcacaggcgccctggcgaaagtgagagaaccaggataccgaccaggctggacatgtgggtccgcaaggctgcagggcacctcgctatgctcccgggccggctgagctccaggcctggtgcccagcgcccacaggacaccgcgctatgtgcctggggtcggccgagctcccagcacccacaggacactgcattatgtgctggggactggccaagctctaggcctggtgcccagagcccacaggacaccgcgctatgtgcctgcggccggccaagctcccagcagccacagaatgctgcgctatgctcccaggccggccaagctctaggcctggtgcccagtgttgctgagaggcagctgagtgtcccaggctatgtgggggagctctcagagggtcaatcgcagaaattgctcagccccactcctccatctcttccagagaaactcgctcaaccacctgccacaagcaggtggcgagaatgtggccgctgatggggaggggtggacggagggccccatgctctgggggacttcacggcagtttccaggaatgagcttcataagaatgaccttaaatagatatttccctcctagtttcttcttcttcttttttttttttttttgattaaacagcttcattgagttgtggattcaacgtttctgtctatcaagaattcacatgtttaaatcctcacccccaggtgatgggatcaggaggtggaaggtgatgaggtcatgaggtcttgagtgtggagcctcacgagcggcatcagtgccttataaagggccccagagccacctagccccttccaccatgtgaggacgcagcggagaggcaccctctatggaccaggaagccctcacagggactctgccatgccttgacctgcttgcggcctccagcactgtgagctgtgaatgtctgctgcagaactgggccagagcagcccgcacggactaagacttgagatgtaaatcacataccatccaactcaccgtctaacgcttacaattcactagcgtttagtatgttcacagtgatgcacctgtcaccacgatccattacagaacattatcatcaccccaaaaagaaaccctgactcctaaccgtcacccccaaccctgggaaaccacaaatctgtctgtctctacagagccgtcttttccgaacttccatgtgaacactgtcaggcggcacggacctgctgtgattggcttctctcactgcacggcttttgacgttcacccacactgcagtgtgtaccctggagagatgggggacactctgtgtgtggaggaagcaactgcaaagaaggagtgttatgtggatctggacaatgtgcctgtgcttgggcacgtacacacactcaggcacgtacacacactcgggtacacgtacatgggcacaaactcaagtacgtacacacaggcacatacacacactcgggtacgtacacacacggatacatgaacatgggcacactcgggtacgtgtacatgagcacactcgggtacgtgtacatgaggacagttgggtacgtgtacgtgggcacactcgggttcacgtacagggacacacacattctcgggtgtgtgtacctgggtggcagtgtgtgcatggatgtttgtttacatgagcatcacatgtgtgtttacgtaggtgcccgcgtgtcggcgtctatgttggtgaaattgtagaatgtgtccaccaggagagagcagtcccctctgggaatggcgggggtggagggcacaagagactaggcttaaactcatacttttaagtttgtataaaggagactgcattctggtaacacttgtgtaactgaaatgcaacaacgacaaacataatcaacagcttcactgctaccagggaggggccggccaggcttgcctagtgagcacagctgtgagagaccagggcggggggcatctgactcggaggctgggtgctgggagatgggggttctgtgcttgtctgtccccctgatctgtaacacgacctgtgactcttagggttaaaacgataaaaagggacttaggaatttggctggtgaagcgtgcgagacccacagctctccaacctactaaaacctaggagggcggccggccgcggctcacgcctgaaatcccagcactgcgggaggccgaggcgggcggatcacgaggtcagcagatcgagaccatcctggccaacacggtgaaaccccatctctactaaaaatacaaaaaattagccgggcgtggtggcgggcgcctgtagtcccagctactcgggaggccgaggagggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatcgtaccactggactccagcctgggcgacagagcgagactccgtctcaaaaaaaaaaaccttggagggcgagggcaggggccctcccagagccaggaggctcaccaggcgtagccagcccagaggggcactggtgctgggaagagacctgctgtccccatgccacagcacacgtttcctatcaccccaaccaaaatcccaagcagggatctggaacacgtggattactaggtcctcactgtgggagctgcttcccctgaatcccacgtggcccagccaagggagctgggctgctgttcagggcagaagggaggcggctcagggtccaccggggcctggtgtggggctggggtgaagccaggcccagctgcccagagggacacccgtgtccagcaactggcagacggatcaacagtgagcgcgtctgcctcagccacatatggaattgctgtcggcacgcgctctgtgagcctcagaaacatcacaggagccaaagccagaccacaaagagcacgcagccgtgtgaccgtgagcgcggccccagccacagcagccgaggggtgcagggggtgcacaggagctcaggggttcggggcgacgggggtgggtgtacagacgtaggtatgtgtcagctggaggggtgcagggggtgcacaggtgctcgggggttcaggggcgacgggagtgagtgtacagtcgtaggtatgtgtcagccggaggggtgcagggggtgcacacaagctcgggggttcaggggcgacgggggtgagtgtacagccgtaggtatgtgtcagctggaggggtgcagggggtgcacaggagctcgcgggttcaggggcgacgggggtgggtatacagtcgtaggtatgtgtcaaaaagcaaaccacacacttaaaatagctgcatttactgcaaaaataaataggtgaattttactgccagtaaatgacagcattggaaaccaacaaaaagatgtgacacgatgctgggacagacggacaggcaaacggacagacggaaggagatccaagagcgcaatgagaagccccagagttcccacagatgccgcgacggacagagatccacagaaccgaatgagaaaccccagacatggtgcaggctgtgggggccaggtgtggggtgcaggctgtggggaccagatgtggggtgcaggctgtgggggccaggcgtggggtacgggctggggggccagatgtgaggtgcaggctgtgggggccaggcatggggtacgggctggggggccagacgtgggggccagacatgggatgcaggctgtgggggtcaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggtgtggggtgcaggctgtgggggccaggtgtggcgtaggtccttcagagcaagctcctgtttcacctcttatctgaaaataattccagacagatcgcaaacatagaagtgaaaaaccatcaacgtatcagagaagaccaggtgtggattccaccttcttgctggaatgggaagcccttcctagtcacgtcgcaagggcctgaaccacagagaagagcagcaggtccatgcctgtaagatggcaagagccgaggcgggcctgccacacccacacgcgccggaagggcccctgcactggaggaaggtgggcccctcggaaaggagcagcggttgggccccgcacgttcgtgtgttaaagggctgcggtgcagctggtgggaagggatgctgagctcctggcactgacgctacttggtctgctcaccctgtgcggtccccggggtcggggtcctgcagcccaggcttctgcagggtgaaacaccaactctatgtccagcgcccccagccaccaacccccaggcagtgacgtaggacatccttctgaggaggttgtttctgctcaggacccagctcaaccacacaggggccgggtcggatggaagctaggagaccccggcaccccagaaagggaccctcccagccccagtccagggccccgatgaccctctccctcccccagccttgcggccaccacccctagaatcctggcttgttacaaagaaagaaggacaggaacctctcacccctgggaagccagggggcctggaggttggggcatgtggctttctcctctctgctcgcctcaacatcatcccccagaagtgtggctcccatggggtccgcctccacctccctgccccgtccagccactgccggtgacccaggctacgcagtgaccatcccagcatcggaaacaggaaggactccgagagaaacaggaggaatagtgaaggggcctgtgcaggtgggcagggaggagtccagaccagcctttgggcctccagggggcactgcggctccccagaaaggcctcggcacctcatcggccgtgcccatcccccagcagtgccagcaccaagtgctcccttgggccaggctcccaaatctgggcccctcacacagcaaggatggggatccagtgctgctccatgccagccatgaaccaggcactgaacacccaggcctgccacagacccctggggtctctcctgggcctgcaccatcctcctgggaggacttctggacccctcatctgaggggctgcactgttactggcacgcactgcgggcccttttcttggctggcgtcccgggtttgagtggcctcttcgccaggtggcccacctgttaactgccccctctgtggttggggcagcaggccccaccacgccgccaggactctccaggggccaggaaggaggcgggtgctgaggcctcccaggtgggcagagggaggagaagccagcttagcccgcagtttgacggccaacccaaaaggcagaccccaaagcacagcccccaaagccggccctcgtctctagggtaaccacaggttggagcccttctggggctctgctgccctccccttcactgggacccaaacactctagtgggttccgctccacgtcccaggttcgaacacaagctccccagggccacaagggggcgccccagacaccagcgaagccaagagggctgcaaggaaggggagggtcttccgcacgggccgcgcggctggggccatccagcacccattctggtcacgccacagtgggccctacacttagcagacgagtttgctcagggaggctgagaatgggtgctccaggggtcctcggccctagcagaggccccggaggcaggtggcctccacctcacagtgagaacctgaacacctggccaggtgcagccacgcccatccgggagggctgagagcagaacaggggccggcccgtcttcaccacggggctggaaggatccgcgtgtggctcaaacggttggtctac

SEQ ID NO: 804 - DNA, 12311 bp, Homo sapiens
  misc_feature (1)...(12311): n = A,T,C or G
atggcgcggctccttccagccccgtggtgaagacgcgagagcggcccggacgacaaggtaagcccagcgtcctcctcctgggctcggctgacagccctgcccttccctgctgaccttggccctgtgaggtgggccctggagaccaggcagaagatcgggccttggggggatccccccgcccggtgggtgcagggggcttgtggcctcccaggtatgggggtgctggcctctcctggctgtggaagagcctgtccagggctggggccggtaccgtgtctggagggacacaggcccaggtgggcatcagtgctgccccagccaggagggtgccctgggcagggctgccatggggtcgagcacatcagctccagctcctgggcagcagagggcagctgggcctgtgccccaggactggccccatcagtcctgagggagcaggggcagagcccagcccccaccctaaacccggtggcccccagaaccaggaggtagatgcgcagcctatgaccacatcacagtcaccctcagtgctcaggagcaagcaggattcctgcagcctcagccaggagtgaaccccccgggcagcccctgagccacgtccnctcagcctcggagcagcctccgggggggctctccttctgccccgcttgccccagagccctgcggggaggaaccgtcacctgctgtggccgaggagcatcaggccccggagggcgaggaggccaggcaggtggcgtgaggtcccggcccgtaaccactgcacctcactgtctccctgtgactgccaagggctacccgggggcacctggacgggggtgagggccctgccagatgtgccaggggaatggtcaccccggcctcagggacggccctgcagaggcccgaggcggactgcatgtgtgcgacgattctcaccctgagccagggagacgctgccctgggtttccaggcaggtttttatgaatggaacagttccatgaggggtctgcacaggggttaggggacgcccactgtggcccgtggcctggcaggagctgtctgggctgtggggtctcacagctgagggcccggtgggggtccagatattggagtcagtggcggtggccgggggaggagggtctgggcggttcagttttcgacgtaccaagaagtcaaggtaagacgccgtggaagccagaggccgcaccgtcgccgcggcctggggtctggggcaggcgccgtgtgggccgcagtgccgggctcagccgtgtctggggctccagcatcctgggctgcttccagccacgatgtccctgcccaacacacctcttctcgcccgtccgcagatggacactgttggggacgcgtcctggtggtcacaaagcccataggagtggcctcacccgggaccccgcgtggctccgcgtggccctcagcccctgcccacagcttccgcgcccgaaccgtgacgggcctaacatttcagatgagtaaccttgtcctgatctcaggaatgaaatgaggtcacgggcacccaggaaatagccactcaccccctccccacctcctttcatttaaaagcagtttttggggaagacaccctccacaaccaagggttgctctgagagaggcaggaaggaggggatttcgggagcctggggcctactgggggctccctctcccctccccgcctgccttaccgagatgaggcaaagccacctgtggccccggaggccaggtccacgtggagtcggcgatgccggcggggaaggctgacagccgcccccataactgcacgccccccatgtccagcaaccaagggtaacgccagcctccgagacccaaacgatgtctgtgcaggctgtgcctgcagagatgcggcccctgcccgggcctgggctggaggccgaggggtccatgggagagcacaggctgaaagagggttctagaatggggtcaggtggagtctgcacactggggcgtttatttctgagacgcccaagcagccccaggggagatgaccagctctgggcggtgtcggggaggctgagtccagtccagggctctgcacacggagggtcccggcagggcgagtttggcattcctgcacacggagggtcccggcagggagagtttggcattcctgcacacggagggtcccggcagggcgagtttggcattccgtgccgttggggccgtgttggggcttctagggctgtggtggccacaggtcctgaggaggacagcaggggagggagaggggctgcggaggacggcaggggagcggagaggggctgcggaggacggcaggggagcggagaggggctgccagcctttctccagggcagaacttcgggtcacgcccactctggggagagcagagaggcctggcgggggcggggacggagaaggcagctccgccaaacactgagtccccgtgatggtggctccttctggctgcggcaaggtctgagcgccggcgcacaaagcgggggcacggtgctggcagagtgggtgggacctgcctgtggccccgtttgcttctgttggggggcagctcccggaggctgctcgggcagagcagcagggtgggccaggaaaactgcaggggcctctccttgttggcccgtcagcctgtccgtctgtgtgaccttggggcatgctctgaggggtgtgtcccaggctgactcaagacagctaagccagaggtggggacgaccctggtgcgttctgggagccggcagtgcatcctgggctgcagcggagcgagagagaggagcccagagccggcagcaggagtttccgtttccctccgagtgcatgggatgctgcaccgtaggactcccccgtccagacgtctccgtttccccatggcatccagcccctgatgctcagaaattagcttcctgagtttgggagagttgggagggcaggaggcctcaggtccctcctggtcttctctgcccggcgctgggttcagggggtcaggaacttacgctgggcggagggtgtgcgtggagcccatccagacgcacacagaggcgtaggcaggtgtgggaagtcagccagcaccccactggccgtccccagccctcctccctacccgctgggagcagaggcacccagatctctgtccctgggcactgctgtgcgaggccggcacccctgccagggagcaggcaggagggacagagccctgcaggctccagatggcagaattcccggctctgagacaggaacatgggggtgcttcgcatcagcagtgcccagagcccctcagcagccccgggcttgtgtggaacccgtctgtgaactggatatggaaggaaggtccccgagtgcccacatttacagggaccctcagagacctcactcagacctgggaggcccattgctcacatggcctggctgctcccggtgggcagaagatggagaagccacagacagcgtcctgcgtggggtctgtgggcgctgacccagcagccgtgcagggaacagccctgcccgcagaagcggatgccggggcaggtggcagtgcaccccgaggaagccttctggacggagtggtggggagggcgcgggcgcatgtctcaggccagtgcacttcacatctcatcccacacctgcgggtttgagcttggtttggggtgccagctcccacctggccagccaccccttggggactcaccctgggctctcctgccaatcaaggtggagactttgggacagccctcctccacgtgaacagactgaccgagacacctctccaccacctccctcacactgtgcccgcccagccgccccctcccctggcccttggcaggaggctccttggcagctgacgggaggctcgggcactgccagatggccccttcgcaagtcttcggtttgtgtctaaccactttttccttggaaaagtgtggggtgaagagcgatatgggactccataggcagccgccaggtggtggtggcctcgctcctcctgctgccgggggctgccacggccacctccagggatggctgtctggcccgtctgtggaagcccatcaggaagcacccccagtgccgggcctcagccaagagcaccggcctggaaggggcagggctgggggacagtggcatgaggtcagacatggcgtggggccgaccccgcaggcagcccaccatccacagcctccatgttctgtctgcaaaatggggccacagtggggcctgggcagaggagagaactgcccactgccccaagcacggtccccagagagctggaggccagccagtcctccacacccagcccctccccagcagacccttcttccagtggggcgctgtgcccgactgggtcctctctgaacctctgccttttcgtcactgaagttcgtaggttcttgttcttgggaactgtgagttcaggcactaccagcacgacagccagagggacggacggacggctggacaggctggaggcccctgccatgggcactcaccccgtgggacagacagaaggatggatggacggttggacaggctggaggcccctgccttggggcactcaccccgcaggatggacagaagggcggatggatggctggacaggctggaggcccctgctatggggcactcaccccacgggacagacaaaggatggatggacagctggacaggctggaggcccctgccatgggcactcaccccgcgggacagacagaaggacggatggacggctggacaggctggaggccccttccatggggcactcaccccgtgcgacagacagaaggacggatggacggctggacgggccggaggcccctgccgtggacactcaccccgcaggacagacagaaggacggatggacggctggacaggctggaggcccctgccgtggacactcaccccgcaggacagacagaaggacggatggacggctggacaggctggaggcccctgccgtgggcgctcaccccgcagttgctgggcctccgtggggtcctgggaaatttcaacagcagtccagtgtgcgggccgcgcctttgttctgtccagccagcggcccaggctgcgcctttgttgtatctggccgccggcaggccaggcaccttctgaggaagggttgctgcgtgtctgtggctcacggaggccttcctctgtgtgtgactcacaccccccacccaccccagcccacttctgggagcatcttcctgggggctttggaggcccatccattcttccctagggacaaaagtgcagggagcggcgtcccaggtgccaccgtctctggggaacgtgggccaggactccctttgctggacacagaccctgcccacactgggtgaccgtggggtgacctcacagggtgtgtggggttccgaagccgccaccctccttcctgagcctgcactttgacctgggactgctgagcccagaagggccttgagagggctggctcagtggcacgtgggggccttgggtggttgggtccccgagacaggccatctcgctccttgtgtggcaggctgcggggccctgcttgcctgggtcccacgtggtagaactcggcgtttggtgggggcctgctggggacaggaagggacagcaccccaccctgagctgggcactcatgcttcactggagccaggcggaggggccgagggcaccggcacaaggagcagacgtgtcggtccctttgaggaccgagatcatgaccaccacggagcaagcgcccgggtcctcagatcaaaggcccaatagccagtgaggcttctctgcactggtcccagcagaagcggggcctggctgaggcagtggcatcagagactcggggcaatgggagtgcgaggggggtctcagcgtcccacagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacgggcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcgggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagctgggggcgtcactgcagggcaccggcagaaactggggtctgaaaacagcagcccagagtggatttggaacagaacagggtgtcacagaaaggatgtttcatgaggtgggttttgatgagtatgtttaaataaatgtaacttaattgatgttaaatatgcatcttaatgcttttctaaaatgtgcaattgggccagttgcggtgactcatgcctgtaatcccagcactttgggaggctgaggcgggcagatcacttgaggtcaggagttcaagaccagcctggccaacacagcaaaaccccgtctctactaaaaatataaaaattagctgggcgtggtggcaggcgcctttaatcccagcactttaggaggccaagcgggtggatcacctgaggtcaggagttcaagaccagcctggccaacgtggcaaaaccccgtctctacaaaaaatacaaaattagctggctgtggtggtgtgcgcctataatcccagctactcaagaggctgaggagggatggtcacctgaaccccggaggtggaggctgcagtgagctgagatcgcgccattgcactccaacctgggcgacaaagtgagactctggctccaaaaaacaaaaaaaatgtgccgttggaactatatttcgaaattggaaccccagactttttgaagcacaagcttgtgttggcctttgggggcccatccctgccccctgttggggggcgacctcccccccaagaggcctttttgagccctgggttcccttggcttgtaaaatggagtaggcgcctgcaaaggacggctgtgggggaggcttgaaattcaatgcatttgggggaaggtacgtgttttcctgtgatttaatatttcacgaacgttaaacctgtgctgggcacagctctccttcgggtgggagtgtagctgtggttatctctggaggggggtcacggctttctctggcaggcagcatggggccctggtgtcccgtggcctccacggtagccgccccacccgagcgtgagcgtggcctccacggtagccgccccacccgagcgtgagcgtggcctccacggtagccgccccacccgagcgtgagcgtggcctccacggtagccgcgccacccgagcgtgagcgtggcctccacggtagccgccccacccgagcgtgagcgtggcctccacggtagccgccccacccgagcgtgagcgtggcctccacggtagccgccccacccgagcgtgagcgtgggggccacggtagccgcctcacccgagcgtgagcgtgggggccacacccacaagtctggcatcatggtgttgggttcatgctccctccagaggccccagaggaggatccttcctgcctcttcccactcctgctgactccggcatccctggctggtggttgcattgctcctatctctgcccctgtccgtcctcacatggcccctcctctgtgtgtgtctttgtgtctcttctcctcaaaatgacgccagtcctcggatttaggtccacctggataacctgggagggccccatctgagggtcaggatgggtgtgggcttggggcctgcaggcggccccacctttctccccgcaggcactcgtgcctgtgtaccagccttcagggccggttgtggcctcggggttccaggaggcgctgccatccagggcctcgggcacagcatccctgggctcttcccccagcccctggggtcctctcttctcagaggctttccctgggtttctgtgtttccgcgaagttccggtgccttctgcactttccctgggagctgaaattcgctaggatttgcatttccaggccggcagcctccagggatgctgagcagcatctgaacatccctataggtggttctggcttttgcttttctcccgacattccgggtggagatggtgaacacacgcttctccgggctccccctgatgctgccctcaggccttgggggtctggcctacccctcacctatgcaccacagccttgctcagagagtgcacacctctgcgacagacagaacctcagagtcgttccatggcaaagccacactgccagcgtggctgtggcctacacaggccgggcaacagcaggtgcaggccctaccccccacgccacgactcaaggcccaagcctgctgggtgcgtctgagtgttcgtcctgtgggacgctcctctccaggccttcgtgctgcaccccaacccctgtcctgtgggacgctcctctccaggccttcgtgctgcaccccaacccctgtcctgtgggacgctcctctccaggccttcgtgctgcaccccaacccctgtcctgtgggacgctcctctccaggccttcctgctgcccccgccacccacccccctcctgtgggacgctcctctccaggccttcatgctgcctccaaccgctgtcctgtgggacgctcctctccaggccttcgtgctgcacccccctccacccacccccctcctgtgggacgctcctctccaggccttcatgctgcctccaacccctgtcctgtgggacgctcctctccaggccttcgtgctgcacccccctccacccacccccctactgtgggacgctcctctccaggccttcgtgctgcaccccaacccctgtcctgtgggacgctcctctccaggccttcatgctgctcccaacccctgtcctgtgggacgctcctctacaggccttcatgctgcctccaacccctgtcctgtgggacgctcctctccaggccttcgtgatgcacccccctccacccacccctgtcctgtgggacgctcttcttcaggcccttgtgctgccccccaacccccgtcccgtgggaggttcctctccaggcgtgagaggacacggcccaattcaaggacacgtgccccgcggagtggcagccttgaggaagcagtcttgtggtctcctggccccagcgctcggctaaccatggccgaatggaggttgggtgccccccagggtggtttccagggcgatccggtgtcctggggtggctggggcagcatggctgagaggaccctgtgtgctctgcactcctggttaatggttggggcctccagcaccttcccatgccttcccatgatggcaccccctggccacccgctgcgtaacgatggcagacgcagttacagtgttggtttctgaaccgtaagctccggataaatgtgcctctgaacaccaccgtcaagtccctaactggattatgtatatttggcctggaagcctgatacttaatatcagcctgctctccggtgaatgcctttcttcccccggataatctattcccactccgcttccttctagacttctaacctcactacatctttcatatcagagctactctcctttctaaacaaaacacagacctgcccctggttctgagtctagtttcacccccaaactggggcgcagggctgtggggcggggctcggggctcggggctgggttttcggccccgttgacccaggccaggatctctgcctgttccaggatggtcagtgctgaaggcggcctcaggactgaggttagaaagtggggttggaagcctcgtttgtggcaggaagatggcttctcctgtgattccagtggtgaggtcccaagagaggagccggccacattgagactggccgtagcccaattggagctggccagttgctgcccctcaattccttcttcctgctcccccaactccccagccccctggggtctccagtcagcagggagagtgggcacagcttggcgggaccgaggcctgctgggcagccgcttcccgtgccctgtacccagagaaggagctgatggcagcacagcttctcagggggctgaggatgcactggatccatctgtgccgagtccccagagcagggcccagaagaggggactggggatggcatcctcccagggccaggcacgcaggaaggggctgagctagggttctgcctgagtctgtcttctctcctcccctccccccgcccgttccctctctgtgggcctcaccatctggaccccccatggacagaaatgacctcgtcacagggccccttcacggcctttgtcctcacggcccctcctggctggctttgcccaggccagcaccctgggcctgaccttaaccctgacttatccctgagggctccacgcatttcaaatggagcggccccatccccatctcaggagtggcccaccaccttcccaggggagtgtccctgctgagccatgagccctgcggccagcctgccggctcagcccagcccagctctgccacagagcagccacgccagcagcacgtctgttttctcgtcggtgagacgagtggtggcttatccaagtcctcaaagtacaggcttcagggccctgtggcttgcggcatgcagtgcgcccggaagtgcctatgtggacacagtgtgtgtgcatggacgcaagcgcgtgccgttttcatggcaggacacagcagggctttgggggcgacttgttggtaaagggagtacgtgtatttggtaagtagttcaaatagaacctgagggctggaactccctggctgaggccgaccttggtgattccttctataccgttggaggcatcctgcgaacgttggcgcctttgggagcagaaagtgctggtccagcttgcagagggctccatcgaacccgtgtgggagctgctcccgcggtttgaatggctgcgggctccgccatggataggccctgcccggggccaggccttccaagcccagaaatagaaacgtggccacagctcccacctcagtcccgaaactggagccgaagccctctgtccctggccgcaccagagccggcctccctgtgtgctgccagccacgcagcagcttggagaggacccgtccttaaacacttcccgactgccgggtccagagctgcgccctccctcccttactcatcgcgtttgagttcgcagttggtgtcctggttttccacctgagtgggcgctgggatggaagggtcccgcccaggcgtctggtgcggtcaggcgcacataagcagcctttgcaggaagccgtggctgggcctcgatccgagttctagcgccccaccgtaagggagagccaggtgcttcctgtccctcccggccacctcaagtgtaaaatcacggggttcagggcggtggtcttgggggctgcgctgcacagccgtttgcagctacagcagctgctcggagctgtctccgactttgcacccccgtttcacagagggagaaaccgaggcccagggagggcggggcttgcagcggacgggtggaggaagggctcctcctttcaggtcccaactctccacagtggcaatgaggtcgctcttttttcctttttttgagaccttgtctcgctctgtcacgtacgctgaagtgcagtggtgcaatctcggctcactgcagcctccacctcccgggctcaattgatcctcccacctcagcctccccagtagctggggccacaggcgcgtgccgccacctccggctaatttttttattttgtagagacgggcgggggtggggggtcttcctatgttggccaggctggtctcgaactcctgggctcaagtgatccgcccacctcggcctcccaaagtgctgtttcaggcgccggccaccgcgcccggctgtcgccctttctgactcagtttccccttctgggagcggggtggcaggtgtccgtaacttcttgttgtgaggaccagaggagcagcgcccacacagcgctcagtgaggccggcgctgcgcgcctttccccgggtggccgtgatcggaggcagcgcgttcggaccccgggccggcggcgggcgcgggtggatcggcgcctcggggctggattagtcgggtctgcccgcgccccgcccccgccccgcccgcgtcttc

SEQ ID NO: 805 - DNA, 13035 bp, Homo sapiens
atggcgcggtccttccagccccgtggtgaagactgtagggtctcctgtgccagtttctgttcagcttttgacccaaggcagagaggatgtcggggcacaggccaccacaggtcccgggtatgggaggcagccatgccagctgggtgctgagcagattttcaggtgctctgcagggagagctgtggggtttgcacacagactgaacacagttgagagtcagaggctctgggctttgggcctgagctcttggaatgacagagacaagcctgacgaaggtgtgagccaacaaggttctgggagccaagcagctgcagcctccctcagcctcctgcccccactggagagcagcttccaacccatccgagaagacccctgggggctccctcagccccctgcccccatggagagcagcttctgacccatctgagaagatccctgggggttccaggcctgactttgcccaggggaacatggtcatcactctaggtgggaagcagaggggcctgccagggaggtgaggtcttgggtaggtggttctccagagcctcctgcctggtgccaaggaggggagaggcccttgctgtggtttcaggagcagggcgtggccacctggctgcagggggtgggccaggccttggtgcaaacaggcagccccgtcccaaagaggggcagcagggctctgtgtgtgctgaggtagaattattttatctctccgtgtctggttcactgtagcgtgattaggaatgttattggtgctgtatggtaatgacattaagagagccaaaagcagtcgcatagaattgctacaggaaaatctgtctagcaatgtcacggcagcctgcgcccagccctggtggtcctcctgggagaggagcagggaggtctggggccctagccactactgggggtgctggcgccactgcagggcagtggcgttgcgcagggagggcctccaccgcgccttcttggagggcccctgtgtgcgcaggtgtggtgccacgggtgctgacccaggtgtgcactgcacacctgtggggggttcaaggcctccgctgcctcagcctagcaggggttcctgcagctgggacagtggcctgaggcggccctggctggcaccccagggctgggctgggtggtgggtggtgctggggacagctcctggagcctttccaggcctctctgtgtctcttgtgtcttcattcgacactggggtggtcactgcgaccaactcatggggtcctgtttgtgtggattagataagcggggcccaggccaggcacggtggctcacgcctgtaatcccagcactctggggggctgaggtgggcggatcacctgaggtcaggagtttgagaccagcctggccaacatggtgaaattctgtctctagtaaaaacacaaaaaaattagctgggcgtggtgacctgtaatcccagctgctcaggaggctgaggcaggagaattgcttaaacccgggatgcagaagttgcagtgagccaagattgtgccactgcactccagcctgggcagcacagtgagactccatctcaaaaacaaaaagataagcggggcctgacccaccacttagcagagcacctggcacagacctcactgcggtgaacacgatgaagtgggtgagcgcggccgctgctggtctccttggcttggtgcagggcccccacccggagctcatgtcacttccccatgcgaaccttctgggcccttccttccacggagcccaggcatccttggggtgtggtggttggcaccgcccatggggtggggctgttgcctagcttacaaatgaggacactggggctgcccagggcacgcactgtccctcagtccctggggactgccccccgtctggcctggactcctgtcccggccccacccccacccgtggtctgccccaaggggaactctggtcctcacaggagcgggggtgaccacgctgctgcctgtcatggtggccttggacgggacgctgtatggtctctgagctgcaccaccaacccctcaggtgtacgtggagtgactgagcgactgggcagagtggggtgttgggtgcaacggtggggctggcaagggcccctgcctgggcctccttggtcgtgcctctctcagcagctgggcagggcagtgctgtggcgttgctgtggggcctctgaaacctgccaggcgaagcccacagggccagccttaccctggaaagccccggagtgaccagcagaggggccagccgcacggctctcccaggcctgggtacctttcccaccgtcttaaggtagcaggcgaagcgctggctggcatctcaagagcagagtgctgggacagccctcccagagcttcctgggaatggcctctgttctctgcagtgagcgtggctgcagtgctggctgggggtgtgtgggcacaggggctgcgcctggagccggagatgtcggaggcctctcctcctcggtgtgggcacccaccccatgctgtctgttctctagaatgttcactcagcagcacttgtgagccctgtctggggctgagcagggggcaggacagatggacattctggtgggggtcagacgggacaggaaactgccttgtgcttggtgtgactgtggccggggtggggagggagctggagggtgggtctgtggatgggaggaggggccggcagaaatctttatatttttttgaaagcagagtaacactagagcaggtttacagaaaatgtggtaaatttaaacaatttgcccttgacacatgcgtccttctggccagctgtgagcactgtggcaatggggagaggtgtggagcgggcctgggggagcgtctgtgccccgagggtaccacccggtcccgcctcctcagatctgccctctgcctgtcccctctgactctttgcccagtagaaagacaaatcccagcacagtggtgccctgcgtggcaggctgcccttgcaggtttcctagttactgtgaaaggtaacaccttgatttgttcctgcttttgatccagcgctgcaaacagccgttctctgggctgcagcctttgattcatccaggctgagaccctcagagctcactgggaaccgtttctgcagtgttagcagattgcgtccacagctgcctgggatgggcagccctgacagatcctgggtgggcgagcaggaactctggaggccatgggctctcgggcttgtgcaggagcaggccgctcacagcagggctctgggccttgagtggtggctctgcagagagcatatggcgggagctgggcctcggggaggcaaggagtcttcctggagccggaaacagcaaagagttggagtgacaggatcagccctcgtgggcagggggcccggaaacgctgctgggcctctcagggcctccagctcagactggtgggggtggcgcttgtgtcatggggcgggcgcccagccggagagggcgtggccggcaccaccatggctcttgtctctgtcgtctgcccttaccggagggacagccaaggtccttctccccagggacaccatggctctatgcgggggcgggtcctcctcggggacactgtggccctccgtgggggcggatcctccccagtggcttcccagggttcttggcagcagctctgacatgggttctgtcctgggcttcactgctgctgttttcctcacagctgtgccctccccgagaggattctgtcctttcgtggacgcttctccctggccggctggctcctctggaccctaaacttgacgcgccgtatctgtctgcaccagccctggtgccaggagctgagccagcatacagaaggtgcttactagtggtttatcgagtgtggaggtggggaccccagaacctggggctgcccgatgtccaccggcagggcggaggctggagtgtcctggggctgtccgcaggctagaaggtgctctgaaggagtcgagatgggacgagaggggaccaggggaggccagcaggtttacagggggcctgggggtgtccccagggtctggtagcccaaaggtgaacacggggaagcatctctgtcccaaatccacagacccgtctgggagcactggccagaacccctcaggccctctggaatatggtgtcacctgggggagcacttcctgtgggctgtcacctgggggagcacttcttgtggggcctgggtgtcccctggagaggctcctgtggtccctggcccccactgcagggcactcgctcttgaaaggtagccctggtctcagcagggaggggcagtcctgggcagccctgggctggcctcctgtgaagcttactggagactccctgctggactaagctttttctcgtctggccccttcgatggctgagccctgggaaactcccatcccccatcccgcagcagcatctcacctgccatcgtccttcccctcccatcccccgtcccacagcagccatcttcctttccctctgaggtgcccctcccaagtggggaggctccttcccaagagctgctcaggtgggtgctgtcctgggcccaaggccctggggtcccgccaattaactggcgtttccctgtctccctgcagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcaggtgagcaggtccctccccgaccggaagctctgcggcgggtcagtgctcaccgccccagggccatgccagcacctggacaccacgccacgtggcccccgggcctgcctggcagcgcgcccatcgttgtcaggcttggggtgcaggacacgtggacagggctggggcctagcagaggcaggagccggctgggtcacggaggggccgtgacgtgcccagggccacagcaggagaggtgcctgtctggggcagcaaggcgcgcgttccgggctggggcgccaagctgataggccggccccgtttccctgccgtgtccatcaggctccgccgactacaggtgtccagagtgtctataaggagggggtccaggctcattgccgagggctgtcctgtccacacgcagcgccatccgctcacgtgtgcggcgtggggaagggaatacttggtcccggcagtggctgcaggcacgtgactgtggtcagtggtcaggtgcgtggcccagctgggaacagggctctgcctgccctgcccaggggcctcctgcccaggaggggctgtcagagcaggtgggggcttccccagcgcgtggggctctgtcctgggtgcagctcagcctgcagctgcttcctccgcgggggtccgctggtgtgcgccttccttccagggtggggctctgcgcggtgtcctcggctctcctcggcccccttgggaattgggctgctggagaagggcagcatgcctcctgggcccgggctggacgggggttccgcgggcggtgacacctgcccaggtggacacgtgctctttcttccatgcaggtgtgctccccagaaggggggccgctcccagccagccactgggaccagaacggcccggcccagcgccagcaacagctccagcccagccagtccagccagccccaggggtccctcccagccccgtcggcactcccggaccctgggcagccctgccagccctcccagcggccactcctgggtcagcgcagctggccccagcggtcacttctgggcctgaaacagccctgccagccccggcggtcacttctgggccccggtcagccctgccggccccagcggctccttccatccccagatcagctctgccagccccagcggtcacgcccggcccagccctgccggccgcattgggcactcccaggccccaggcagtgctgcaggcgcctgcggtccctgctgaccccgtgtcaccactgccggcgcctgcggtccctcctggccccacggtccctcctggtcccctgcctctactgccggcgcctgcggttcctcctggccccaaggcaccgctgcaggcgcctgcggtccctgctgaccctgtggcaccgctgccgacccctgcggccgtgggccagcccgtgtcactgtggccagcccggtagggcatcctcaggacagcgcagccggcccctgtggtcgctgctagcccagtgccagcggtaccagcccccgcggccactcctcaccctccgaccacgccgacggcccgccagcttcctcccaggacagtgctgctgcccccggcgggccttcctagccccgtgtcagtacggccagccccgaaggtccctgctgggccagcccagccgcccccggcggtcgctgctgcgccccaggcagccccagcggttagtggaagccccagagcagcccggcccactcacgccttcactcctgggcccgggacggccgaggcagcagaagcagccgctcatgggcccggagcagccctgcccacccaagcggccgctcatgggcccagagcagccctgccagcccctgcggccgctcatgggccccaacaagccctgcaaaccccagccgttgctccccattcccgatcgcccttcactcctggggcagccgggcccaccctgccggcctctcctggggctcctgtgccagccgcggcggtccctattggatctggtgccggcccgtcagccccggctctcgctcctggccctgggccatccctgccggcccctgcggtcccggtggacccgatcctgtgcccccgggatggcccgtcaggccccatctgtgagccctggagcctgatgcctgcaggcacctccccatatgggttttccagcccactccagtgtgatctgcaccctggcagggccccaagggccaaggccgcattgcccttcgggctggagatgctttgccggactagcctgaggccttgtctagacagggctgagctgtttgtcgttggaaattgaggctcggccagaggcgggagcccctacagtgccacgatcaggctgaggctcaccacaccaggaagagagatgaacccgcgtctgcctgccgccccgccatgctccctctccccccactggcgtcacagtgcccccacccgcgttgctgcctgtggtgtgcgtgccctgggaggggaacacagcccctgagggcggggaccttgctgggggcccctcagcgtctttctgtgcctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcaggaggtgctggtgtccacctccagggcccccaagctacagggggcacatgggcccatctggtgggtcaggaccgccagggggacccggagggctcccacccccaccttttaggactctgcctccaccacccccgtgggcatgcactgaagggttgcctgcagggtctccaggcgagggggaccccacagggtgggcagcgccttctcccggcttccccacagtcccatgcagcgtcccgtctggctgttgacctacatgtggtcgggcacacctcacactacaaggctacccctgggcccatccctgccccttccacggcccccacctgtggtcaggtgttgccaccccctcaggacctggtctcaaggcagccccactcgagtcttctggagtccaaggcacgccactcgcccaaaagggagggggtgtttgggggggctttgactgtctccagacctcaggggagctgggcaggctctaaccagtggtcctccagagagcagcgttgaccacctggacccctgcgccacgtgacaggaggctctggtcctgcaggcctggtcttgcccagctgggctgcctcaggtgtcaggaaggggatgggtgtccctggctcccaggccaggcagctgctgacctccagcaccccgcacttgctcatgaggaccccacccccgcaggccctcccgggtcctgaccagcctctggtgcagcatctgctttggcctccgggccccctcgctccccacccacccggggccccttcctccggtgctcacctggggcctccatcccagaagcgcagggcttatttttctgattaaagaaaataaaaagtgccgtgccactattttttataacagcatcagcgtttgtaatttaaacagacgagcatgtgtcttacgtgatttattcccacaaagggcttttgtgctgggcttggctcgggattcattgcactctgaccgaacagaggggagacctggagcatctgttcctgaccttcctgcccacccatctgaggcctggaatgggggtttgtactgtgctcagcatgggggcaccggcctccagatccccccaccgcaaggctactgtgtgggccagtgtgacaggggtcgagacccccctctcggctcatgcctggggggcacccatccccgggatcagtgtcctggggactggtgagggagggtggttcagctcagagtcctctgcatggcctgggcacgcgtgagggagcatggttcagcccagcatcctctgcacagcctgtcaggtgcttgtgttctgctcacggaaggccggggcatggaggggccgagtcctggctgcagcgccctggctgagctccaggttggacctggcacacttggggtgcgggcttgaagggcggtgccatctcagagtcacccacacaagccattgccccgcagaggggctgaagttgccttcagacgtccctgttgtcaggcgtggggaacagtgatgatttaaacagtctcctgccctctttccactttcaggcccctgcccctacccccgggctcctgtgagtacagagggggccgagtgagtagagccatgtctggggcaggcctgaacgggctgagggagtggggaggggccatccatgctggagctgagcagtggcacttggctgccccttaatggggaaggccaggctgccagggagggctgaggagagctggaaactgcagcctgggtccctgtggccaacagctgggggtgcagaggacacccgtggaggaaacattcaggacccagaggggctctcgaggcctggccatgaccctgcagcctccagctcgaacccactgtctgcactggcttgcggtcggggtgccgccatggggagggcagagacaccagggcgctatggtgctggacatccatgttgtgtcctggggcccgcgccctggtggggacactgctgccaagcgtcgccctgggaaatgcagatttcgtgtggacagatctatgatgtttctgaagagctgggaatccaggtttctctggatttggcaatgttgaaaggttggtggtcaattctaatttttatgactcactttgctgaccagaagatgcagctgtgggcctgcgaggcctccggcaagtgggatttggctcccatcacaggcagcagattggagcctgaggcctggttggaacatggcttgttcccttgtttctggaaggggttggtactcagtggggctgcgcctgcccaggaagatgggcttgtgtcctggctgctgtagagggggtgggggcagcccagcctgaaggttgaggatggaggtgtcttccggggggtgacagtggggatctgggggaggctgcccgctgcccgactacagagaccctgttgctgcctcaggaacccctctggagactggggcctgcgtgcagtgctttagtgaccatcagccctctggtcacctctgtgggggcctctgcccaccttgttgttgttggcacaggcaggctggtcccctcccatctgcagaaggggttatggggagggcgtgagccttctgggagaggccgaggcgtgttcctgcagagcccacggcagacgagggcagtggttggtttgttgttgggggaggagaaggggaggtcggggtggattcctggaagatgggtgacactgagactgtggcggtggggccaaccccacgaggggcctggagctctaaggcccttgggtcctccccaggtcaggccaagtccatgagccatcgctgagcagcccccagggagggaggggtgtgagcgtgggtgggctcccggcacctggcccaacatccacgcctggtgtgtgggcatctgcctgcagaccctcgtccgagggccccgtctatctggacccctcactgcaggtgaatagccacagtccctcccccaggccctgccctgcgtgttggaaacaccacctcctgggccttccccgtttgctcattcgggatccttgtctgggcactgaggacgatgagctccgcctctgttctcgcgtcagggctcggctcctccgtgtgtggggagacaggctgggatagcatgctgggcgactgtggtgagggcaaagacacagagggcatgagtggggggctgggggggcacctggatgttcagaggccagaaggcaggactacccgcaggtgcccaagggagacccagggccgcccagaagtccagggggagtcctggggcctcggagggatctgagcagggctgcggcctgacccaggatctctctggcctccctggcgtcttcccaggtggcccaggaccgcagtaccagactgagctggactggcattgaccaggccgaggccaccggccatcctcctccggccagaagctgcagtgataggggacatccctagcagttcacaaagctgtggggagaccccgagggggaagggtttccatgctgagccacaggcccggccacggtgcaaagctgtggggggactccgaggaagaagggttttcatgctgagccacagtcccggccatggtgcagggatttggcacgaagcctctcctagggccggtacacgacctagagggctccctggtgtaccctgggacctggcagagtgcagcttctcatccagcaggggtgggtagggccctggactctcctagggcagcactgtttaataggagtgttatgtgagccacatatagagttaagaagaaataagtaaaattcattttaatgaagtattgcgtttcactccatgtactttgaaaatagtatttcaacaatgtaatctatataaaaattgtcacatcttttttactcttttttttgtagagtctgggaaagccagcaggtgttttacatttacaacacttgagtttagactggcagcttctgcgcccaataaccacaaggctgacagcagggaggtgtggggggtccagaacaatataccctctgtgagtgcttatctcatgcccatgctgttcccaggcgcctgctgtctgtctcctcatcctctacctcatcggctctatggtttgaggccagacctcatgcatcaggccagagtgtcctgccgagacccaggatgcacccctcacttggcacagacaaaccagacacaccagcttctgtctttccccatttcagtgggtgaacctggaaccacccagatgactgggctagaagttgacagtcattctcctctcctcactcccctgtcctcccacccagcacacccagccaggcaggtccttagcttccaccttcctgaatctctgacctgaatttcactagaaaataaggaatactacgtcaaaatttatgggatgcagctaaagccaatccttaaaggaaaaactagcttgtgcttatatgggaaaagaagaaaggtctagaatcttaaggttttaccttaagaacccaaaaaaaaaaaaaaatggaaggtttgtaaacctataaaggaaagccatagtatagacaagaacagaaatacagaaattaatgaggcaggccaggtgcggtggctcacgcctgtaatcccagcactttgggaccccaaggagggtggatcacttgaggtcaggagttcaagaccagcctggccaacatggtgaaacccgtctctactaaaaatacaaaaaattagccaggcacggtggcgcacacctgtagtcccagctgcttgggaggctgaggcatgccaatcacttgaacccaggaggtggaggttgcagtgagctgagatcacgccactgcactccagcctgggcaacagagtgagactccgtctcaaaaaaaaaaaaaaaaaaaaaattaataaggtaggaaacagacaatagaggaaatggacattgccttaaggcgtttttaaatgtgacaaaaccctacctcgataaatctgaaaaacaatgcactgactattaatttttttaactaaatgggaattatcattacaggctctttattcacaaatacggtgaaatggggataattttttttcaacaaatacaacaccttaagggaaggggataacattacttgtaaaacaaaacctcagacagcaattatttttttaatcccacataaggcttttcttctttttttgtggcaatagggatgaatgcttttataccccaaatttagagcggccgaatacatcctttttttgggctatttttttcatggactatgtttcccaatatgttgattctctcctccaaccttctcataaattcagtgcgcgtaatgccccttataattcacacagatactcgcagtgtaattttgtatagtctacttaataaatagcgacctgtcttcacccttctgtattggcgctccttgcattctgtcttccctccatgagtctccttgttaaatgacctcataattcgggtgtatgttagattctcatcagtaaatagaattttttggatttctttcaactagttctcaaataatgtgtatctatactgtaccttccccggacatgtggccg

SEQ ID NO: 806 - DNA, 13288 bp, Homo sapiens
  misc_feature (1)...(13288): n = A,T,C or G
aaatgagcgcggcaccttccagccccgtggtgaagaccctccctcccttccttcctctctccctccttcctccctcccctcccttccttcgtctctcccctccctcctccctcccttccttcttctctcccctccatcctctctcccctcctctccagtgcttccctcccaccccccacattcctttcttctgtttattcatttgacagatacctactgagttcccgctctgtgtgaggtcgggggtggagtctggggagaaggaaataagccaggaacctgcgtttgccgatgtgatggtgtgaagtggtgactggcctgagggcccctccttatgggattagtgcccccagaaagagccttatcgggggtctgtccctcccgccattgcctcctgaggacccgcatttctccctccaggggacactgcacgccaggcaccgtcttgggtagagagcagccctcaccaaatgcgggtgccttggccttggactttcagcccccagcactgtgagaagtaagtttctgtgagaattacccagtctcattgtgttcttaccccaaagccctggggctgaagccaggtgcctctaagccggctctgctgcccccgagcagagggtgcaggggagccagtgggggttggggggcgggagcagagcccttcgattcaggagggagcctggcgggccggagggacaggtgggctcaggctctctctccccttcgggctcagggtctctccttctccttcggggcaggagcagagcccttcgattcaggagggagcctggcgggcccggggggacaggtgggctcagggtctctctccccttcgggctcagggtctctctctccttcaggctcagggtctctctctccttctccttcgggctcaggctctctctccccttcgggctcagggtctctctctccttctccttcgggctcagggtctctctctccttctccttcaggctcagggtctctctctccttctccttcgggctcagggtgtctgtctcttttgggctcaggggtctttccctccttcaggctgagggtctctctctccttcgggctcagggtctctccttctccttcgggctcagggtctctctctcctttgggaccaaggtggagtcttgcttctccgtgggcatgtaagggtgagtgaacccacgacacttctttgcatggtgctcgtctgtgttctccggaaagggccgttacttgccggggccctacaatcaggacgatgatgacggatgccggctcccaccagcgaggtcacgtgtccaggccgtgatgtcgtgaaggctgggagatgctggcaccgctcaccggggtggtaaactctctgctgcaacaggtgaggggctgggctgagcgcaggaaggggaccccgaggatggggcttgccttgggctggcgctgggggctcgggctgtgtctgcagagccacagcacggggtcagtaaacggggcccactatgagccgaccctccgctcctaccgcagtgaagctgggggcctggctgccttgactgtaacgtgctggaatccacacagcccctttaagagagaaaaatgctgacttccacctggcgggctcataggccagcctcgctcactgcagtcacctgtgggtgtttcacacactgggggtgcggccgcctcgtggagcaagtctgtcgatgccacttttccaacagccagtgctcacgtcgccacgggtcatgatttggtagctcttgcagtttcaaacatgttccttttcttttttttttttttgagacggagtttcggtcttggtgcccaggctggagtgcggtggcgcgatctcagctcactgcaacctctgcctcccgggttcaagtgattctcctgcctcagcctcccaagtaactgggattacaggcacccaccaccccgcctggctaatttttgtgtttctagtagagacagggtttcaccgtgttggccaggctggtctcgaactcctgagctcatgagatccgcccacctcggcctcccaaagtgctgggattacaggcgtgaggcactgcgcccggccagaacatttccatctttattatatctgttcggtgatctgtgatcagtgagttttgatattagtatgatcattgttttggggcaccacaaactgtccccatataagacaggaagcttaatccatccatgttgtgtgttccgactgctccaccgaccagcagcttccccatccctctccctctcctcaggcctgtctagtccctgagacacagagcactgaagtcaggccacgtgataccctccagtggcctcggatgttcaaatggtaggaagggttgcaggtctctccttcaaatcagaagttaggaatggctaagcctggtgagaagggcatgccaaaatctggacagacggaaagccaggcctcttgtgcaaaagagttagccaagttttgagtataaaggaaaagtccttgaaggaaagtgtaagtgctactccagtggacacacgattgggaaggaagcgaaaaggctgttgccaatgtggaaaacgtggtggcggtcggatagaagatcaaaccagccacgacgtctcctcaagccacagccggatccagaccaaggctgtaactctcctcaattctgtggaggctgagagaggtgaggaagctccagaagaaaagctggcagctggcagaggtggcttcctgaggtttagggacagaagccacctccatcacacagaagtgcaggtgaggcagcacgtccagctccccgatggaagatccagctgagatcacggatgaaggcggctacactcacagcagatcttcagtgtagatgaaacagcagcaacagtgacagcagcaacagggcacaggccatctctagaactttctggaacaggacacgcaaactgagccccgttgcccctgttgtaccaatgaggacggaggctgcagagtgggcgggcgtggcctgggtcagaaccagccccgtggctgcacccgtgggtgcacgagcttcgcagccagctgccagggcgctttggctcagcacggccctggtgaccccaggcatggtgccgatgtcaccccaggcatggcgccgacgtcacctcagggtcaactcatgcctgacggccccgggatgtggtgatggggtctcagctgcgcacctgtgggcgccacctgcagttccttctgccgtccccgtctttccctgggctctgggcaccctgggagaatgcccgttccatctccagggactgctctggcctcggagatactgtcgcccagtgactctcaagtcagaaaccacaggccgacgccctgcttgctgggctgtgccgcagccttggtctgattccaggtgtgtccctgcccagggctgtctgcctgccactgcctctgcccaggccaggacaacgggggcagctcaggggtccctccagcacctgaccagggtgatggggagaccctctgcaggtgcaggggcccatgagctcccaccccagcctgccacacccgcgggggaagcacctgccctggtaagcagcgcctgcctggggccctgggagcagacccggggggaggggctgtgccgaggccacgtgcagatgccagggcttgccatggcaaccaaggacaggcatcctcggctggccaggcgagggcgtgtcctttccagctccccgatcttacattctttccctgcacccaccatatgcacacatgcacacagacatctactctgtacaccaaacatgcagacacgccaagataagcatgaacatacaggcacatgtaaccttggcaaacacacacacatgcctaccaggcacgccgcagaccccgacaccatcacacacaggccctcaagtcacatgcggttatgtttccagcctcctgtgcagacaggcatacgtgcacagccccacccgcctctgcgtgtccacgagcagacgcgcacctgtgcggatccagacacgcgtgcaccttgtggataagcagacgtgcgtctctctggacgtgcgtgctcatgggcacgtgcgtctgcattcagatctgtgtacacatcgcaccctgagtacccacagacacgcgtgagctctcaggtgtgcacacgcgaaggcacggctcgcggcttctgcggaggcctttctgatggatggaacaggtcctcactgttctggacaggagtgggagggcaagaggcccagccttacacagtcagttaaacgccgtcggcagggctccccacggcaggggcgggggtggagggaaatatatccgaggtggtgcacctggaagaaaggctccaaacagctgcagcccagtcccctctcggggccccacttggcagcgtctcctgcagggcctctgagctgctggttttggaaatgcagccaatgctgaggtccctcagcagcccagcagcaggccaggagggctacggagctgccaggggcttccaggacagctctgggagggccagggagctgctaggggcctccagcagcaggcagggagggctgcggagccgccgggggcctccaggacagctgtgccctgtggttggccttctgtctttgggcctctgtgctgggcatcttggagaaaccagctgtggctgtgtgtgctcagggctggtcaggggccccacgtcccaccccctctggtgcccctaattttaggaaaacccatgagaaactaccatctctactgagcacagaacgtgctttctagaagattccaacccaggagtctcgttaggaggtagcgggcctgcagcaggaggattttctttcggtgtaatttaaaaattaacttttccatccctctgagaatctagagtagcaagttcttgagggaacgggacaggcagcggccaatgctcacaggcctctgctgcacgctagtgacgaaacgcagcggaacgcgtgctcccagcctggggccaggagtctggagtcaggcatcgtggggccgaggctccaggggaggatcctgccacccggtctggcctctgctggcacccaggtgctggctgtggctgcagcgctgcagtctctgcctccttcccttgcgtctcctccttgtctctgttttctcttcttataaggatgcctgtgtttggatttagggtctaccctcatcagctgggcctcatcttaaccaactccacctgcaaaggccctgtttccagatgaggccgcagcctgaggttctgggtggacaccattctacccagtaccacgtatgtacatactcacggaaccctccaacgctcctaagagaggggcccctgatggtccccagtttacaggcgtgaaagttccaggaggaggctgagctgcacagggtcactgggtgctgggcacttgcccccgtcgccagctgctgcccagaaaccacccccacactttgtgacctgcagcaacaccagggatgatttttatcctgaatccacagctcgggcaggtttgctgcggacggcttgtttctgctacacttggcaggagctggggctgcccacacgctgggggccgagttcgcccaacgctcaggcacctggtgggtcgtggtggctgtcggctgagccctggccaggctgtgaccagacacctgcaggggctcctctgtgtggtctgggctcccacacagcctggcagctggttccatgagtaagagcccagagcccccagcccagagcccagagcccggagcaggccaagtgggccggctgcagccttctgccctgtgctcctccccagcccgccatgaaggccgtgcattcaggcagcggggagcggggctcctctccacgggggggttgagggggaaggcaaaggtctggaagaacacgcaggactgaaaatattgtttcggccatgtgtgcatttttggcacaatctaccatattagtagacgccagttccaaacctggaaacttgagcctctggacctaggtctctggatcctcagcacggaccaagccgcatctggggagcgcctgccggggagccaagcccgcaggaggggcaggtgctggcgggggccgtcactgcagtcctcatatggttaggccggggaatgatatttcctctccacctctctcggtggaccctaaatccaagagagaagacatctttctcacggcagccccatctcaggcagatcctgtcgtttgcagcctctgacctgtgggaggagcccaggcctgccgggaggcgggtgcacactcacagaacgtgcagcgcaggtgtgcactctagagcccacctcagtgctgaggtcgacgtcacccccgggctcttgggccgtggccaacggcaggtatgttgcaaatctgaacagcatggtgtttctaaatgtgggacctttgcccccaaatccagacttccggcttttcttttttctattttttttttttttgagacggagtgtcgctctgtcgcccaggctggagtgcagtggcgcgatctcagctcactgtaagctccacctcccaggttcacgccattctcctgcctcaacctcctgagtagctgggactacaggcgcccgccactacgcccggctaattatttgtatttttagtagagacgggggtttcaccgtgttagccaggatggtcttgatctcctgacctcgtgatccgccctcctcggcctcccaaagtgctgggattataggcgtgagccatcgcgcccggccccagcttttctttaaaagaacagaaggtggagcaaggctgagtccacaccctgcgagtcaggaagtagctgcagctgtctgcgggccgccgcctcgccccgcgggctcctgcctgctgtgccacgccccccactgctccccaccgcgttgcagctggcgctccacctgccgctcaccagaccagggctggcagccccttcccagacctgcctctctgtgatctcatgtgaccatggcagctgcagctgtctgtgggctgcacacccgggcacggtggcaagctcccgggatgggggatgatgagcaaccctcagatggccccacagtgtgccaggtatcgcccttacacacctgtaagggcgtcacctcatttcattctcatgacagctctctggggggggggggccatcatcactatcaccttacagataaggaagctcaggcaccaagaggttagataacttgctccaggtcacatagggacgatgagcgttgcaggtgtgtgcaggtgtgcataggtgtgttccagtgtgtgcaggtatgcccaggtgtgtgcaggtgtgctccagtgtgtgcaggtgtgctcaggtgtgcgcagaggttcccaggtgtgtgcaggtgtgcccaggtgtgtgccgatgtgcctaggtgtctgcaggtgtgctcaggtgtgttgagtgccaggcacgaggagccgaggcccttccacatgtcttaccccaggctccagcggcccagttccagggtgggaggtctgccaaggcctcatggccgcctgctcaggatgggggagggcaccttccccttcttggccatctgcccagtcctctcggggttgggggctgtgctggaggggccgggcaaggacgtgcctacgctgtcatctggtggctgcctcccaggaactagggaattccaggttcctgtccagagtccacccgcaggctcctgacacccgtggctcccccaggcccagaggacgcaggctgctgaggggctgcagcctatcagggtccctgcctgagccccgatgtcaggcaggcatcccacaggagcaccctgggctctgctgccttcccgcggtttcctgttgtgggcagggccacaggggctgttggggaaattcaaggcctgggacctgggaacttccagcctggggagggagacgggcgagggccaggagcgggtttcaggaagtgaccagtgccctgggagagggagagtggccgcaggtggctgcttcccacaggccccatggaaaggacatctgagctgaggcctgaggatgggagaaccctcatgtgtgaaaatggggaagtgggcgggaggtggggaggtgggcaagtcggcaagtcacagggcgtggggtaggagcttgagcgtcaccgtcgggaagaggccgtgtggtcagggagggaggagggtggctgccgttggcagctgtcagatgggactcgcaggcaggtttcggacaggtttcctttcccaggccgtctgcgagaacagagacgagggcttggatcagtttctgtctgagttggcgccttcccaggctggctgttggctctgctcccttctgggacctgttgggatgagcagatcagggagtattttgagccgaaaggtacgtggggaaactgggactgacagcgaattccctgtctgcgtttgcccacatgagtttttctttgtgctcttgtgctctcaggaattcagcctctgaatccctcctgggcctggggtggagcagggtgaacacatacggaagcgtaaacacagcgggccgacttcagcctgcagctcagccctgcggtctcctgggcaacgcgctgcgtggggacattgtctctcacctgaaaagctgcttatgggcccccacctcgtcgtgggtttaaagcggattaatgggagggttggtggttctggggctggcagggcttcccagcaggggcagccccttcatgtggtggcgagcttggtagtgacaacaggcaggccgctgtgccccgggtgggtggctggagctgggcgtggggtgtctccccgtgaggactgtctgccctgcccgctgctcacaagccttcggcgtttcccaccacgctctcctcaccttctactgggaggaaggtcccagggcacgggagggaccctgtctagagtggagctgggctgccccatctcaggtcatgggtcacggctgccccatctcaggtgacggcagcccccttcaggtgaaggccaaggcgcggctcttctcctcccagcctgaagcagatcctgttgtctgcaagtacccagcatccgatggcttctcacggcctccaccccggccacctggtccgagacactgctgtctccggcctggactggtgcagtagccagcagctgctgctctcgccctctatggggcagcctcacacggcccgtggtgcccctgctggtgctcagtccttgtgcgctccctcccttgagcatgtgcgggacctgtggtttatctcaaatgaatagaaaatggcaaaagcaatggggtgtcacttccaaatctggttgcggaaagaccctagtctatcttgctcatccctctcaccctctcccacggtctggtgaaaccagtggctgtgccgagagctgccatggggcaagagactgagggcggctttcagctaaatgccagtgaggagctgaggccctgaagaactgaatcccgcccagaactacatgcctgagctcggagccatttcttccccatgggagatgagacccctgcccagctgagtccagattgcagcctgtgagaccctgagcctgcggatccagccaagccatacctgatccttgatctaaggaaaatgggagctgataagtgtgtgctgttttcagctgccaagtgtgggaccttttgtgatgccggagtcagtagatgccgcaggcccaccccgccctctcctcccagccagcatgattatgtcaagaccagatcagctcacagcacttccctgctcatggctcctagtgtctcaacagccccaggccctgccccatttgtcacctcccagccacccaccccaggccctgcactgttcgtcaccccctggccactgcctgctccccaggcctgccctgttcatcacccccccaacaggccttgaaccattcatcaacccccggccacccgccccaggccccgctccgttcgtcaccccctggccaccggctgctctttccttgcttcctggcctcgagccacatggggcagtttcctgaacattcccactgtgtttgcacaggaggttccctctgcctgagatgctcctccctcactccttccaacatcagcttctcagtgagcccctccctgatctctctgcttagcctcagattcctcccgtgtccctgccgctcctgcttatttgtctctgcaggattcatcatcatcgggcccttccagctgtcgacctacccccgctgccactgggacgcacactccacaaaagcagggttctcctgtgtcttctctctcccctgcagcacccccagggcctagagcagtgtctgacacacggtggagtctcagcaaacatttgttcaaggagtaaaccgcaggagtggagggcaaatccaagcgtgagcctgagcctgcgttgccgcgggaatgtgagcaggtgccccggtccaccccggcagaggcctcccccgcccagcgcgtttcgccacatctcctcctctggccaactgagtcctcgcagaaaggtgtgtcaaacagatcattcctccacctgcatccctgagtgaggacaaacagcaggtcccctgaggacgtgtgagagcagttgcctgagtgagagatacgccttcgccattgaaggcactgagtctggggactgtttgttagagcagcagaaccaagcaatcctgacagcgcagaaaccagctccaagaaatgaggtgctgccgcagccacagggcacctggagcacgtgtcctgctcacgtggaggacagagagaaggcggggcagaggccggagcacactcggtgtggaacactcggtcagactggactcggcaacttggaagttggaccatgaacctgacgaaaccgcagctctagggaaaggctggaaaatcgcacgtcggcagacatgccagtgagatcttttgaggagccagacccagacaggaattgtccatcctgccagcaggcgtgaaagtgaacaaggagatttcaaaatatgacactcccagaaagctggaagagccggctgactgtagaccccaagtgatcaagaaagtgcactgacaaaagtctcaagcagggcacggcgtcacagccttgttcatctcccgtgcatcgaggcgtctcatggtgaaggtgccatgtgggcatggtgattttcacttggacaaaacggcgcaggggaaagtgaccaggtagggagaggaggatgacgtccctgaaactcagctgagccatcggcatgggcggaaggctttgtggccctgggaaggtcgatggcggaggagctgcaggggtggctgctgcatgtggagctggctgaagccagagatgagaaagctcctggggtctcgagagagtcgcgatgacaggatggcacccactcagtctacaagagaaacgtgtgcgttaatgcaaaccaccactaactcctgcgaccaggaggtgggcggcgaagactcaccggccccaaggaaggcgtgtcctgggtacccacctcgtactggccgagaagggtcatggaggaatcagaaacctctcggagggcagagccaggggcctcggaggatggcagaaagggaggtgaccttcaggtaggaactgaatctggactgagtgagggagcgtggaccagcaccagggtgggtgctcaggggccttcccgggggtttcaggtcctctgtggaccagcgactgccgccatctcccttctctctctccctgctgctggggccatcatgtccattccctgccacccactgtgcactgagcatgagggaggcaatgaccaatctcttcagtctgtgagtctccggtgaagaggtgtctggggtcacccagacccgatatggctgtgatttggggtcgtctcacctggggagccacgacggggagtgaacacagtcgattagtccagaaggcagacgtggaagtcagtggcgccgcccactaatattttggcctccttttccagacgcatttaggattatgctttccctctctctccaagttaggcccggccatgtgacctgctttggccaatgaaattctagcctttaaacacgagttcatgatgcttcctgctttggggattgtggatgtgtgttgacacctgggtccctgtcccccagtgatgacaaagagcaaaggcacctgctggcccacgctggacacacatgtgagaaagacatgcatctgtgaagtgctcagctgctgtggtgtggggctgtttgttacacagcccagccaagcccagcctgactgatacactccctcaagcatgaatagggctctgcctctccaatgaggggagtggggcccagggctgtttctcagcgatgtccagaacaccttactcctaggtgccccagaagcaatgacaagaaacaccacaggaggcatctgtggaggagctggtcgtggcagggtgggcacagctctgccctgctgtggaaggagttgacgatcccccagggccctgtccccgagggagggcctggtctcctgagcagtgtcctggatcggggctggcgtgtgagtaaaagtgggtccagccctccccaccccaagctgggagaggtgagacccccacagcccactaggcaccagtgactgatgggcccgccactgtcttcacagcccccagagttctctggtaatcacaggcgtggaacatgtgccaggaacctttggtttgcgtgtacctttagatgctcggattaaattacacccataatgcattatgtcattgataataatatcactgtgtataagacacggcgtggaaggagcctgctcctggacggttcatccgtctcttcacacacaatttccatacatgactaaagatcaccattttaacagcctttggtgcagacactgagaggcagttgcagagttaacagcgcataaatctcatttcctctgcactccatttttctcaggctgcagaatcaatttgagtctgtcaggattttattccaaagtctattaacggcccccgcttccttctactcccccgcccaccgccttcccctttcgtgaactcagtcctgcagaaaaagacgccttgctgatacaaagtaacagccttttatctctttacaacaaaatctaactaggcgtgaaggagacgcagctgggacaattaggcgagggtggaggtcactggcctggggatcccgcagcccaggcccttgtgggtctgcagctgggtcctggatgcgtagctcccgccctgggaagggaaactgctgggccttttccgcggtcttcaccacggggctggaaggatcgagnggggctcagtgtttttctaccc

SEQ ID NO: 807 - DNA, 14476 bp, Homo sapiens
ttggcgcggctccttccaatgacgcggcgaataccgggactggggtccccggccgcgggcggcttccgaggaggacgaggggcctccggtctcgcggaaccgaagtcctgccctcggcgagcgtggaagggacggggaaggggcggggaggaccgggggagggtcctcggccaggcggtgccccctccccgcgtccccgcggaccctcccaggccttctaggatgcgggaggggtctgtccgcgtccccgccccgcgccacgtgcccccaagtcccacaagaaggcggctcccgccaccgagacccccgggaacgcgcccagcgaggcgggggctgctgccagacacggagcgcagtgtggagggcggcgcgggcaggaagcgcacggaggcggctgcggttgcgaggcaggcgcggggcgaacttcctcctccacccccaggacaggccgagctcggaggggcccgcctggtggggttttctgagcccaggggccccttgcgcgtgggcactggagtcattgattcatgcagcgcgtatttgccagatgcctcctgtgtccaggctctgttggtgaccccccagcggctgagatagactaccctcttataagtgggagagagaccctgaacacaaggcccaatagaatatcagccaaggataatctgaagaaaatcgaacggggaggtgtcacagagagtgggcattgggtggtccagagggcctccccgaggagtgacgactccgagccccagcagtcatgggcaccctgtttcaggtcggggctacacccctgcacaggccctcggagaagaatggtggtttgctggagggcggaggggagggtgcccaagacagtggtgggaccctgccctcggttgcccttagtgggaacgggtcctcgcccactctgcggggtccactttaccctgcctctgggagagcctactggcggcctcttgtgcagggcaggaagggtgtggtccaggcaccactggctgtttgctgggctgaggcagttgggaaagtagctcactggggtggggggacttcctgttcacccagcctcctccagtccacccagcccgctctctggttccctgtcaaagcctccccagggtgggggcagggtccccctccccctcttcccattccgggttttgttaaaccgtggtttcaccctccagcatcctcccttttgatttttaaaagcctcattaggaagacagaaacggaccccgagtagtttctccatgcacgcctgctcccgaattcccctccctggacagaaggccaggaaatgtgggcgagggtcacccaggtggcatttgaggctcttgtttaaatacaggcctcttcccaagtagcctgggagtcctcacctgttccccgaggctcccagaggccatcccaccctaggctgggcccagaggtcagtcagactgcaaggggcatcctgtgggcaccccctcccccccagaagaattgcttgggaaggtctgaggttttggatttgaagtttctttctctttttctttttctttttttttttttgagacagatctcactttgtcacccagactggagtgcagtggcgtgatcttggctcactgcagcctccgtctcccgggttcaagccattctcttgtctcagcctcccgagtacccaggactacaggcctatgccaccatgtctgactaatgttttgtatttttagtagagatggggtttcgccatgttggccaagctagtctcgaactcctgacctcaggtgatctacccgcctcagctttccaaagtgctgggattacaggcgtgaaccactgtgcccagcctgaagtttctgattatagacatacactgtttgtttatctgatctccgaagatgttcagatgtgtgaccccagtgaagggcaggggctctgtagacctcctcaggggcttcctttttgggctcccccccgggtttccctggctgtcctggggaaggcgtccccaggtgccttctctcctttgatccatttccaggtgtccagatggccaaccagggaccagccgccatctctggagttctgggctcaagtgctccccagggaccagccgccgatgctggagttctgggctcaggtgctccccagggaccagccgccgtctctggagttctgggctcaggtgctccccagggagggcttgctttgggaaccttctcttacagaagaaagcagctgggctacgtgctggatgggaagcccttgggagggatggtggttctgggggtggttctgggggtggtttctgacagatgcgtacttgcctgcttgcggaccgggctgtgtgtctccgggagcacgcatcacagtgaccggacatcccacccaggactccgaacctccctggggcttgccagggccctgggcagagcttgcagcacgaaccccaccccccacactcccactgacttcttggtgtggtgcaggttggacctcctgtgcttgtttggtttttcagtttgtgtgctcacacatctgccctctcttgccccgggcaggatggggtgctttggaaggtagagactgcagcggttaggagacctccaggccagtggcctgcagagctcggaagtggagggaatggctgggttgtccggacggtggccgccagccacgagtggctcaagcctctgcagtgtggcaagtgcagctgaagaactggattatacattttacttacagactttaatctaaaatataatagcctgtggggctggtggctaccatgctggacagggaagttctagaccggctcgcctgggccccagcctcagctgtgccacccacttagaatattttgggcaaatgatttaacgtgcttccatcgtcccgtctataaagtgggggtggcgtggcgatgaggcgtcccgccgtcgggggtgtgaaagcccctgggtgtgtgtgaatcggtgtgtgagtcaatggaggcctcagacccacgacgggagggaggtgtgagcacacacagctgagcccaccccagggttccccacccctcacgtctgaggttctctggggctggtcggggaccacactctgggaaccatgggtttgaatgcaccacagtcagggccctggtacaatcagggccgtaggtgggtgctcatcaagccctccagcccctccccaccctcttccccagctcttgccagcaaaaccccttttctctccactctgctggaggcccacagctcctgcccacaactccttcccagcccctagggctcagctctctggccccaccaccagcccaggtccctttcctgctcacgccacaccccttagctctcatccttccaaccagcccgggtccctttcctgctcacgtcacaccccttagctctcatccttccaacccgcccgggtcagagccctgagtggtgctatgagcatcggtgggctccgggatggcacatcagctcctccatcgtagccactggcctttgctttagagagtccttccctgccatctgtaaggctctgtgcaaagttaattgatgtgaaattgtattcaaaattcaatttggggcaacggatccaaattaggctctataaatcagctaagccatttgccctttgggtttcaaacttgcctgtggggtgacagccaaaaagtagaaagtatgttccatttcttgcagcccccagccccatctgtgagccggctgtcagctccagccctccgcatgcacccctcttccttcccgtaatggcacctcagtgtattttggatgcatagtctgctcttgtgggtgccgtctggtgacacagcaggtcctaaggccccatgctcccctagaaaaggaacaaaggaacgtcagtcagctcttgcttggagaacgctgtgtaacaaacagcccctgggccctcagtgacaatgccttgctcacagggttgcagggtgacaagaggggctttgcttcttcatttggactttggttaggcccagctataatccactggcctctttctgtgggatgcaggcgttcattctccctcagtggctcaggaggctgagcagagccatataaacctaggagaagcccgtgcttgaagcctcatgttgtgtctgtcaaggaagtttcaaggctaggaccagcctccacggggcagagaagtcgtgctttctgctctggtggggtgtgatggctcagtttgtcatgcaggtgacccaggtgacaccagtcaggtggcctcttcctggcattgcagttagaatgtgccttgagccacatgtcaaggcaattgagtgtttggagtcctcaacgtgcccccttccagtcatcctgctcctgaggatgtgctgttgcctggttccgagcctgctgcagctctgcgggccgccccctccctgttcacccaggggagcaggcgtgttccctccgcaggggcttgagacctgccgtcctttcccctggaccctccctctcccccaagccctaacccaatgccactccttcctgaggctgatggtggctttgcgtgaggtgggccctgctgagcagcagagaatttcttagaattttcatcgccagatggctctgggttagggctgaccacagaaaaccagcaggcatgttggaaagcaggagtggaatgcagaaggcagagggagccacacggagcagccaggttacactcctgccgtcgtgtgactgctgcagaccccctgtccccgcacctcaaacgggcttgggccgttccaagccctgcagcaccgtgggctccagccacctcctgccactgcccctcccagtctgtgtcaggagcactggagtctcccagtcagttcctcaggacgctatgtcaccgtcatgatgtccgtgagctcccatgcgcctggctctccccgttaccacacttacctttctctcctggcagccactccctggctctccttggagagtgtttcagctggccatgctccgtgtgcagtgtgagagtgcacaagcttgcacaggtgctcacaccagaaagggacgttgcaggttgggaggagggtccttgtgccaggccctggcccccgagtctgccccttgcagtggggtgcccagcctggtgtggggtcaggctgtgggaaggaggagaggccagggacaagcagccgggattagcttgggctctttcccttgaaagtggcagaaatgcaaacccaaagcagcccgtacctgtggggttcccgacaggccccggcttcaggcagggctggattcaggcagcagcccacaccccgtggggttcccgacaggctccggcttcaggcagggctggattcaggcagcaccccgtaccccgtggggttcctgacaggccccggcttcaggcagggctggattcaggcagcaccccgtacccgctggggttcccgacacgccctggcttcaggcagggctggattcaggcagcaccccgtacccgctggggttcccgacatgccccggcttcaggcagggctggattcaggcagcaccccgtaccccgtggggttcctgacaggccccggcttcaggcagggctggattcaggcagcaccccgtacccgctggggttcccgacacgccctggcttcaggcagggctggattcagggacaggggttccagcagcctcagctttaagtggggagttaaggggttcaatgtcgacaggaaaaatagaattttatgaagctctgagcaaagtcccgagtcctctctgaatgggatcttcaggccgccaagtccctgcagctcgggggtgtgaagctgtgactgacaggcctcggtctaccgagaccacagactgaggaggcagaggcgggccctaaaactagatgggaacggacaccgtagggggccaggtccccacctgaggcccacctgcctcactggaccagcaccggggctcgagtctgcaccccacctacccacctccccgcagtgtcccggccaccccacgcagctctctggacatcgtgtcccggctgccccacacaagtctctgaggcccgggcagctctctggacacctttctgctacttgtgccacactgttggttcttgggcccgagctgttcccccctcccatgcccagcaggtcccggttatgtcccggttatgtccggtttacgtcctggttatgtccaggttatgtcccggttgtgttccggttatgtcctggttaggtcccggttatgtccgggttaggtccgggttaggttccggttatttctgggttatgtctggttaggtcccggttatgtccgggttatgtcccagttaggtcccggttatgtccaggttgtgtccgggttaggtcccggttatttccaggttatgtccaggttaggtcctggttatgtccgggttacatccaggttacgtcctggttacgtccaggttaggtcccggttaggtccgggttatgtcgcgttaggtcccggttaggtccgggttatgtccgggttatgtccgggttaggttccggttatttctgggttatgtccgggttaggtcctgttatgttccggttatttccaggttaggtcccagttaggtctgggcgcatctgtcagtcattgctgtgtcccagcgatggcaaatctcagtgtctgcggccgtgagcgctcacattcttctcagctctgcaggtcagctgcagggctcccatccaccccagggaggagtcatgcccggctggagcctgggtgactgtgtttccccatgtgagaccaggggatgggtgagccaggcctgtgaggtataaggcaatgtctgcaagggcgtctggggaagatgcccctctgtgatgaagagagaaggacacacaaagatgtcatccgtttttcatcctgcccactcgccccactcctggctttgaatgctgccctgtgagcatatgctccctagagctgtggcagcctttttgcactcatgaggcagcgagctccaggaggaagagccaacgtgctgacacagtggggcagaaagacagagacaacagaatggggagctggcggcctggaccagctacctccagacatttcatccgggaagtagctgtccgtacagtttgagctgctctttgttggatgttctgttacttgcatcctatggatttggcctctggctgcaacgtgacagcatcagtttggggaaacaaaaacatgtctgtattcaggcagagaggcatttaacgtggggacaggtacacaaatgtcggaagggctgtgcggccatcgcggacacgagggggctgggacactctcagtgccaacgggactggacacgagggggctgggatgctctcgtgccaatgggaccggacatgagggggctgggacactcccagggccaatgggactggctggggagctcctggtgacctgcagagcatgatttttggctgcctctgtgcaggtgtttccagaggagactgcagtgtgtgtccgagtggcggaggtgaagatgacctgccctcagtgtgggtggcaccttccagctggggtctggagagaacagaaacagaaaaggggaatgtgtctctccccacggcagctgggatgcacgcttcctctcctgccctcagacagaactgcaggcgccccagcctttgggctctaggactcgcactggcagccccgggtctcacgcctgtggcctcgggctgaattggggccatcagcttcccgggttctgatgccttctgacggggactgagccacactacccggatccggtgttgtccagcctgcagacagcctgttgtgggacttcccagcctccatcatctggttcccctaacagaccctgctcacttctctctctgtgtcatgttggctctgtctctctggagacccctgactaacacagttgtgctggaggtgaaggaagtgaggaggctgtgttatgggttaccgtgtgtcctcagtatcactcactggagtcccaacccccagaaccccagaatgtaacactatttggaaattgggtctttgcagatgtaattgcaaatgttaaaatgaagttcccagatttggctggtctctacatccaaacactggcccccttgtgaaaagacacacaggcctaggggagacggtgtgtggggacgggagcagaggctgcagcgacgcaaccacacaggcgggaaggccaacaccaccaggaacaggaagagacacgggtcctcccctggagcctcctgaggcagcgtggctccaataacactggttctggacatcaggtctctaaatctcaagggaagacatttctgtgctttaagctgtactttttttttctttttgacggcgtcttactctgttgctcaggctggagtgcagtgtcgcgatctcagctcaccaccatctctgcctcctgggttcaagcgattctcctgcctcagcctcccaagtagctgggtttacaggtgctcaccactatacctggttaatttttgtatttttagtagagacagggtttcaccatgttggtcaggctggtcttgaactcctgatgtcaagtgatccacccgcctcggcctctcaaattgttaggattacaggcgtgagccactgcacccagccttccactgcactttgctatggagcctgggaaacgaccacagggtgctcccaagaaggggagcttctaccccacacagatgagagcccagcaggacagcctcagggaggcccacagtgcacaggggccagggctgctgatgggagggggccgctgggtccctaggggtgcagcctcactggtgtggaggccgaacagcttcccttccagttggcagggccacctggaagcccagctgcagggaagcctggggcacacagggtgtggacggccggcccgctcatgcaccgtgccccagggttggggtgctgccaggaggaaatgacaggggcctggggcctcgtggacagtctggaagtttctctttcctgaatgcataatcagtccttcgaagatcccacaaacccaaacttaacccacagaagccgaccagcgtgtcggatgcagcagctccggtgggaacgggccctgaagccagtgtctttcctggaggacacaggggacagtcccggctgagagccgggagtttcattagaaaccctggaggagagcagctgccccagagccccatctgcgatagaacattagaaacagtccccgtggcctttgttacggaaaaggctcgctgcggcggcatccttgagcgcaaacgctgctgcggctaaggcacgaggttgctctggaggtgacgtcgcggagggaagaggccatacggcaggaggggtgcagccgctcgtgtgagcgggaggagccccgtgggacggtgctatgcctttcccgagggtccctgggagtgtccgaaagtgcggagaaaggtctggaaggtggccccctgccgccacactcggaaccttattttttcagcaagtgtgagctttggagcgcaccaagatacgggcgtgtgttctggggtgcgtgaggtggtggtgccgcggcagcccaggcatccctgtggctctcccagaggctctgtgaggccgcccgtgaccctggaggggtgggctgtgagggccacctgcgaccctgggggggctgcatctgcagagctcaatcctctggcaaggtcaggggtgaggcgaggggccaagctgagctccccacctccctattccccccatgcacttcccagcgtcatggtgtgcagcccacacatcctcccaggacggcccttggagccctttcctccccatttctccagtctgagtttggggcgagagtgccgacatctgacttgtagttaggagggttcctgcacagcactgtagaccgtgggccaggggccaagagtagaagtgctgaggggccaaggaggctgctacagggcccagggagaggcaggggtggcctgtacctgaccagcatgggggctcacttggagggcagtaggggagtgtttccaacaggacttgttcctggctgtttgggaagtgaggcagagctgagagccacagccggaggtgcaggcctgaaccctcaccagcctgttcagggcattgagggaggatgctgaggccgtggggaccagccttgggctccgggagctccatgcccggtcccaggagcctgggatgtagcaccttccgtggtgaggagacttggtggatatggttgagctgaagatcttgagatggtgacggagccctgcatggtccaggcggccctggatgtgttcacaagcgtccttgtgggaggctcggcaccctccggacgctggaagattcaagggtgggaccctcccacagcctgcagaggaacccggcctgcccacacctccacgtcagccccaggagcccctctgggacttcaggctatgagaaggtaagtgtgtggttttaaacagcccagtgtgtggtggttcattacggcagctgcaggaagggagatggtgttccagcgacaggcggctgcaatccctgcatcaggagcgtaagtgagaagagcagcccgccgtgcaggcgacacaaggaagggtccactccggcctcctgcggcccactctggcccactccagcctcctgtggtccactccggcctcctgcggcccactcttgccccctgcggctcactcctgcctcctacagtccactctggcccactccagcctcctgtggcctcgtcagtttggaggtctgaatttcattcctaaggcaggtctgggaggttgtgagtcatacaacgcaggttcccttctgagagcattgctcctgccgggctggatggtgccccgtggcctgcacagatagacgggcatcctcagaagcacatgccaactcccagtgcggcctgagtcctgggacacccccccccccaccaactctgggcactctctccacccctgcccaccctgcatccccgcctcagagcggcttctgcctcggggcctctgcctgtgttctctccttgctggcagcttccactcatgccttctcggaggggcatggcagggctcctcagggtggcatcaggtcaccttgccccacgctggtgcccacaagaccgatggtggctctcactggtgtagtgctgcctgcactacaccgtgagccccggggacactgtcccttcactgctgacccccgcggctggaacatcacctggtgcacagggagctgctcacatgagtggcgtgaagaaaacggttcccagcagagaacctggtgtgtgggataccgcgaggggggcggcctggtgcgtgggatacctcgaggggggcggcctggtgcgtgggatacctcgaggggggcggcctggtgcgtgggatacctcgaggggggtggcctctggacggtgctcatgaggcccagatcaaggtgtgggccaggaggttcctcctggaggctcctggggagaatgtttcctgggaggatagaaaccaggcccctgtgggcatcgtgcgggaagggtgagctggtctgagagtggagctgactccaagagtgaaggtgagagggagacagaagcaaggcccccatgacgtcctttgagcccctggatccagctagacctgaagccacccactccaggacgtcctggttatgtgagtcactaatttctcccttggcttcaaccacttttgttgccttttctgtcacaattcagaatgccctgacttgtgtggggttgtgcagtcaggaaagaggaaaaggtgtatccagaaggggaatccccagggccagagctcaagaatcagcccccggctgagcaccacatgtagtggatggagcccagggcccccgaggtgcacggcccaggcagatcctcaggctgtggggcaggagagtgctgggggtggcggcctctctcacccccacctcggcctctctcacccctacctcagggtctggccagctgtggtgcttcacagaagggatggaagtgattgtgaacctatcacgagcccaactccagacactgatcccaggaggatgcgcccaggctagtccactggccccaaaaggacacacccaggctagcccactgatcccaagaggacacacccaggctagcccactgatcccaagaggacacacccaggctagcccactgatcctgggaggagcccaggctagcccactgaggaggcaggggagagagatgcaggtggggtgagaggacagttggggatgcatcttggtgatcatgattggggaggacctcctagtgcctcagctgtggtgggggaggggtgggggatgggagggcactttgaggctcccaacctgggaggagccaccacaatcagcccaaacgtcactgctccaccaggctgtgtgacagctgcagtgtggtcaggctgcaaattggcccttggttctgcagggacttggagaacctctgcggcgtgcagggggtggacgctgacccggggcacaggccccacccaagcaaaccgcagcagctgcagcagggctggggagggaagctcaggggtaggagccgatctgatctgtgcgttccagggcttcccctggaggaggcactcggggtgagggggccctgcagagaggcccagagctggggaggccagtggagccgggagccacctggagggaggaggaaggtgcggccgggtcagcgttgggaggggtgtagctcagcctaggggccggtggtaggaggggtgcagcccagcctgggggctggtggggaagctgcatcccatgaggggccggaagcactgagggcagctcagggctgggttgtttccaacaggccaggtgtcatggggtgaatgtgtctgaggaaggagagggcaggctggggagaactggacagtgatggaagctggggggactccagccgtcctggcctctgggggctcctgccagggcgcagggtgcggggacagcctggtctgcatagctgcgagtctgaggacctcttcaggaagacttgtggggtcagaggctgcacggtccgtgaggggggcggcagccgtgaggttcgggatcacaggacaagggccgtggggtgtccggcatgggcattggagaccgcgatggagtcaggttctgctggacatggaccagaagtccccagttcagttctgagcacgtgggtgaggggactcctggggggccgccaggggctccgaggagatgtgggctcgggagctgtgatggctgggctgtgtcccccacaaatccacatgctgaagtcccacccccacgacctcaggatgtgactgcataaaggggtctttaatgagggtgtcaaggtaaagcgaggttgttggggtggaccctgatccagtcccatgggtgacacaatacgaagaggcgatcagggaggaaaaggccccggagagcggctttgagagtgacgaccgcccgtgatgaccggcctgtgataactggctggtgataactggctcgtgatgaccggcccatgatgactggcccgtgataactggctcgtgatgaccacccgtgatgaccgcccgtgatgaccggcccgtgataactggctggtgataactggctcgtgatgaccacccgtgatgaccgcccgtgatgaccggccgtgataactggctggtgataactggctcgtgatgaccagcccgtgaaggacaaggaagaggtaaggatgcagacaggcacagggggccaccaggtgaacgcacagaggagacaccgactgccggccaaggagggaggcacaggatgaacctgccctgccggccccagggtggagacttccagcctccggggtgggcgacgggtgccccagcctccggggtgggcgacgggtgcgtgtggtttgagccgctggcctgtgtcgtttgttgtggtggcctgaagagacctgcacggtagctgagtgtggtggacacgccaaagccgcaggcaggagacctgcagtgaggctggcaggaccatgtggcggcaatggccaccccaagcctcaggggcttcctgcagggatggctgctcagatgccggggcctgcagtgctgatgagggtgtgcctgggccacatcgccatggaggacgggaggggcctgttcgtttctagagggacacgccggccacccggatgcagataccacgtcctcacggatgcgcacacgttgcttagacaccatcacgtgagccttttgagctttgaaggttgagaacatattcctaagaacacacatcagcgccatttagagcttctaaggggttacccccggaggagggggcgggtcacccccggaggaggggggccgggttcaccccgaagggagggggccgggttaaccccgaaaggaggggaaggggcacccccgaaggaaggggaaggtttaccccgggggggggaggggtcaacccccagggaaggggaggtttaccccttaaaaaaagggcggggggttacccct
